United States Patent 10,240,205 (METHODS FOR ASSESSING RISK OF DEVELOPING A VIRAL DISEASE USING A GENETIC TEST) - sequence listing, part 14

SEQ ID NO: 1515 - DNA, 532816 bp, Homo sapiens
cggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 1516 - DNA, 532816 bp, Homo sapiens; identical to SEQ ID NO: 1515

SEQ ID NO: 1517 - DNA, 10681 bp, Homo sapiens
caagtttattccatcatactgattttttattttaacttcatataaatcacttttatattattttatttggtattttatcttcacagcttccaaaattatttatcatttatttaactgattgaaagtgagccagaagcaaatttgctgtcataaaagtttactaaaaatcaagagaaatggcttcgtagcaccattactgcaatgttacaattacatacgttgttattagaatcatttctaaagttataaatttatgaagctttgagactccatttcaatatatcagaaaaggaaatcatgttaataaaaaatcattagacgcaaaataatataaaatataaatgaatacatgaagtaacaatttttaactcttttacaaacttatgtacaataagattaaaataagacagttgtgcattcaagttttcctgtggatctgctcatcttcattgcaagggttgctaggtaataacggcacagggatatggttattctgaatatttttctcactgtcaaagacagttgttagggacaaatagacaccaaaagagacaaatagggatcccttattggctccttacattttgttggataaagcacaatttccttgcaatgcttccccatccttctctcccaaatattgttctctttctctctctctctcttttttttttttttttctgagacagagtcttgctcttgtcgcccaggctggagtgcaacggcacgatctcagcttactgcaacctccacctcctgggttcaagcgattctcctgcctcagcctcccaagtagctgggattacaggtgcctgctaccacgcctggctaatttttgcattttgagtacagacggggttttgccatgttggccaggctggtctcaaactcctgaccacaggtgatccgcccggctcggcctcccaaagtgctgggattacaggcgtgagccaccacgcccggccctctctctttcttttttttttttttttttttgagagacaggatcttgttatgttgcccaggctggccttgaacacctgtgttcaagccatcctccctcctcaacctcccaagcagctagaactatgagcgtgtgccacggttcgcagctttatcattctgttttgtcacaactctcttatatagttaatatacctttgggagaagcatcacacacatacaaaatgtagcaaaccttgacctgattggcatttctgagatgaagagacccacgagagccaatagattttcctctccccaacattcaagcaacttccttccaattgtttgctaattatgatatgtgaagtttgtgggtgtttctaaattagggacttccttaaaagagtttgcgtttccagaagatttgctacttcagacatcaacccattattagggtgtcttgttcacagtcctcctgcccattttaagatcctttattaaagtagcttgaaggtgaccatgcatggtctatacctccatccccacccataacaatcttcttttgtacaaacataaaaacatgcttctgctgattaaaacatacagcgcatgattggatattaatgctttggagagatggtttggggtcacaatcacccagatactctcattaggaggtcctatagatcatggcctgatggaagagtttgtgttacttgaaagtaaacgtcaagggaaaagaatagaaaaatctatcactaacaccactgttaactcaaatgaatcaaataataaaggatgttgatataaaaacatttgatcctctcaccatgctttttaggatctaccttctgctctcatcctacctaaaagtcatagaaaaacgttgacactttaggatgctcccaggtcctgcagttctgttattcccagtaggggacaatgttgcattcaaaactgcaccaattgcagcacgtccctggccagacctgtgttccttctctattttcaagacatagatctttttaaagagtcgtatataaatattttttctgtaaactctaagaaagtgagagttgaagaataaaaacagagaagacttgaaggactgttttttatccactgtcttcagcagagatatttcatcgtgtgtgacattcctggaagttgctatcaaagtcccaaagtacgaaatgcgtctcgtaagtcatcaacctcatacaggggctgtagagaaagagagaagcaaattgagtgaatggcttcaaaacgaggttgggggtcggtggggccggagagtcttctaaactgagtggatggctttgtaacatgttggaagaaagtaaattgggaaagagtttttttgggttttttgtttgtttgtttaaaaaaaaaaaaaaaaaaaaaaaaaaaggagaaaagaattctgaccaggaaggaaacgcaaccctggggagagacagaaatttaaagatgtgaaacaacaaaagaaagaaaagggagggaaaaggaaccttagcagagggctctgaatggtgaaacagcagaagaaaaagctgatgtggaggagaaataaagttttcatcagatgaaaactgagagtgattgaacaataagaaaatataagaaatatacgaaactccaaaaaagactgtagagaaagaaagaaaatttaaaaagcgaggaagccccttaccaaaaggatgcgccgaagctgtctggagagacgaactgaattttcatgcagcccttcccaggctttgaaagttctttcgtggttttctacaaaagtattccagcagtaaaaataatcttcaaaaaaaaaaaaaggaaaaaaaggcggggatatgggggtagaagacagttcaggttccaaatcgaggggaaagaagcaaccctggccccattttctcatttcctcggggccttgtctctgagccattcactcttttctctgcttctaatctttaatttcggctccagaggtgaaccagaatccccgcccacttcttcccctcgagcttccccactaactcattcattccgcatcgcaatcccgaatgcgggctgctgcactgcgcctgcgcggaaggccctttcgcacctttgaaggtcatgatggctatttgcaccccggcgcggtgcagccgccgcagcccctcgggctcagccttgcggtcctcacagaagtagaggcgcgcggtgaagatcctcagactgaggttggggttccctcgcagaaagtcggccacatgtcgggcacagtcgtagcaggggctccaggaggtgaaccaggtgacgcggtagcagcggccagggtctaggtcccagtccgagatgtagcggaggaagagcaattccacgtggcagccgttctggagagacagagaggaccacgctaaaattcactgacttttattgcggctctggtagccttagtcattgtctcctgcaatgatctttggggatgcttgcagctattgtccttgtgttacagagaggctaagcaacttgctcaaaagagcacaccagtaggtagagctgaacccttggcagcactagtcctgcagagtgaaggaaggctatgggtttttgtggaatgaggaagacgaagtgcgctgagttgggaggaagcagcatcacactacctcaccgaagatttaatttgtgtttatgaagttgctttttgcaccttttgagaaggaaaatggctagaagtgcctgttgatgtaacattgtggaaatatacctggaccactaggtggaggcaggacagtttatgaggaccatttgggaggatctgaaaaggggaaatagattttggtaaagcagacagatgggtattgtaagagaagtaataggcactgccatgagaagtaaatgaaagtgcttgataaaatcaaagccttctgaaatagaatgtgtcatgtcaccgaataggaaggagattgggatgtattcaatacaaatgtaggcaaagaaaattgcatggtaatataaccatcaaacaacgagccagacgatgaccttccaccccacggatgcttccctgagattccaccaagcccagacgtcacagcgtgttaggagagaggagatacccgtgggcagaagtttatgtaaacccatctggattttggtgaagaagtctcttggaaatgtaattctctcgggtagccgaaagatcaatttaattaatcatcagccgaggcttctctgagttttctggggatcaccatgttgaatgtattcactggcctacgacccatgtgagtaggagggaaaagaaatcatttggaagacagaattgagccaccgttaattttttcccaaattcttcttccttaattttcaaaaatgcttaagacacaatttgtttttcacatttaaaatttttgcttggacaagctgataatattctcccatataaaaatgcttttagcttaattaatctcaaaggcaattcagatgctgaggaaagctggtaaacagtttgggagcagttgttcttggcactgaaggaaggagtggtattagggtgcccagcattactggggaggaattaaatcacatattttgggccatgtctaatatgggtgcatggacatggaaaaagaaataaaaaaaaggatttgaggaatgtgatagagacacaaatgccaaaaaaggatggaagtaataccatcagcaggtggctctaaaagcactcacagttgaccattaaactgcttgcaaagccgactttaattgataccttattgcgaagataaccaaagtccagtgaaaaggatgtagcactgtcacgcctcttcactacgtagcacaggtaggtctcacgccgacccttagcccagcggacatttttgaattggtaaagaaacttcctccggttcatcaagaggctgtgggtgagaggagggagagaaaatgcaagagtacagtttataatctggtcactctggattttccttcagctttttaaggaagtcattacttgggctaaaccaaagaagatgctctgacttcctctgctggctgcctgagccctcctgagccctgctgagcctggaatccatcataaactccttttcctgcttatatttaaggccaattgagagatactcatcaaggaccccaaacccttacccacaagacagtcacctcctgccactgtcttctagatgctgatgacttgggattacaattaaatttgttcttcaacaagaaaacgaaacaaaaaataaaataaacttgttcctcagtcccataattgtatattcagatttcccctccagtctttacctaagtgtccaacttgtacctcaaactcaaaatgatcaaaacaatattcctcaactgccccctgtcctaaactgccactcctcccgactttgccacctcaggtaagcagcctagcagcctggaaccatccttgactcatttcttattcctcagtcctcatatttaattaatcatctaaatgtgttgattcaaaccccccaatatttcttgaatttgtaccttccctgtttgctcttctctgcttcggtccaagccctcatcttcttcctccttatctgttgtgctggccttttaaccggtctgtctgcctccagtccctccaaaataacattccccacactgtcaccaccatgatctcacaaaaaccaggtgcaccatgccattcccatgctgaagaccccctgatggttctcttctgcctgcagaataaactccaaactctttaatgtggtgtttaggccactttttacagttggatcttgatctaaatttctttttttaaatttttttttttttgttacggtctcactttgtcgcccaggctgaagtatactggcatgatcttggcttactgtagcctcaacctcccaggctcaggcagatctgccaggctccgcggatcctcctgcctcagcctcctgagtagctgggattacaggcgcccaccatcatgcccaggtaatgtttgtatttttaatagagacggggtttcaccatcttggccaggctggccttggactcctgacctcgggtgttctgcccgccttggcttcccaaagtgctgggattacaggcgtgagccactgcaccggcctattttttaatgtataagagcaatacctggctgggcgcagtggctcacacctgttttttaatgtataagagcaatacttggccgggcgcagtggcctacatctgtaatcccagcactttgggaggctgaggcaggtggatcctctgaggtcaggagtttgagaccagcctggccaacatggtgaaaccccatctctactaaaaatacaaacattagccgagtgtggtggtgggcgcctgtaatcccatctacccgggaggctgaggcgacagctttgcttgaacccaggaggtggaggttgcagtgagctatggtcatgccattccactccagcatgggcaacaagaccaaaactccatctcaaaaaaaaaaaaaaaaaaaaaaaaagaaagagtaatacttgatcattgtcaaacttgaatactatggaaaaatagaagagctctaaattttaaaatattaaagattttttaaatctcaaatatcatagtgtctaataataataattagacttagtgtctaatgacaatgactgttaagattcttgtgtttattcctctagtctttctacaggcacatatttacatgatttggattatactgattgcatgtgtgattttgtactctgctgcttttttaactagtcaaaatgatctaaatatcttgctatgttgttcccacataatgactgatttctcctcctctttgttttctggctcctagcacagtgtcttgcatatcataagcactaatttgaatagcatttgtggaaatactctggtaacccaagtttccttaaagaaatcaagagtccccattgcagctgcagacagcaacacaagctgtacagcatggttgatatgaaagcacaagtgatgcctggattttgtccctagtcttttccagaaatgcatttatccaatttgtggagctagtgctgtcacctaatggtacggggcagaagtgcagagaatttgcgaagtaaagggctcaggaatttgaataacgtttgctggcaagagaattgaaagttttcttacacattattttttcttacattgaggtataatttacatacagtaaactccacccatttaagatgcataattctacgaatatttttggatgtaaacaccccaaactgctaccacagtcaggatacagaacctgaatcaccaccctcaccccaccagagcttcttccctctttgcagtccttcccctccccacaggacaaccactgatttgctttctttttttcccatttttgtggagaatggagtttcactgtgttgcccaggctggtcttgaactcctgagttctagcaatcttcccacgtggcctctcaaagtgctgggattacaggtgtgagcctctatgcctgccctgatttgctttctgtaactataagttactttcattttctagaatttcgtatggcatacattatctcctccttcatgtctgactctttcatttagcgtcatgactttgggattcatccccaagtagcttctttgtactgcagggtggtattccattgcatggatatagcacattttgtttatttgttcacttgttgatggatatttggatagtctctactttggggttttgtgaataaaggtactatgaacattcacgtaccagtctttgtgtggatatacattgagaattgatattttaataatgtagtgcaggtgacagaccctgactttaaaagttaaataccaaaatatcagcctaactaagtagctcatctaggacaacagctctttgtagttgtttccatttatttttaatttttcttcttatttttttgaggcaaggtctggtcctgtcacccaggctggagtgcagtggcgcaagcactgctcagtgcagccttgacctcctgggctccaacgattctcctgcctcagccccctagtagctgggaccacaggcacatgccaccatgcccggctaatttttgttatagaaacagcgttttgccatgttgctcaggctggtcttgaactccagggctcaagcgatccacccacctcagcctcccagagtgctgggattacaggcgtgagccaccacacctggctgtctgtttcactttaaatgtctcccctcacgtacatgaagcttactggaaagcactttaaactttaggcagcaaactagatttattgccagtatacacattacataaggtaaaaattagccatattattttaaaatttaaaatgcatattttaatctaaatggatcctaggccagatgcagtggctcatgactgtatcccaacactttgggaggccaaggcaggaggattgcttgagcccaggagttcaagactgcagaaagctatgattgcaccactgcactccagcctgggtaacagggtgagattgtcttttaaaaaatcaaaaacataaaaaacataaaatgaatactaaaaaagatccaataataattagctttattttaaaaggataataatttttatggtaattaccatagtaccaaccaccattactattactatattagcatataataaccctttgtatatataagctcaacacataataggtgcttaataagtacagaagaaaagaaattctctctttgaggcccagtgttaaacagattaagcatcatctcttaccaataaatccctcttatattaacttaccctcctgggctgtgtagatgagaaaggcagaggaatctacatctttttacatgcaccttggttggcggggtgtgtgtttgtgtgtgtgtgtgtgtgtgtgtgtgtgtgtgtgtgtgtgtgtgtggagagagagagagccttatcataaggaagaaaaagtgtcctggaagtatagataagaaggatgtggcatagataaaggactttgggtggatttttgggtcctactctacatgaaaatacaataagcctacactgtttctgtcacatgttaccagtcagagtgaaatgaattgcgtgatcctgacctgctagttaactttgttgatccattacttcccttctctggttaggggcctgtttccagctccctgttctcgtcatttctgtcctgagtaggaaggactttaccgagggagtgtttcaggcttgcaggctgacagctgctctggacagctgtgctccctgaggcagaaccctagctgcatccccagccgtgcaaaccagaaacaagcgggttaaaaataatcctgaccaagtcattttgccatcactaatgagctctacagatactgtcctccttaatgataatatatttcccttctgtcctgttgaatttcatcttttctccttttctgtctttctctgaatttcaactgctgattttacctttgctttccattttactttgaacaagtatttccaatggacccttcacaaggacctatagctcagacttgttttcaaaatctcagtgtaaactgaggagacatttgacattgtctgacctcaagaaaattttctgaagaacattaaatcctccattaaaaatctttattctgtatattggatgtgatggctcatgtctataattccagcactttaggaggcccaggcaggaggatcgcttgggccaggacttagagaccagcctcggctgggctaagaccctgtctctacaaaaaaatatatttttaaaaaatctttattctgtaatgtaagttctttataaaggagttaaattgaggtaaagtataaggattaggtgttattctcatacatccatagtaatcataaatgtaggaatagaataagttctatgacaataacctatcaaaaactgcacataaagacattatgaggaccttaaccaaattcacacctaagaggtaagttaagctacgtctgaacaaatggaaagattagttaatagtaaaagtgccattaactgcctaacaattgggcctttaacattaaataacttgcttgaatgaatttgtctccttataatggacacaatcatagtgactttcaagcaattaatttagaatgcttggcatttctaaaattacaaattttcttactatagctaaattatttcagtaacgcctccctaggaaagtgtgtcttcaagttgttttactgttgaatatttacaaaattattacgaaaattagcactaccgtttttagtacagtactgctattaccttttcatgatttgagtctctaaagatttgctatgttaatattattaccataaattagtttcaaccatggtacaaatctcaggacgaatcagtacattgtacgcactacttcttttgccacatgaaaaagagggaaatcaagagaagtctgaaacagaaagaattgggctgacagcgtataagatctgaatagaagaaaaggagacagatcaaaaaatatatatgcatattgatcaagctgatcttatcagtcagacagttacatgagagaaagggatagctaccagtctcattactcagatttgctctgagaggaaggccagtgcaatcacccacgagaagactgcctctttacctgtccatagtggtgtccagagtgtcttcttgcctccctgcaagtctcaggccagaaaaatctcacttcaattaatgatggttctct

SEQ ID NO: 1518 - DNA, 28972 bp, Homo sapiens
acagggttatcgaggagaataaatgagataatgcatgcagaacctctcacacagctaagaatttaatatgttagactattattaattatgaaaacacataaagaattctgcatataatttcagaggtctatgatttctaggggatccttagcctggttccggatggtcagtaagacaactttcttcaatgcctacattttccctctgaattccatctgtgtttactaagcatctgctgtgtcctgggcagtccaacccacatgagtatcttggtcactagtgtcatcagcacctttgaggggtagggatcattcctattctactgatgaggtgagataacttgtccaaggtcgcatggtgaagtcgctgttgaaatctgtcttctgactcgttgctctgtcttcatctgaggaaagacttgtgaggcttctgaggaggctgctctccatcctgctgtgttctgtcagtgacactttgtgcacacaggagatcctaagacacataccctaggccctcagagccggcagtgacttcttcaaaatcagttccggcagcgctgagtgtccatggaaaagagctcttattcagagcagcccttcctgtgtgcagagctacgcaagtaattaaatcacttcagcaacaagatcaaggggacggataagtgttagagactgtgtttcagtcctgactgcctcttatgcatgacctcaggaatgccacttcacctctctgagtctggtttcctcacctataaaagtgaaggacagttctgactccacagggtgctgtgtgagggttacgtgaagtcgagggttacatgaagcctttgcataatacctggcacaacgtcagtcttccgggagtggtaggactagtctgcattcttggtttgcagattagatgaggaaacccaggcccaaagaagcaaacaaacaatagctcacccagtcttctctgtttattcttctcaactacaccatgctgctttgcaggttggtttgacaaacatttccccacaattagatgcatgatgaccaagggaggaaagaaaattttcacagggtatttaaaaagctcagggaacaaacagatcagtgcaaatcagtaaggctaacacctgaaaatgactctgcacaggtgaggaagtggagcagaagagggaggggctggttcagggaacaggatttaatatgtcagtgaagaccctgcctctctctgtaacaagatgcctaaagaagaatagtggtgcttccagcccagctccctcttgttttgggaacaacagtcatttctcagaaacctcacttgcaaaggcagcccttccaaaaacatgagagctttagtttggagaaattatttaagctcacttttgctggagaggaaatgaatttaaactaggacacacagagaagcaacaaagagtgttaaagaagcaactgaaaaggtagtcaaagatctggcttaaggattagaagcactggctttctagactatggacaagtgtccattcaacagttatccagcctggcaggaagcagatatctttctgtgtatatctggatccaactaacatttatccaatgtctgttgcatgccaggtactgagcaaaaaccttcttcctataaatttcatttaatgccattaaggccaagaaggtggcataaccaacttcctttttcagctgaggaaacaggagcacagtgaataactaactggctgggatttgtcctaggtcccctgaactccaagcacagtgctatctccactagaccaagctgccttgtctctgggctcaagagaagcctgcataggagctgaaggtcaagaggttgcaggcttatctcatatgcacatacttggacctccctaccacacagctgccagcgacaagaaagggcttcttttccttccagccaggtccagaattcaatgtcatttttctagcttagattatctaaaaaaaatgccacaacaggggatacaaattttaacatattttattgatttaggggccaaacaaggcagcatttggtcagttaagaaaggcacctcattgaaaataatacatcacagtgctgttgagtgatcccagtcacaggatttgagaatggaaaggacaatctttggatgacatagcttaggacacttgctcatttatttaaaagagtcccttcacacagtgcagataaaagaaggcaagagcataggattgtggcatgtgctgggtagctgtgagaggttactcatgaaagtaggtagcctagtaaattagtggtaagtcaggggaagggaatcagcctccctttccatttcattcccttccccctccccttgattccagtttgcttgatttgttgagccaccatccctatgaatacaccttacatctctttcaaatgtggagatggttttttgatcttacagtgtgtggaaccggagtcagtaatcaaagctccctgttccaagctatagacagacaggacaacaatttgatttcctgtactcttggtctggaacccatggggttctgagataaaagctgaggtcttagagcactggctttaaaaaatattttcaccagtccagagtaaatgaaaacccgattccttagaaataatattgtgtctatttctacccccaccctccaagcatggtgttttttaaaaaattaatttttcccttacactttaaaaactctcacctatgtataaaagaaactgccacactacaataacactgctgttgttccaagtattcctctgagcccctcaccagccctccctcaccatcctcaccctgaccacccttcccctctgcccagcacctaagagcagggatcacgccgcggggtgatgagcagtgttgcagtctcgcctggccttctgatactaggctgaaatagagaggaaacaagagagaacaaaatgggtttttaaaaaccaagtacatatcagaggaggctggcatgtaagccccagcaaccaaatgcattaaacactggacatttctgtgacaggtaaaagcagaacctgctgaggctgaggaactctggaattaaatgaagcaaaaacagaatcctaaccatactgagaagggtatatgcattccctatgaatcttccagttcttatgggcagcccaaatattacttgtacatgttgtatgcacacgtgaatctatgtggacggatgacaaatatttgggcaaggatcatgcacataaaattagcaaacattcaagaacctcaactttgaggccaagtgcttacaattgtccctagttaaaggggagctgattctaagattcatgatgccactgtcacccagagaaggatcccagaccaggcacacatagctgacagtttttgtttcactcctcttccttgcccattcccagaagtcatgtgcttcccagaaacacacaaagccagactgagtttccattaagagtgggtggagttggtttagagccaggaaaacaaggcaggacagaggcagcagacactcacttggaccaggcaaagagggaagcaaggtggccaggtactcatgcccagttgccatgtggacagcagataagacctctggtagtctcacagatggcaggagagctcaggtcaggaggctgggcactttagagtccactgaatcgagtcagcagcagattatgctgaggctggcgatattatttactggatctgccactgactttctaatggtttttccagaggctgccgtttttgtggtccttcatagcagtctgttacttcatctgtttgccacaaatcaaaccagagaccaaaagacagcagggaccttagaaaatgctcaatagttgggaagctaaggttatgaataaaagctggtaactgtcacaggtggtcttatttctgggtgatcttttcttggggaagtccatggctatagccatcataaaattaggggtgaagggttggatctagaaaggagagggtttgggcttaaaaagaacatatctgatttcagttttatgtcctggagagagactgggtttgaataaatactgatcaaaatgaatccaagaatagatcacacactgttttgttcacacttggaaacacaggcaaacattaaaaataaaagcaaataaacctaccctggtctctttttggggaagtagatttgactgctctcagatgatcagcctggatgttcagaagacaatctgaattcaaaaggacctttcacctggtttaattctctggcaacaattcagttttcaaacccaattcccaaataattgctattttcagcatcatgatgcagatcacaaaaatattccaatttggcctggctctttttatgacgatatcctctcccagtaatttctgtaacctgcaaagtaagtgcctttttccttccacctagggggaaaaaattaatgatccctgttcacacactgactcacgtgggttttcatcatgggttagaaaacaaaatggaattctctgtccataatgtgccatcaggaactgtgaccctgcctgacttcacatgatcctggacttctaatcagctgctggaaatggaagaaatactatgaggttctggaattgcggtccctggaagattacctgggttagttcattttggtcaaaaaataaaatcaaaagtatggttaaagaagtaaacagctgggctgggtgtagtggctcacgtctgtgatcctggcacttcaggaggccaaggtgggtggattgcttaagcctaggagttcaagaccagcctgggcaacttggcaaaatcctgtctctacaaaaaatacaaatatcagccaggtgttgtggcatgcacctgtagtcccagctgctcaggaggctgaggtgggataattgcttgagccccaggaggcagaggttgccgtgagccaagatcacgccactgcactccagccagggtggcagagcgaaaccttgtctcaaaacaacaacaaaaaagaagtaaacagctggtaaagcaacctagcctaaaacttacaaagtagcagagtgaacacatatgtgcatgcacacacacacacacacaacacacatacacacagatgagagtagcacacacgccaaagatacatcaagcaagtgcttttttaatcaatacatcaaatgatatttttgctagcctgaggaagcttctctttgcctgtcctatcattcccacccattgcctcacagggatggaaagaaattccttcttggacccaacattagataaacataaccaagtctttacatgtggctttggagaaggctgctaggatgcttgcgaacacgacatcgggggtctgggatgcatcgatggcggagtggatcccccgtttcctgtagtactctatgagtggggtggtttgagtgtggtaggcttgcaggcggattttcaaggccttttcattatcatctgatcgacggatcaagggttccccggtgatctgagaacaggaagacagcaatgaaaggctgggactgttagcaaggttttcttattccatgccagatgcagatttgagatgggaccattctgcccaggatgctgtctgttcccaaagcccatcagagacaaagacaggcaatccagaccctctccagtgaagaactttgctactcccaggagcagagcagctggtgaacagaagtcagagagtttgtcagaaacaccaactgtgaggaaaggggctcatgaggggaagataggcaatgactttctcatctttgtgctcaggcgattcagcttccaagataaacacttctagggtcaaaagtaaggaagtcaaaaaggcccctaagaccagaatacatcaaaatcaaagatacattagcaattgtaatcttagttgcttaaatatttagtgtatttactagagtgtcacccatcaacattctaaaagtggcaagtaaaataagaactttcaatggtagaattagcaactttgcaaaatgtgactaagttgccataacggctctggaacctgtatttatagaacctgaatgacctgatgaacttgtttcataggacaaaggtaaacccaggaaattcttactgttgcctgcatgctttaaaacaaaccatatagactctttatggcaaatggtgcagtgaccatgtatgaaaccccaggacacagtacagcagcaataactataaaaagaatatttttctggaggactggtcatcaaacttctcttcagtgccacactcttcccactctccaattgtaggcttttaagaaagcttctcctgattagctgatcacttaggtggccatgatgccagaaaaggggctgctcttgacagaagacaggtacaatctgggcactgcaaaaagctagcaccactggaagcaaccttgaggccaagcaataaaccacctgaggagacactgaatagatctgacacaggccatgtgatttacttgatagtgttatttttcatgactaagttagtaatattggtagaaataaaaggaagatggaaagaataaaggaaaaagaaaaacagtgaagaaaggggaaggaaagaaaaggaaattttttgtcctgagtttacatacgtcatctttcatgggctcttttggagggttgaactcctcgtggtaggaacggccactcttggggtgaatcagcctgaaagacagcaaatgaatatgagttaggttaactgacagtacgcgcctgcactccactctagggggctccagaatgacaagcagagatagggacgctggatgcaaggacccagcacccagcagaaaatccagctaaataactgggcttccaggagagcttatgccagcggcagagtatattttctattttgaccaaacattattatgagtatctggctgaagagcaaactgctggcataactacctaattcaggacttgagagaaggaactctggtgctggtctcacacagccatccattctgttcacccatttacttaacaaacattaataagtattccattcaagccttaagctgaattcagaagctacaaagcaatgagtaatgatccctgctcacaagtagtgcttagtgggagagacaaatgtggaaataaataacaaacgtgataatcctttaacagagatttgtacaaagtgctatgggggacagaggacaaagaaatgaactctattttctaacctagtttggttacaaaaccaggaaggtactaacaggaaaaataattcccatggatgcaaacactgccagataatggaacacatcttttcaatcacacagataaaagatagcctaacccttatggagcaatattcaagtaatcgggaaaaatgacttattaaacaagtcatggaatatagagctcaagaacaggcatttatttggcactgaatgtatagtgggcagctgcatctgtgctgagtccctacagacaacaagcccatgttcctgactgggaatggccacaccacaggagcctagaaacctaaggaaaggaggcaggccaagctctgctcagcagccaggccttgcttcacttctgtggtttctcaattctctgccaaccaagtgtttgtttgcttatttaactaatggttgcttttctcatgaaggtctattagactagagctccctaatatttttcaccatttggcaggcatagcaatatttgggccgggcccagcagcttatgcctgtgatcccaacactttgggaggctgaggggggcagatcacctgaggtcaggagttcgagaccagcctgaccaacgtggcgaaaccccgtttctactaaaaatatgaaaaatttagctgggtggcaggcacctgtaatcccagctacttgggaggctgaggcaggaggatcgcttgaacctgggggtggaggttgcagtgaaccgagatcataccactgcactccagcctgagtgacagagcaagactgtctcaaaaaaataaaataaataaaaattctattcaattctatttagactattgaagtagcacctctgtaaaatgtgctactttcttttttgttaatcacagcatattttggggggacaagatggtccatttggcataaagtggcactgggttatgggcaggagggaggtgacagtagagaaaataagctatagagtcatcccttggtatccatggggggattggttccaggagccccctctgtggataccaaaatccatagatgctcaagtccctgatataaaatggtacagcatttccatataacctatgcatatcctcctgtgtacttttatttttattttatttttgagacagagtctccctctgtcacccaggttggaatacagtggcgcggtctctgctcactgcaagctccgcctcctgggttcacgccattctcctgcctcagcctcccaagtagctgggactacaggcgcccaccaccaagcctggctaattttttgtatatttagtagaaacggggtttcaccgtgttagccaggatggtctcgatctcctgacctcgtgatccacctgcctcagccttccgaagtgctgggattacaggtgtgagccactgcgcctggtctatttattttattttttgagacatggtcttgctctgttgtccaggctggagtgcaatggcaatgaccatagttcactgtaaccacaaactactgggctcaagtgaccctcccgcctcagtctctggagtagctgactacaagcatgcgccaccatgcctggctaattcttttattttatttaattaatttattttattttattattattttttgagacagagtctcattctgttgcccaggctggagtgcagtgtcatggtctcggctcactgcaacctctgcctcccaggttcaagcaattctcctgcctcagcctcctgagtagctgggattacagatgcctgccaccacgcccggctaattttttgtatttttagtagagacggggtttcaccatgttggccaggctggtctcgaactcctgacctcgtgatccacccacctcggcctcccaaagtgttaggattacaggtgtgagccaccgcgcccggtctagttttttaattttttgtagagatgaggtctcactatgttgcccaggctggttgtcttgcatactttaaatcacctctagattatgtatacctaatacaatgtaaatgccatgtaaagaattgatatactgaattttaaaatttgtattattttttcttttcttcagctttcctgggttatatttattggtggttttgttctgaatatttttaatccacaaatgcttgaatccgtagatgagggaaccatggatatggaaggccaactggacagaggagtaaaggttcctgtgactgcagtcatgtactgtgaggttgcaccttccattatttgagtgcctggaaggattcctctgatgcattcattcagaaatggcatccactgggagacccagggaaaggagagagcaggctgctgggctcagctgcagcaactttgggaggggctaggggcatgagatacggaccaggatatttttttaccttctagagagcacagggcacatagcagccaggctgcaacaaatatgactcccacacactgctcttttgccattcacaaataccactttttaaaacaatacaaggctcattccacagaaggtaaatgaaagaaaccccactctccaagttctcaaaatgggattgctctcaagtaccaaccaaaatagctccatgagccactgagcgtggcttggaggtatcatcaggactgggaatctacaatcactgctaccgtgagtgtgatactttatttttatttttttgagatagggttttgctttgtcacccaggctggagtccagtggcctaatcatggctcagtgcagcctcgacctccctagctcaagcaggcctcccacctcagactcccaagtagctgggaccaccaccgcaggtgcacactgccacacctggctaactttttttttgctttatagtagagacgaggtcttgctatgttgctcaagctggtctgaaactcctggcctcaagtaatcctcctgtttaggtccctaccaaatgctgggatcacaggcatgaaccactgcgcccaacattcagtgcgacactttaaacacttgttttctcatccacaaaattgggatggtaccaggtattaagataataccggagagccaactggtaggataattaggatttgagagagccaatattgaataagttaaaaacaaaaaccacaaccaccaactattcatattcaagaaacagaacaatgactcaaaattactagaagtgaggtcagagctaattcagaagattgttacaatgggtccatatcatctcagacttgaaaaagatcctgtgtgaggtccggggtgcattccccagcatcttcaaacagccgacatctgtgaccaacctgggcaacagagtgagactctgtctcaaaaacaacaacaatgacaacaacaaaaaaaaacagaaaagaaaaagatccatattaaactgactggttcctgcctcattttcttctaaccatcaacattttggactacgaggcagaaagcaggcttccagggctaaccctgccactcatctgttgggtaaacttggaaaaacaccttcagcagtgacatgctctgtgaggacgggggtccttctctctgtgaggaagtcacactaaccacctacttccaaatggagggaatgaatcttctctctttcaccctttacagcaatcctgctgtttgttcttcagaatctctctgttctctcccacccaacctcagttagaaatctccaccacatcatgtggatcataaacaggctcctagatggtatccttatctgtttctccttgccgtaatttaccttgtacaccaggaccaagctaatgttcttagaatactgtttttgccacaatacccagtggctcaagactatctcatgagtcctgaactccgtcaagtctaccctctttggtttggcagatctccccagtaaagctcttctcaacagcattccttctaccttcctgccccccagaccactgggcagacacgtctgctactagcctcagcgaaagtccaacccataatcattccggcttctcctcccttctgggaaaggctctctgaaatactcttcatcgaggaagagtttaatgttatctctatcctaggcagcctttcttccctgtccccaggctttcttcttggacttcctactacactgaacagcccaagtttcatatatgactctctgaggtcagagatgggcatcactatatggttatcctagagcctctcgtggtcctctgctcccagggtctagtactgtgctatgcaggaagcaggtactcaggaagctgggcccatagaatcaaaggtctccagtatcacctgattctgctaatacgtgcttagtgcctaagagaccccaggcctagtgatgtctttactgttaaccctactgcttctcgacctacatcaactttgtctactctgtgcccagtggggatacaaagaaacagaagttcctgcattaaaggagcctatggaatagccggagacatgtaacctggacatttgaaaagaaaatgaatataaggtagagtccactgtatttcatatcgctttccaggataatagtgctaaccctgtgctgtctattcacatgtttgtctcttcttgaaggtatggactacaaacacatggaaaagatgttcaacctcattaggaaatcaaagtaataatgtctgaaataagaaaacattttttccctaatccaaaaatttacatgcattatgatggccatagtatcattttaacagtggctaactggaagaaacataaatgtacaacaataaggaaataagtaaacaatggttaacctactgtgaaatattacacagcaattaaaagtaatggtcatggatgtctggttcaagatggttggctgaccactttcctgagacaccattaaaatgacaaagacataaaaaagctacagcccacaataaagaagggaatggagggtccatttgcagttgaaagcttctgtcatacttctggaaggcacaaagcagatggcagtgattagtgaaacagggtagagacaactgtaggctaaagcagtgttggtctgtcagaacaaacgtgtccagaagcagaggcatttctgtgttcaatgctattacagagaaacaaacatgttaaaacacacacacacacacacacacacacacacacacacacacaaagtggctgtactatgagcaaattcttcctccattttctaaactttgtacagatggttatattatttttacaataaaaagtctacagcaaagtatggcaactccagctgaaatcagatttaaggagcactaaaatggaggagatacacatgtaaagacattaacatttcttaagcacctaatataggcaaggctttgaactatgcattttatgttacctaacacgtgaaatagcttctcaaagcaggtgttatcaacccccttctacatataaggaaacagcctcagagaggttaagaaatgtgcctagggtcacagttaaaaagtgacaagaggccaggcacagtggctcaagcctgtaatcccagcactttgggaggccaaggcaggtggattgcttgaggtcagaagtttgagaccagcatggccaacatggtgaagacctgtctctactaaaactacaaaaattagctgggcgtggtggtacatgcctgtagtccgagttactcgggaggctgagacaggagaattacttgaaccggggaggcagaggttgcagtgagccaagatcgcgccactgcactccagcctgggtgacagagtaagactctgtctcaaaaaaaaaaaagcaataagagccaggcacagtggctcaagcgtgtaatcctagcactttgggaggccgaggcaggcggatcacttgaggtcagttcaaaaccagccgggccaacatggtgaaactccatctctactaaaaatacaaaaaaattagccagccctggtggcagacacctataatcccagctacttgggaggttgaggtaggagaactgcttgaacccaggaagtggaggttgcagtgagccgagactgcgccactgcactccagcctgggcgacagagttagactcccatctaaaaaaaaaaagtgacaagaatgagatgctgtctgacttcaaatcccttgctcttctttccatatcccgatcccatctcaccacttcagcggatgtcaccaaataaaatcaatccatgttgaaatggcactaagcttcatggccgggattaggcaagagcaattctcagagtttgagaaagctctgagaagcatgaaaagggaccttcaagggacaaataccttcctgtgattcttcggatcagcagagagtctgggatgctgaattcaatcacagaatcaagcttctctttcctcttctccatgaggtcatcgagctgtaaaagaatgtgtggcccacctaagctaccagagcttggttagacccatctccttcaaaggaattaagaaagacaaaggacaagaatttggtttcatgcagtagtaatataaaaactaagctacccaccatttctgcctgcctcacagtccgagggaagccatccagaagaaaaccatttttgcacaagggggtctccaaattcttctcaatgagctccactaccatttcatcactcacctggaagttaggaacaaaatagccttgggtttaaatccattacctaggtgactgacattagcccaactccacagccaaaagtttgtgtatataaccttattactaaacagcaagttttcttggacccaaagaagcaaaaataaaagcaaacgtgaaatggctccatttggaagatccagtttcataattttatctctgtggttgccaaatacacactctcgtctcttgaaattctcctgtatcccaaaaatctgggtgagggaagacagattccattacttgttacttcaccaggagagctttgtatcttaggtcctgaaggtccctcctgccactagagtccagagtccaaactgtcagataacagcttatcagcaatcagtgatcctcaaggcacaggaaatgtgaggacaaatggctgacagaccacctgagagagtgccaggagagaatggggttgaccaaaacacaggcatcagctttccctgttccacagctgtcattaggctaacagtaacgtgactgatgtgtgtacttggttacacatctgggccatcctggacatgaggaaacagagaagttcactgaattggcaagattgggtcagaaccaaggaactgaagagccaagccaacactcttccctcacttttttttttttttttttttttttgagacagtctcattctgttgcccaggctggagtacagtggcacaatctcccctcactgcaacctccaccttccaggttcaggtgattcaagtgcctcagcctcccaaacagctgggactacaggcgcacacgaccatgcccagctaattttttgtatttttaatagagacggggtttcaccatgttggccaggctggtctcgaactggtgacctcaagtgatctgcctgtctcagcctcccaaagtgttagtattacaggagtgagccaccatgtccagccctaagccaatatacttctgagtctctctaaaaccccaataaggacttctcccagttttcagaaactggtttttctcttgggctgttatagaaagaaaagtctccagcctgtagtgaagcctgcccatcttggcagctaatgcttttatttcttggtgctaactgtgaacttggggacaaagtacacactctgcaactaagtgaaggttggagataagcaatctcattgccacatctcaattttttcttagtacagagtcttctgtcaaaactcaaagtccaaaatatctagctttctggtttgactcagagattcaattacatgaagggaaaactagatagaaatgggcaggcagaggtatcatttgatacagctacagaatctcaaagcctaacagaaggtaacttgaggattaaagcaaagtccagctccttccccaaccaacattctaagataaaaaaagaccagaagaccaagcacaaaatgacttctgaaggtgattctcagaggccaagttccagaataactcagttataattaatctagcaatctttgattagtgccagaaaataatagattgtatttgtccaatcaggtcaactggcctaaagaaggagaaaatgtggctgggcatggcagctcacacctgtaatcccagcacttagagaggctggggcaggaggactgctcctgggtttagctcagttcaaaaccagtgtgggcaacacagtgagactccatctctacaacaacaacaacaacaacaacaacaacaacaaaagtagcagggcatggaggtgtgtgcctgtaaccctagctactcatcaggccgaagtgggaggatcacttgagcccaggaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttgttacagaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggccaaggagggtggatcacctgaggtcaggagtttgagaccagcctggccaacatggtgaaaccccatctctactaaaaacataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttgttaaaacaccctctagcacatggttgttcaacagaattttgtttgatgatggaaagttctgtatcagcgttggctggtaaatacttgaaatatggctagtgcaactgaggaactgatttttacattaattaaattaatctaaatagccacctgtggctggtggctaccatattggacagtgcagatctagattctgaggaatatcaacactcattggtaccaccaaacctaccagtttcccagcatccatagttgccttcagcttttttcctagctctgagccagaagccaccatggccctcagcatgtccccagtagctaaatggcagacacagaagttttcagccaatctgggtgcctacagagaggaagacaaaaaccaagattcaattacattacaggctgtggagtcagactgcctaggtgtgaacctggccctgccacttactggctatgtaaacatgggcaaatgcctacttccttacctgtaatggggataaaagtaccttatattacattctaacatatactgattatagggttatggtaagaattacatgaaataatatatgtaaagcacttaaaacagtacaactagcacacaggaaggagtcataaatattaattatcactatttccactcaacacactagtgacacataagtttcagtttccccattataaatgggaagacttgctgggcatggtggctcacgcctataaccccagcactttgggaggctgaggtgggcggatcacgaggtcagaagttcgagaccagcctgaccaacatggggaaaccccgtctctactaaaaatacaaaaattagctgggtgtggtggcgcttgcctggaattgcagctactcaggaggctgaggtaggagaattatttgaatctggtaggcagaggctgcagtgagctgagattgcaccacagcactccagctccagcctgggtgacagtgagacttcgtctcaaaaaaaaaaaaaaaaaaaaaagagaataaaaatagtaccaacacttcacatggttgctgtgaggtttaaatgagatcatgtatataatgcacttggtacaacacctggcacataacatgtgctgaataaacatttgccaaagggatgaatgtacaattgtcatgtactacagctactgggtcagggaggcaactaggagcagtttgcccccaggcagaactgggttttcctccttccctgtcactaagtagctgtactatggtggccacctcacttttcagtttccttatctgtttaaaatgaaggcaaaaaaggctccatctcagaaggtagctgtgaggattagctgagatatatacaaagagcacttggcaaataataagcacttacatactagttttaggaggcattatagtgttttggtcaagagcacaggcttgagagttaaactgctggtttgcagactccaggtccactaaccattatgtaaaattgacttaagatgtcacttcacctttctaggtttcaaatttcctctaagtaaaatggagatggtaatagtatctgtatcactgggttgatgagaagattatacagaattcagtatatgcaggccctggcatatagtaagcgctcagtgggcactggctgttaccataacccctgtcctaatcctatattcattcatacaaaaagaaaacatttactaatgcctttcccaagaaccctgtcgggagcctgggaaacagatgaataaaaggcatagactatgtacttaaagagcttatatttggtgaattatacatgagaatgcagaattagaacaggaagagaccctagacagctcaacactggctttgcagtgggaaaaaaagaatgcagaatttacaaggaatataatcagttcaaggagctcaattttagctttttccgttcaattgttttataaactaagcaggtttagatcccgattccaacaaatcagttcactgggagttttcttttctttctttctttctttttttttgagacagagtctcactctatcacccaggctggagtgcagtggcacgatcacggctcactgcagccacgaactccctgggctcaggtgattctcctgcctcagcctcccagtagctgggattgcaggcacaagccacgtgcctggctaatttttatgtaattgggagttttcttaggtgcatgcttaggtgcacacaataaaaggtacatagatagggctggtttgtgattcatggaccaattcagttaaagcaaagaaatgacttcatagcaaaatggaatctagtgagaaggcattaaaaactgtacttggccgggtgcagtggctcacgcctgtaatcccagcactttgggaggccaaggcgggtggatcacaaggtcaggagattgagaccatcctggccaacatggtgaaaccccgtctctactaaaatataaaaaaattagccgggcatggtggcgcatgcctgtagtcccagctactcaggaggctgaggcaggggaatcgcttgaacccaggagttggaggttgcagtgagctgagactgcgccattgcactccagcctggagacagagcaagactccatctcacaaaaaaacagcaacaaaaaaaaactctgtactctgggttgggcgcagtggctcacacctgtaatcccagcactttgggaggccgaggcgggtggatcaccggaagtcaggagttcgagactagcctggccaacatggtgaaaccccatctctactaagaatacaaaaattagctgggcgtgctggcacgtgcctgtaatcccagctacttgggaggctgaggcaggagaattgcttgaacccagaaggtggaagttgcggcgagccgagatccagcccgggcgaagaagcaagactacgtctcaaacaaacaaacaaacccaaaaaaccaaaattctgtactttgcaaaatcagtgaatgtcaggagccctgacaatgaaaaaccaggctggcactgtggccgtacatctagagagtgctttctgccaatctttctcattgctgttgaaattaacctgggtaaacaatttggaggtcaggcttgctcaagtggaaaggctgaccaaaacaccacagagaagagctgttagcacagaacctgttctatttttatcactcccaaactgcaggactcttatgcactgttccaggtgattggattctacagctagatgaaagaacacacaccaatagggaagaaaactaattcctggctgggtatggtggctcacgcctgtaatcccagaactttgggaggctaaggcgggtggatcacgaggtcaggagttcaagacttcaagaccagcctggccaagatggtgaaaccccgtctctactaaaaatacaaaaattagccaggcgtggtggtgggtgcttgtaatcccagctactcaggaggctgtggcagagaactgcttgaacccgtgaggtggaggttgcagtgagcggagatcgcgccactgtactccagcctgggtgacagagcaagactcttgtctcaaaaaaaaaaaaaaaaagaaaaagaaaaaaagaaaacgaattccttcatttcctgctggctgcctgggagtcaatgtggtaggctgtaaagagcacgcatgggttttgaagtcagacagatttacacttgattcctagctaaggcactcagtagccgtgtgatcttgggctaagtacttaacttctcagagtgtcagtttcctcatcagtttaatggggataatgactacttcacagggttcttatgaggataaatgaaataaagtaccaaaaacatcagacacgcagcaggcattcaataaataaaaggcttccttccatggtctttcttctttgcattagtctttatttacaggctgcagaaacctaatgaaataactttattatagtcccctcacacttcaaacttatgctttagagcagccattcacagactctaaatcactggaggaatgctgttaaaatgcagattccggctgggcgcggtggctcacgcctgtaatcccagcactctaggaggccgaagcaggcggatcatctgaggtcgggagttcaagaccagcatgaccaacatggagaaaccccgtctctactgaaaatacaaaattagctgggcgtggtggcataatcccagttactagggaggcagaggcagaagaatcgcttaaaactgggaggcagaggttgtggtgagctgggattgagatcgtgccgctacactccagcctgggcaacaagagtgaaactccgtctcaagaaaaaaaaaaaaaaatgcagattctagttcaatagggtagggcctaagtacctgcattttaagcaagcttcccggcctggatgagtggctgggctctaaactacactttgaagagcaggggtctgaagcccacactcagtcatagtctgttgctgtcagccaaaaactgttgctgagcccaagaaacaggctcatcacctctatgaaaactctgtggggtggaggactctggggtaattatgggaatgctaaaaccactagagagacagcatggtgggctgagtggttctcaaatttcagtgtattatcaatcatctagggcatttcctaggcccacctttaaagtttatgattgagtggctctcaagcagcacctcaggttctgatgggtacagtatgtgaagccctgatgtagtggcagagactgggttttgtagtggtatagatctgggttaggaaacgggctctaccgtttattcactgtgtcatcctgaacaaattacattaccttttctaaggtctcgttttctttatccatagaacagaaaacagtgtctatctgctgaactgttgtggggatttaataagattacgtatgcaaagacatccagcatagggcctgacaactaggaaataaagggaaactatcagtcctagagatttggtttaatcccaaattcaccagtcttctcaccttgtaaccatcatcttcttcttatgtttttttagaaatgaggtcttgctatgttgcccagggtggagcacagtggcttcacaagtgttagcccactacacatcggcatgggaattttggcctgctctttttctgacctgggccgatttacctctccttaggcaacctagtggtctcctgctcctgggaggtcaccatattgatgttgaacttttttttttttttttttttttgagatagggtctcactctattgcccaggctggagtgcagtgacatgttcatagttcactgtggcctcaaactcccgggctcaagcaatcttcctgccttagtctcccaggtagctgggactcaggcatgcagtaccatgcccggctaattattgtattttttgtagagatggggtttcgtcatgttgcccaggctggtctccaactcctgagctcaagcgagctgcctacctcagcctctcaaagtgctggaattataggcacaagccacagtgcctggcctgatgctgaatttagtgcagacacctgatcagcatagcacactatagccccaaactcctgtgcccaagcaatcctcccaccacagcttccggagtagttgggactatgggcgcatatcactgtgcctggcacaattacctttgtgcctccagtctttgtcactcctgctgtcaatgttcctacacatgcagctagaatcatatcttaaaacactgttggatatgctacctaccctccaaaacatacacattccgaagccttcaacatctctgtggtacaatagaggaagagtccaaatatcttagcctggcactcagctgccctccacaatcaacttctaaaacctgccaagccctcccaacttacttccacaagtgccctgtgtttacgtcctgcaccactgcagacaaactgctcttacgcatggttcccaaatacgcggcataaatgcctctccaaggacctcaacacaagctcctcactccacaggaatgccctctctgctccaatattggtctaagccttttctgtagtatacttctgagtacatttctcccatcaaaagcctaactgggctggaagcagtggctcacatctgtaatcccagcactttgggaggatcacttgaggccaaaagtttgagaccagtccgggcaacacagcaagaccccatttctacatttttttttttaattagctgggcatggtggcaggtacttatagtccagctacttaggaggctgaggtgggaggaccatttgagcccaggagttcgaggcttcaatgaactatgaccgtgccattgcactccagcctgagtgacagagtgagaccctgtctcctaaaacaaaaacacctccccaactaccccttcttccgctgaggattcatattaacattagctaactttgagcatgtgcatcatgccaagcagttttccatgcattgttttacggtacttagtatgtataatacataataaacccatgaggtaggaactatttttaactgcattttacagatgaaactcaggggctaagttgcccaagatcacagagctagtaaaagaactggcaacaggccagattaccaagccctagctcttagccatgacactataaggctttaagacaaacaacccaaagagccttagtggctatcctcctggaagggagcacaaggaggatttcaaagtgctggcaatattctgtttcttgataatgggtgtaagctacacaaatctgttcacattgtaaaataaatcaagctgttcactttttctaggtatcttatagcttaagttgttttttttttaatcacagaaacctgtgtttgcatttcagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttactacatgtgtgtcctgaggcaagataaagcctctgagctcagtttctctgtcagtaaaaaggacctatctcctagtgttataggattaaatcagatgatacatgtaaaatctttagcttgggggtctgtcacgtaactgagcaatgggtgactatgttgtaattattacaccctcctgacatgcacacggtaggagaaaaatctaacctggggcagtagatagcagcagaaagagcaggagctttggagtcattcagatgcaagctctgtaaattacttgctatgtagcctagagaacaagccattcaaacttcagtttctccaactgtaaaaggggaaataagagtgtgggtctcagagatgttgcaagtatcactgcaatgacataactgatgcatctgacccataagactgcctaagcgtgcctggcctcgaagaattgggcataagtttgacacatggaagaaatgaggaggggttggcaaaaaaaccaagaaacatacctttggttttgaccacaccgaaggagcatccaaccccaaaagggaggcaaggaaataaagttatttaaataaaataacaaacccaggtattatagatgttttaaaacattacattgatgcaaaagcgagtagttttgaaatatttaactactttagttaaaagtgaggagttttaaaaggaaacattatttcagtcatgcaacataaagcacataaaatactgagttacgcaggtataacaaagtatagcaggaagaaaacaaacattactgagcaggcactaggcactaaccccaggttagggattttacatgtaagattgcaaacatctgccagtgggagccaagcaggcaatgcaactgtatgaaatgagtcaaatgtaagcaatgggcagtgaagaggaccgtgcaggggacaggaagacacacagaccatccaaagcagcaatgccacacaactgcaagtgactgctgccacactggaatggaggcatcactgccaggtcttctggtttctcaagagaaactggagctctggatttttaagagaaattgcataaccgaaaacgctctgtggtcaacctactattttgaaagctgacaaagagaataaatcaagcatttatcctgacttttctataccaaccatatcacggggtaacgaaacagtagatgaggggaagtttctctttatagaaatatttcagctaataaatgaccagggaacaatataattagaataccaccatttcaccatccataacgaattactgaacctagacactgaacagcatgactataaacaccagagacaaggaaataccatgtgcctcctcagggagagcacagcacccaccacctgtgaagtagttgggccaaaaaattgaacctaaattgaattaagtatatactaattaagtataaaccaccaatttacaggaaatagagagggcagaggaagatgttaagtacaccaggggaatacaactgaaaattcccagagagtggtataatactcccaggaaaaataatccaatttctggggctggacatgatggctcacggctataatcccaacactttgggaggccaaggtgggcggatcatgaggtcaggagatcgagaccatcctggctaacacagtgaaaccccgtctctactaaagatacaaaaaattagccgggtgtggtggcaggcacctgtagtcccagctactcgggagactgaggcagaatggcgtgaatccgggaagcagagcttgcagtgagccaagatcacaccactgcactccagcctgggcaacagagcgagactctgtctcaaaaaaaaaaaaaagaaaagaaaaataatccaatttcttcggcaaaaccccaggaaaaaaagagaaggggaacttataaattaaaagaaaggatgggcacagtggcacatgcctgtagtcccagctacttgggtggctgagggaggagcccggtagttcaagaccagcctgagcaacatggcaggacccccatctttaaaacactagaaaagttagccaggcatggtggcatgcacctgtaatcccagctattcaggaagctgaggtgggaggactgaggctgccgtgagctatgattgggctactacactccagcttgggcaactgagcaagactttgtctgtaaaaaaataaataaataaaagaaacttaaaattatcacattggtaacacaaaagaaaatttgaataaaaattgttgattttttaaaggatattatgcttatgtttttaaaaattatcttttagcaatacatactaatattatttacaaatgaaatgttatgatgcctgggaggtgctttataataatttgtgaagggagaatggctagaggagcgaaggccaccagttaatggttggggctgggtaagggctcattatgccatcctgtcttcttttgtgtattcaaaattcttcataataaaaagttaaggtgtatgagatgtctctgcaggctaaatgttattgtaggctaccatttgtaaagtctgatttaagatcttttttttttgagacaaagtctcactctgttgcccaggctggggcgcaatggtgagatcccagctcactacaaactctgcctccaaggctcaagtgatcctcccacctcagcctcctgaatagctgggactacaggcacacaccaccatgcctggctaatttttgcatttttttgtagagatggggtttcgccatgttgcccaggcttgaacttttttttaaactccacaaaaatacatacaatcaccagtattcctattgttacaactctggaaagtgtacagaggttaaatgacttgtgtaaatcttatcctttcaactcccagctctaatcacatctcctctatttctacaaagccttctctgaccaactctcatcttcatgcacccttatcaatcaactcattagtataatgttcttctaaacttcctgaataaatcatgtcttacactgaaacatccaagttgaaggaggggaagggagatgtgttactaagataaaagggagtcaaaatttattgagtacctactatatagcaggctgtcatctaggttgtgggtgcttgatacacacacacacacacacacacacacacacacacacacatatatcataattttccagtatcattgtgaatgtttagttgatgagggcaagaactttatcagtcttgcccaatgctttatatccccaatgttaggtgctcatgaaatgctgaatgagcaaggtaggtattatccccatttttcaggtaagaacactgaggctcggaagttacatagctagctaaattataaaacccttgtcccagtactatactagtataggttgtccattccataattactgaaattattaacttcaatatgagttaagaaaaaaatctcagggcatagtggcttgtgcctataatccctgcactttgggaggtcaaggcaggatgatcgcctgtgtccaggagttcaataccagcctgggcaacatagcaagaccctgtctctacaaaaaattgtttaaaaattagctgggcatggtagcatgtgcctgtactcccagctacctgggagggtgaggtgggaggattgcttgagctcacaccactgcgctccaacctgggcaacagagtgagaccctgtctcaaaaaaaagaaaaagaaaaagaaaaacaatgaagcatttgagctactgtttatacttgatcactcacagcaaaagtctgcagagtctaagattaaacttccctaagctgcagattacccaataaatgagtgtggcagcaacaggaaagagatgtcaacaacgctgaggataaaggataaagggatcaggtacaggtaagctccaaagaagaatcatctcagtctgtggagagaaaagaaagctgtattttctgacttagtgcccaggtcacaggaatgaatggagtgttccagaacttctttctttatcacccacattaatctgtgacattcatccacttccactaaccccatcaagggccaagtaatgtgctaggtgccacaaggggtaccaagaatgagtaagatggtctgtttgccaagatttttaaaacttggcaagtgctaggaagagaaaagcgggcacagggcagtcctcagattccctttcatttgggagctcagacttccctctttgaagcctaacaacaggcaagagccagaggcttagggccccaggtgcaatgccagaccccaagcaagaaggggacatcaataatccaacctgcgggcttccaaatccgaaatgagatcatcgatcccaaccctaatctatggccccattatgtcccagatctagaaggggcccagatcccaagtgaggcccctgttgcctgctagggcagatggtaacttcagactctaactccatggttcctgaggtctcaggctcatgaaactcatttcactaatttgggaaagccacctgacctttctgggcctgttttttaacctgttgattgataaagttaaaatttcaagttccctataaacaacaacaaaataaaaaaaggaaaaaataaataaaaaccaaagggaaggaagatacaaacaaacaaaaataataaaaacaaaataaaaaaaaattcaagttccttttcatctaaaatcatttgcgtcatcccaagctgcttagccttcagtagcctcaggtcctaactccaagccaggtcccatgagcactcccaacccttattgtggacactactcaaaggttgcgactcatgggtctccaggctataaaccagttctacacattcacccccaactttcaaacagggagagccttaggtttcctcccatctcaattcaactggctcacacagcacatgtcacctctcactctgccccacgtgttggagatgcttctcctcccctccccctaagtcataaatcattatcaaaatctcccgacctccagtgcctggaatgtaaccctgattctggacaattcacctccaactcgcaggtaacctgggccataaagctaattgcctccattcagcctgtaatctagatgcctcggcccagggctcactctacccctcaaacctttccagtctctagacccttagtggaattaatcagccctcacattccctaacccaacacttcaacactgaatccctcgggcactccaatcctaactcagactgccccgacctccaatttggaccctctccgaaatgccccaccagaaccgagaccccggccagcgttccccgcaggccttagtccccggcccgctccgggcaggtccagggcttctagatctccggccgccttgaccttggagttcagcaggctccgccgccaagcccagtcctgccgctcacctgggtccctttaccggccccgggaggccccagcagcacggcccggatgcctttaggatactcgggttctgccgctggcacgctgggagccatgtccgccgaagtctctcactgccaccagttcgcacgcctcacaggtccagtgcttcccaggtcaacgcacgcacgccacgcac

SEQ ID NO: 1519 - DNA, 28972 bp, Homo sapiens; identical to SEQ ID NO: 1518

SEQ ID NO: 1520 - DNA, 25687 bp, Homo sapiens
ggggagctgattctaagattcatgatgccactgtcacccagagaaggatcccagaccaggcacacatagctgacagtttttgtttcactcctcttccttgcccattcccagaagtcatgtgcttcccagaaacacacaaagccagactgagtttccattaagagtgggtggagttggtttagagccaggaaaacaaggcaggacagaggcagcagacactcacttggaccaggcaaagagggaagcaaggtggccaggtactcatgcccagttgccatgtggacagcagataagacctctggtagtctcacagatggcaggagagctcaggtcaggaggctgggcactttagagtccactgaatcgagtcagcagcagattatgctgaggctggcgatattatttactggatctgccactgactttctaatggtttttccagaggctgccgtttttgtggtccttcatagcagtctgttacttcatctgtttgccacaaatcaaaccagagaccaaaagacagcagggaccttagaaaatgctcaatagttgggaagctaaggttatgaataaaagctggtaactgtcacaggtggtcttatttctgggtgatcttttcttggggaagtccatggctatagccatcataaaattaggggtgaagggttggatctagaaaggagagggtttgggcttaaaaagaacatatctgatttcagttttatgtcctggagagagactgggtttgaataaatactgatcaaaatgaatccaagaatagatcacacactgttttgttcacacttggaaacacaggcaaacattaaaaataaaagcaaataaacctaccctggtctctttttggggaagtagatttgactgctctcagatgatcagcctggatgttcagaagacaatctgaattcaaaaggacctttcacctggtttaattctctggcaacaattcagttttcaaacccaattcccaaataattgctattttcagcatcatgatgcagatcacaaaaatattccaatttggcctggctctttttatgacgatatcctctcccagtaatttctgtaacctgcaaagtaagtgcctttttccttccacctagggggaaaaaattaatgatccctgttcacacactgactcacgtgggttttcatcatgggttagaaaacaaaatggaattctctgtccataatgtgccatcaggaactgtgaccctgcctgacttcacatgatcctggacttctaatcagctgctggaaatggaagaaatactatgaggttctggaattgcggtccctggaagattacctgggttagttcattttggtcaaaaaataaaatcaaaagtatggttaaagaagtaaacagctgggctgggtgtagtggctcacgtctgtgatcctggcacttcaggaggccaaggtgggtggattgcttaagcctaggagttcaagaccagcctgggcaacttggcaaaatcctgtctctacaaaaaatacaaatatcagccaggtgttgtggcatgcacctgtagtcccagctgctcaggaggctgaggtgggataattgcttgagccccaggaggcagaggttgccgtgagccaagatcacgccactgcactccagccagggtggcagagcgaaaccttgtctcaaaacaacaacaaaaaagaagtaaacagctggtaaagcaacctagcctaaaacttacaaagtagcagagtgaacacatatgtgcatgcacacacacacacacacaacacacatacacacagatgagagtagcacacacgccaaagatacatcaagcaagtgcttttttaatcaatacatcaaatgatatttttgctagcctgaggaagcttctctttgcctgtcctatcattcccacccattgcctcacagggatggaaagaaattccttcttggacccaacattagataaacataaccaagtctttacatgtggctttggagaaggctgctaggatgcttgcgaacacgacatcgggggtctgggatgcatcgatggcggagtggatcccccgtttcctgtagtactctatgagtggggtggtttgagtgtggtaggcttgcaggcggattttcaaggccttttcattatcatctgatcgacggatcaagggttccccggtgatctgagaacaggaagacagcaatgaaaggctgggactgttagcaaggttttcttattccatgccagatgcagatttgagatgggaccattctgcccaggatgctgtctgttcccaaagcccatcagagacaaagacaggcaatccagaccctctccagtgaagaactttgctactcccaggagcagagcagctggtgaacagaagtcagagagtttgtcagaaacaccaactgtgaggaaaggggctcatgaggggaagataggcaatgactttctcatctttgtgctcaggcgattcagcttccaagataaacacttctagggtcaaaagtaaggaagtcaaaaaggcccctaagaccagaatacatcaaaatcaaagatacattagcaattgtaatcttagttgcttaaatatttagtgtatttactagagtgtcacccatcaacattctaaaagtggcaagtaaaataagaactttcaatggtagaattagcaactttgcaaaatgtgactaagttgccataacggctctggaacctgtatttatagaacctgaatgacctgatgaacttgtttcataggacaaaggtaaacccaggaaattcttactgttgcctgcatgctttaaaacaaaccatatagactctttatggcaaatggtgcagtgaccatgtatgaaaccccaggacacagtacagcagcaataactataaaaagaatatttttctggaggactggtcatcaaacttctcttcagtgccacactcttcccactctccaattgtaggcttttaagaaagcttctcctgattagctgatcacttaggtggccatgatgccagaaaaggggctgctcttgacagaagacaggtacaatctgggcactgcaaaaagctagcaccactggaagcaaccttgaggccaagcaataaaccacctgaggagacactgaatagatctgacacaggccatgtgatttacttgatagtgttatttttcatgactaagttagtaatattggtagaaataaaaggaagatggaaagaataaaggaaaaagaaaaacagtgaagaaaggggaaggaaagaaaaggaaattttttgtcctgagtttacatacgtcatctttcatgggctcttttggagggttgaactcctcgtggtaggaacggccactcttggggtgaatcagcctgaaagacagcaaatgaatatgagttaggttaactgacagtacgcgcctgcactccactctagggggctccagaatgacaagcagagatagggacgctggatgcaaggacccagcacccagcagaaaatccagctaaataactgggcttccaggagagcttatgccagcggcagagtatattttctattttgaccaaacattattatgagtatctggctgaagagcaaactgctggcataactacctaattcaggacttgagagaaggaactctggtgctggtctcacacagccatccattctgttcacccatttacttaacaaacattaataagtattccattcaagccttaagctgaattcagaagctacaaagcaatgagtaatgatccctgctcacaagtagtgcttagtgggagagacaaatgtggaaataaataacaaacgtgataatcctttaacagagatttgtacaaagtgctatgggggacagaggacaaagaaatgaactctattttctaacctagtttggttacaaaaccaggaaggtactaacaggaaaaataattcccatggatgcaaacactgccagataatggaacacatcttttcaatcacacagataaaagatagcctaacccttatggagcaatattcaagtaatcgggaaaaatgacttattaaacaagtcatggaatatagagctcaagaacaggcatttatttggcactgaatgtatagtgggcagctgcatctgtgctgagtccctacagacaacaagcccatgttcctgactgggaatggccacaccacaggagcctagaaacctaaggaaaggaggcaggccaagctctgctcagcagccaggccttgcttcacttctgtggtttctcaattctctgccaaccaagtgtttgtttgcttatttaactaatggttgcttttctcatgaaggtctattagactagagctccctaatatttttcaccatttggcaggcatagcaatatttgggccgggcccagcagcttatgcctgtgatcccaacactttgggaggctgaggggggcagatcacctgaggtcaggagttcgagaccagcctgaccaacgtggcgaaaccccgtttctactaaaaatatgaaaaatttagctgggtggcaggcacctgtaatcccagctacttgggaggctgaggcaggaggatcgcttgaacctgggggtggaggttgcagtgaaccgagatcataccactgcactccagcctgagtgacagagcaagactgtctcaaaaaaataaaataaataaaaattctattcaattctatttagactattgaagtagcacctctgtaaaatgtgctactttcttttttgttaatcacagcatattttggggggacaagatggtccatttggcataaagtggcactgggttatgggcaggagggaggtgacagtagagaaaataagctatagagtcatcccttggtatccatggggggattggttccaggagccccctctgtggataccaaaatccatagatgctcaagtccctgatataaaatggtacagcatttccatataacctatgcatatcctcctgtgtacttttatttttattttatttttgagacagagtctccctctgtcacccaggttggaatacagtggcgcggtctctgctcactgcaagctccgcctcctgggttcacgccattctcctgcctcagcctcccaagtagctgggactacaggcgcccaccaccaagcctggctaattttttgtatatttagtagaaacggggtttcaccgtgttagccaggatggtctcgatctcctgacctcgtgatccacctgcctcagccttccgaagtgctgggattacaggtgtgagccactgcgcctggtctatttattttattttttgagacatggtcttgctctgttgtccaggctggagtgcaatggcaatgaccatagttcactgtaaccacaaactactgggctcaagtgaccctcccgcctcagtctctggagtagctgactacaagcatgcgccaccatgcctggctaattcttttattttatttaattaatttattttattttattattattttttgagacagagtctcattctgttgcccaggctggagtgcagtgtcatggtctcggctcactgcaacctctgcctcccaggttcaagcaattctcctgcctcagcctcctgagtagctgggattacagatgcctgccaccacgcccggctaattttttgtatttttagtagagacggggtttcaccatgttggccaggctggtctcgaactcctgacctcgtgatccacccacctcggcctcccaaagtgttaggattacaggtgtgagccaccgcgcccggtctagttttttaattttttgtagagatgaggtctcactatgttgcccaggctggttgtcttgcatactttaaatcacctctagattatgtatacctaatacaatgtaaatgccatgtaaagaattgatatactgaattttaaaatttgtattattttttcttttcttcagctttcctgggttatatttattggtggttttgttctgaatatttttaatccacaaatgcttgaatccgtagatgagggaaccatggatatggaaggccaactggacagaggagtaaaggttcctgtgactgcagtcatgtactgtgaggttgcaccttccattatttgagtgcctggaaggattcctctgatgcattcattcagaaatggcatccactgggagacccagggaaaggagagagcaggctgctgggctcagctgcagcaactttgggaggggctaggggcatgagatacggaccaggatatttttttaccttctagagagcacagggcacatagcagccaggctgcaacaaatatgactcccacacactgctcttttgccattcacaaataccactttttaaaacaatacaaggctcattccacagaaggtaaatgaaagaaaccccactctccaagttctcaaaatgggattgctctcaagtaccaaccaaaatagctccatgagccactgagcgtggcttggaggtatcatcaggactgggaatctacaatcactgctaccgtgagtgtgatactttatttttatttttttgagatagggttttgctttgtcacccaggctggagtccagtggcctaatcatggctcagtgcagcctcgacctccctagctcaagcaggcctcccacctcagactcccaagtagctgggaccaccaccgcaggtgcacactgccacacctggctaactttttttttgctttatagtagagacgaggtcttgctatgttgctcaagctggtctgaaactcctggcctcaagtaatcctcctgtttaggtccctaccaaatgctgggatcacaggcatgaaccactgcgcccaacattcagtgcgacactttaaacacttgttttctcatccacaaaattgggatggtaccaggtattaagataataccggagagccaactggtaggataattaggatttgagagagccaatattgaataagttaaaaacaaaaaccacaaccaccaactattcatattcaagaaacagaacaatgactcaaaattactagaagtgaggtcagagctaattcagaagattgttacaatgggtccatatcatctcagacttgaaaaagatcctgtgtgaggtccggggtgcattccccagcatcttcaaacagccgacatctgtgaccaacctgggcaacagagtgagactctgtctcaaaaacaacaacaatgacaacaacaaaaaaaaacagaaaagaaaaagatccatattaaactgactggttcctgcctcattttcttctaaccatcaacattttggactacgaggcagaaagcaggcttccagggctaaccctgccactcatctgttgggtaaacttggaaaaacaccttcagcagtgacatgctctgtgaggacgggggtccttctctctgtgaggaagtcacactaaccacctacttccaaatggagggaatgaatcttctctctttcaccctttacagcaatcctgctgtttgttcttcagaatctctctgttctctcccacccaacctcagttagaaatctccaccacatcatgtggatcataaacaggctcctagatggtatccttatctgtttctccttgccgtaatttaccttgtacaccaggaccaagctaatgttcttagaatactgtttttgccacaatacccagtggctcaagactatctcatgagtcctgaactccgtcaagtctaccctctttggtttggcagatctccccagtaaagctcttctcaacagcattccttctaccttcctgccccccagaccactgggcagacacgtctgctactagcctcagcgaaagtccaacccataatcattccggcttctcctcccttctgggaaaggctctctgaaatactcttcatcgaggaagagtttaatgttatctctatcctaggcagcctttcttccctgtccccaggctttcttcttggacttcctactacactgaacagcccaagtttcatatatgactctctgaggtcagagatgggcatcactatatggttatcctagagcctctcgtggtcctctgctcccagggtctagtactgtgctatgcaggaagcaggtactcaggaagctgggcccatagaatcaaaggtctccagtatcacctgattctgctaatacgtgcttagtgcctaagagaccccaggcctagtgatgtctttactgttaaccctactgcttctcgacctacatcaactttgtctactctgtgcccagtggggatacaaagaaacagaagttcctgcattaaaggagcctatggaatagccggagacatgtaacctggacatttgaaaagaaaatgaatataaggtagagtccactgtatttcatatcgctttccaggataatagtgctaaccctgtgctgtctattcacatgtttgtctcttcttgaaggtatggactacaaacacatggaaaagatgttcaacctcattaggaaatcaaagtaataatgtctgaaataagaaaacattttttccctaatccaaaaatttacatgcattatgatggccatagtatcattttaacagtggctaactggaagaaacataaatgtacaacaataaggaaataagtaaacaatggttaacctactgtgaaatattacacagcaattaaaagtaatggtcatggatgtctggttcaagatggttggctgaccactttcctgagacaccattaaaatgacaaagacataaaaaagctacagcccacaataaagaagggaatggagggtccatttgcagttgaaagcttctgtcatacttctggaaggcacaaagcagatggcagtgattagtgaaacagggtagagacaactgtaggctaaagcagtgttggtctgtcagaacaaacgtgtccagaagcagaggcatttctgtgttcaatgctattacagagaaacaaacatgttaaaacacacacacacacacacacacacacacacacacacacacaaagtggctgtactatgagcaaattcttcctccattttctaaactttgtacagatggttatattatttttacaataaaaagtctacagcaaagtatggcaactccagctgaaatcagatttaaggagcactaaaatggaggagatacacatgtaaagacattaacatttcttaagcacctaatataggcaaggctttgaactatgcattttatgttacctaacacgtgaaatagcttctcaaagcaggtgttatcaacccccttctacatataaggaaacagcctcagagaggttaagaaatgtgcctagggtcacagttaaaaagtgacaagaggccaggcacagtggctcaagcctgtaatcccagcactttgggaggccaaggcaggtggattgcttgaggtcagaagtttgagaccagcatggccaacatggtgaagacctgtctctactaaaactacaaaaattagctgggcgtggtggtacatgcctgtagtccgagttactcgggaggctgagacaggagaattacttgaaccggggaggcagaggttgcagtgagccaagatcgcgccactgcactccagcctgggtgacagagtaagactctgtctcaaaaaaaaaaaagcaataagagccaggcacagtggctcaagcgtgtaatcctagcactttgggaggccgaggcaggcggatcacttgaggtcagttcaaaaccagccgggccaacatggtgaaactccatctctactaaaaatacaaaaaaattagccagccctggtggcagacacctataatcccagctacttgggaggttgaggtaggagaactgcttgaacccaggaagtggaggttgcagtgagccgagactgcgccactgcactccagcctgggcgacagagttagactcccatctaaaaaaaaaaagtgacaagaatgagatgctgtctgacttcaaatcccttgctcttctttccatatcccgatcccatctcaccacttcagcggatgtcaccaaataaaatcaatccatgttgaaatggcactaagcttcatggccgggattaggcaagagcaattctcagagtttgagaaagctctgagaagcatgaaaagggaccttcaagggacaaataccttcctgtgattcttcggatcagcagagagtctgggatgctgaattcaatcacagaatcaagcttctctttcctcttctccatgaggtcatcgagctgtaaaagaatgtgtggcccacctaagctaccagagcttggttagacccatctccttcaaaggaattaagaaagacaaaggacaagaatttggtttcatgcagtagtaatataaaaactaagctacccaccatttctgcctgcctcacagtccgagggaagccatccagaagaaaaccatttttgcacaagggggtctccaaattcttctcaatgagctccactaccatttcatcactcacctggaagttaggaacaaaatagccttgggtttaaatccattacctaggtgactgacattagcccaactccacagccaaaagtttgtgtatataaccttattactaaacagcaagttttcttggacccaaagaagcaaaaataaaagcaaacgtgaaatggctccatttggaagatccagtttcataattttatctctgtggttgccaaatacacactctcgtctcttgaaattctcctgtatcccaaaaatctgggtgagggaagacagattccattacttgttacttcaccaggagagctttgtatcttaggtcctgaaggtccctcctgccactagagtccagagtccaaactgtcagataacagcttatcagcaatcagtgatcctcaaggcacaggaaatgtgaggacaaatggctgacagaccacctgagagagtgccaggagagaatggggttgaccaaaacacaggcatcagctttccctgttccacagctgtcattaggctaacagtaacgtgactgatgtgtgtacttggttacacatctgggccatcctggacatgaggaaacagagaagttcactgaattggcaagattgggtcagaaccaaggaactgaagagccaagccaacactcttccctcacttttttttttttttttttttttttgagacagtctcattctgttgcccaggctggagtacagtggcacaatctcccctcactgcaacctccaccttccaggttcaggtgattcaagtgcctcagcctcccaaacagctgggactacaggcgcacacgaccatgcccagctaattttttgtatttttaatagagacggggtttcaccatgttggccaggctggtctcgaactggtgacctcaagtgatctgcctgtctcagcctcccaaagtgttagtattacaggagtgagccaccatgtccagccctaagccaatatacttctgagtctctctaaaaccccaataaggacttctcccagttttcagaaactggtttttctcttgggctgttatagaaagaaaagtctccagcctgtagtgaagcctgcccatcttggcagctaatgcttttatttcttggtgctaactgtgaacttggggacaaagtacacactctgcaactaagtgaaggttggagataagcaatctcattgccacatctcaattttttcttagtacagagtcttctgtcaaaactcaaagtccaaaatatctagctttctggtttgactcagagattcaattacatgaagggaaaactagatagaaatgggcaggcagaggtatcatttgatacagctacagaatctcaaagcctaacagaaggtaacttgaggattaaagcaaagtccagctccttccccaaccaacattctaagataaaaaaagaccagaagaccaagcacaaaatgacttctgaaggtgattctcagaggccaagttccagaataactcagttataattaatctagcaatctttgattagtgccagaaaataatagattgtatttgtccaatcaggtcaactggcctaaagaaggagaaaatgtggctgggcatggcagctcacacctgtaatcccagcacttagagaggctggggcaggaggactgctcctgggtttagctcagttcaaaaccagtgtgggcaacacagtgagactccatctctacaacaacaacaacaacaacaacaacaacaacaaaagtagcagggcatggaggtgtgtgcctgtaaccctagctactcatcaggccgaagtgggaggatcacttgagcccaggaggtcgaggctgtagtaagccatgattgcaccactgcacaccagcctgggtctcagaacaaaaaaaaagagagaaaatgcaattatcgtccccagataagaaggattacctttgtcacaactgcgaagtaattgctttgttacagaaacagcacacagagccataaagcaggttaaaaaacacttctgtgacttcctaaatcctctcttgaatacatctctgagttctggcctagggacagcagtttcatttctggctctaaaatttaggtatataacaaaacacaccagcacagaaaaacttcaagaatactatgaatgagtgccataaattcagaacaaacaaaataacttgcactctaaaaagtcttacaaggccaagtgcggtggctcacgcctgtaatcccagcactttgggaggccaaggagggtggatcacctgaggtcaggagtttgagaccagcctggccaacatggtgaaaccccatctctactaaaaacataaaaattagccaggcatggtggcaggtgcctgtaatcctagctactcgggaggctgaggtacaagaatcgcttgaacccaggaggtggaggttgcagtgagccaagactgcgccactgcactccagcctgggcgacagagcgagactttgtcaaaaaaaaaagaaaaaaaatttcctataatctgccagtttgttaaaacaccctctagcacatggttgttcaacagaattttgtttgatgatggaaagttctgtatcagcgttggctggtaaatacttgaaatatggctagtgcaactgaggaactgatttttacattaattaaattaatctaaatagccacctgtggctggtggctaccatattggacagtgcagatctagattctgaggaatatcaacactcattggtaccaccaaacctaccagtttcccagcatccatagttgccttcagcttttttcctagctctgagccagaagccaccatggccctcagcatgtccccagtagctaaatggcagacacagaagttttcagccaatctgggtgcctacagagaggaagacaaaaaccaagattcaattacattacaggctgtggagtcagactgcctaggtgtgaacctggccctgccacttactggctatgtaaacatgggcaaatgcctacttccttacctgtaatggggataaaagtaccttatattacattctaacatatactgattatagggttatggtaagaattacatgaaataatatatgtaaagcacttaaaacagtacaactagcacacaggaaggagtcataaatattaattatcactatttccactcaacacactagtgacacataagtttcagtttccccattataaatgggaagacttgctgggcatggtggctcacgcctataaccccagcactttgggaggctgaggtgggcggatcacgaggtcagaagttcgagaccagcctgaccaacatggggaaaccccgtctctactaaaaatacaaaaattagctgggtgtggtggcgcttgcctggaattgcagctactcaggaggctgaggtaggagaattatttgaatctggtaggcagaggctgcagtgagctgagattgcaccacagcactccagctccagcctgggtgacagtgagacttcgtctcaaaaaaaaaaaaaaaaaaaaaagagaataaaaatagtaccaacacttcacatggttgctgtgaggtttaaatgagatcatgtatataatgcacttggtacaacacctggcacataacatgtgctgaataaacatttgccaaagggatgaatgtacaattgtcatgtactacagctactgggtcagggaggcaactaggagcagtttgcccccaggcagaactgggttttcctccttccctgtcactaagtagctgtactatggtggccacctcacttttcagtttccttatctgtttaaaatgaaggcaaaaaaggctccatctcagaaggtagctgtgaggattagctgagatatatacaaagagcacttggcaaataataagcacttacatactagttttaggaggcattatagtgttttggtcaagagcacaggcttgagagttaaactgctggtttgcagactccaggtccactaaccattatgtaaaattgacttaagatgtcacttcacctttctaggtttcaaatttcctctaagtaaaatggagatggtaatagtatctgtatcactgggttgatgagaagattatacagaattcagtatatgcaggccctggcatatagtaagcgctcagtgggcactggctgttaccataacccctgtcctaatcctatattcattcatacaaaaagaaaacatttactaatgcctttcccaagaaccctgtcgggagcctgggaaacagatgaataaaaggcatagactatgtacttaaagagcttatatttggtgaattatacatgagaatgcagaattagaacaggaagagaccctagacagctcaacactggctttgcagtgggaaaaaaagaatgcagaatttacaaggaatataatcagttcaaggagctcaattttagctttttccgttcaattgttttataaactaagcaggtttagatcccgattccaacaaatcagttcactgggagttttcttttctttctttctttctttttttttgagacagagtctcactctatcacccaggctggagtgcagtggcacgatcacggctcactgcagccacgaactccctgggctcaggtgattctcctgcctcagcctcccagtagctgggattgcaggcacaagccacgtgcctggctaatttttatgtaattgggagttttcttaggtgcatgcttaggtgcacacaataaaaggtacatagatagggctggtttgtgattcatggaccaattcagttaaagcaaagaaatgacttcatagcaaaatggaatctagtgagaaggcattaaaaactgtacttggccgggtgcagtggctcacgcctgtaatcccagcactttgggaggccaaggcgggtggatcacaaggtcaggagattgagaccatcctggccaacatggtgaaaccccgtctctactaaaatataaaaaaattagccgggcatggtggcgcatgcctgtagtcccagctactcaggaggctgaggcaggggaatcgcttgaacccaggagttggaggttgcagtgagctgagactgcgccattgcactccagcctggagacagagcaagactccatctcacaaaaaaacagcaacaaaaaaaaactctgtactctgggttgggcgcagtggctcacacctgtaatcccagcactttgggaggccgaggcgggtggatcaccggaagtcaggagttcgagactagcctggccaacatggtgaaaccccatctctactaagaatacaaaaattagctgggcgtgctggcacgtgcctgtaatcccagctacttgggaggctgaggcaggagaattgcttgaacccagaaggtggaagttgcggcgagccgagatccagcccgggcgaagaagcaagactacgtctcaaacaaacaaacaaacccaaaaaaccaaaattctgtactttgcaaaatcagtgaatgtcaggagccctgacaatgaaaaaccaggctggcactgtggccgtacatctagagagtgctttctgccaatctttctcattgctgttgaaattaacctgggtaaacaatttggaggtcaggcttgctcaagtggaaaggctgaccaaaacaccacagagaagagctgttagcacagaacctgttctatttttatcactcccaaactgcaggactcttatgcactgttccaggtgattggattctacagctagatgaaagaacacacaccaatagggaagaaaactaattcctggctgggtatggtggctcacgcctgtaatcccagaactttgggaggctaaggcgggtggatcacgaggtcaggagttcaagacttcaagaccagcctggccaagatggtgaaaccccgtctctactaaaaatacaaaaattagccaggcgtggtggtgggtgcttgtaatcccagctactcaggaggctgtggcagagaactgcttgaacccgtgaggtggaggttgcagtgagcggagatcgcgccactgtactccagcctgggtgacagagcaagactcttgtctcaaaaaaaaaaaaaaaaagaaaaagaaaaaaagaaaacgaattccttcatttcctgctggctgcctgggagtcaatgtggtaggctgtaaagagcacgcatgggttttgaagtcagacagatttacacttgattcctagctaaggcactcagtagccgtgtgatcttgggctaagtacttaacttctcagagtgtcagtttcctcatcagtttaatggggataatgactacttcacagggttcttatgaggataaatgaaataaagtaccaaaaacatcagacacgcagcaggcattcaataaataaaaggcttccttccatggtctttcttctttgcattagtctttatttacaggctgcagaaacctaatgaaataactttattatagtcccctcacacttcaaacttatgctttagagcagccattcacagactctaaatcactggaggaatgctgttaaaatgcagattccggctgggcgcggtggctcacgcctgtaatcccagcactctaggaggccgaagcaggcggatcatctgaggtcgggagttcaagaccagcatgaccaacatggagaaaccccgtctctactgaaaatacaaaattagctgggcgtggtggcataatcccagttactagggaggcagaggcagaagaatcgcttaaaactgggaggcagaggttgtggtgagctgggattgagatcgtgccgctacactccagcctgggcaacaagagtgaaactccgtctcaagaaaaaaaaaaaaaaatgcagattctagttcaatagggtagggcctaagtacctgcattttaagcaagcttcccggcctggatgagtggctgggctctaaactacactttgaagagcaggggtctgaagcccacactcagtcatagtctgttgctgtcagccaaaaactgttgctgagcccaagaaacaggctcatcacctctatgaaaactctgtggggtggaggactctggggtaattatgggaatgctaaaaccactagagagacagcatggtgggctgagtggttctcaaatttcagtgtattatcaatcatctagggcatttcctaggcccacctttaaagtttatgattgagtggctctcaagcagcacctcaggttctgatgggtacagtatgtgaagccctgatgtagtggcagagactgggttttgtagtggtatagatctgggttaggaaacgggctctaccgtttattcactgtgtcatcctgaacaaattacattaccttttctaaggtctcgttttctttatccatagaacagaaaacagtgtctatctgctgaactgttgtggggatttaataagattacgtatgcaaagacatccagcatagggcctgacaactaggaaataaagggaaactatcagtcctagagatttggtttaatcccaaattcaccagtcttctcaccttgtaaccatcatcttcttcttatgtttttttagaaatgaggtcttgctatgttgcccagggtggagcacagtggcttcacaagtgttagcccactacacatcggcatgggaattttggcctgctctttttctgacctgggccgatttacctctccttaggcaacctagtggtctcctgctcctgggaggtcaccatattgatgttgaacttttttttttttttttttttttgagatagggtctcactctattgcccaggctggagtgcagtgacatgttcatagttcactgtggcctcaaactcccgggctcaagcaatcttcctgccttagtctcccaggtagctgggactcaggcatgcagtaccatgcccggctaattattgtattttttgtagagatggggtttcgtcatgttgcccaggctggtctccaactcctgagctcaagcgagctgcctacctcagcctctcaaagtgctggaattataggcacaagccacagtgcctggcctgatgctgaatttagtgcagacacctgatcagcatagcacactatagccccaaactcctgtgcccaagcaatcctcccaccacagcttccggagtagttgggactatgggcgcatatcactgtgcctggcacaattacctttgtgcctccagtctttgtcactcctgctgtcaatgttcctacacatgcagctagaatcatatcttaaaacactgttggatatgctacctaccctccaaaacatacacattccgaagccttcaacatctctgtggtacaatagaggaagagtccaaatatcttagcctggcactcagctgccctccacaatcaacttctaaaacctgccaagccctcccaacttacttccacaagtgccctgtgtttacgtcctgcaccactgcagacaaactgctcttacgcatggttcccaaatacgcggcataaatgcctctccaaggacctcaacacaagctcctcactccacaggaatgccctctctgctccaatattggtctaagccttttctgtagtatacttctgagtacatttctcccatcaaaagcctaactgggctggaagcagtggctcacatctgtaatcccagcactttgggaggatcacttgaggccaaaagtttgagaccagtccgggcaacacagcaagaccccatttctacatttttttttttaattagctgggcatggtggcaggtacttatagtccagctacttaggaggctgaggtgggaggaccatttgagcccaggagttcgaggcttcaatgaactatgaccgtgccattgcactccagcctgagtgacagagtgagaccctgtctcctaaaacaaaaacacctccccaactaccccttcttccgctgaggattcatattaacattagctaactttgagcatgtgcatcatgccaagcagttttccatgcattgttttacggtacttagtatgtataatacataataaacccatgaggtaggaactatttttaactgcattttacagatgaaactcaggggctaagttgcccaagatcacagagctagtaaaagaactggcaacaggccagattaccaagccctagctcttagccatgacactataaggctttaagacaaacaacccaaagagccttagtggctatcctcctggaagggagcacaaggaggatttcaaagtgctggcaatattctgtttcttgataatgggtgtaagctacacaaatctgttcacattgtaaaataaatcaagctgttcactttttctaggtatcttatagcttaagttgttttttttttaatcacagaaacctgtgtttgcatttcagatgtctcttaacttactgaggaaatcattaccaacctcactgggtggacaggaggatgaacaggagaacttcagcaaattgtagttcttgttctatccctgaactaacccaacattcaaagtcactcatctgatgcttcccacctggcaccctgcacttgtatgtatttttccattcatattcatttctgcctcttcatctagattacacagcaacaatgtaaattaatgactactcaagagtcagacagacatgagttcaaatcctacctttgctacttactacatgtgtgtcctgaggcaagataaagcctctgagctcagtttctctgtcagtaaaaaggacctatctcctagtgttataggattaaatcagatgatacatgtaaaatctttagcttgggggtctgtcacgtaactgagcaatgggtgactatgttgtaattattacaccctcctgacatgcacacggtaggagaaaaatctaacctggggcagtagatagcagcagaaagagcaggagctttggagtcattcagatgcaagctctgtaaattacttgctatgtagcctagagaacaagccattcaaacttcagtttctccaactgtaaaaggggaaataagagtgtgggtctcagagatgttgcaagtatcactgcaatgacataactgatgcatctgacccataagactgcctaagcgtgcctggcctcgaagaattgggcataagtttgacacatggaagaaatgaggaggggttggcaaaaaaaccaagaaacatacctttggttttgaccacaccgaaggagcatccaaccccaaaagggaggcaaggaaataaagttatttaaataaaataacaaacccaggtattatagatgttttaaaacattacattgatgcaaaagcgagtagttttgaaatatttaactactttagttaaaagtgaggagttttaaaaggaaacattatttcagtcatgcaacataaagcacataaaatactgagttacgcaggtataacaaagtatagcaggaagaaaacaaacattactgagcaggcactaggcactaaccccaggttagggattttacatgtaagattgcaaacatctgccagtgggagccaagcaggcaatgcaactgtatgaaatgagtcaaatgtaagcaatgggcagtgaagaggaccgtgcaggggacaggaagacacacagaccatccaaagcagcaatgccacacaactgcaagtgactgctgccacactggaatggaggcatcactgccaggtcttctggtttctcaagagaaactggagctctggatttttaagagaaattgcataaccgaaaacgctctgtggtcaacctactattttgaaagctgacaaagagaataaatcaagcatttatcctgacttttctataccaaccatatcacggggtaacgaaacagtagatgaggggaagtttctctttatagaaatatttcagctaataaatgaccagggaacaatataattagaataccaccatttcaccatccataacgaattactgaacctagacactgaacagcatgactataaacaccagagacaaggaaataccatgtgcctcctcagggagagcacagcacccaccacctgtgaagtagttgggccaaaaaattgaacctaaattgaattaagtatatactaattaagtataaaccaccaatttacaggaaatagagagggcagaggaagatgttaagtacaccaggggaatacaactgaaaattcccagagagtggtataatactcccaggaaaaataatccaatttctggggctggacatgatggctcacggctataatcccaacactttgggaggccaaggtgggcggatcatgaggtcaggagatcgagaccatcctggctaacacagtgaaaccccgtctctactaaagatacaaaaaattagccgggtgtggtggcaggcacctgtagtcccagctactcgggagactgaggcagaatggcgtgaatccgggaagcagagcttgcagtgagccaagatcacaccactgcactccagcctgggcaacagagcgagactctgtctcaaaaaaaaaaaaaagaaaagaaaaataatccaatttcttcggcaaaaccccaggaaaaaaagagaaggggaacttataaattaaaagaaaggatgggcacagtggcacatgcctgtagtcccagctacttgggtggctgagggaggagcccggtagttcaagaccagcctgagcaacatggcaggacccccatctttaaaacactagaaaagttagccaggcatggtggcatgcacctgtaatcccagctattcaggaagctgaggtgggaggactgaggctgccgtgagctatgattgggctactacactccagcttgggcaactgagcaagactttgtctgtaaaaaaataaataaataaaagaaacttaaaattatcacattggtaacacaaaagaaaatttgaataaaaattgttgattttttaaaggatattatgcttatgtttttaaaaattatcttttagcaatacatactaatattatttacaaatgaaatgttatgatgcctgggaggtgctttataataatttgtgaagggagaatggctagaggagcgaaggccaccagttaatggttggggctgggtaagggctcattatgccatcctgtcttcttttgtgtattcaaaattcttcataataaaaagttaaggtgtatgagatgtctctgcaggctaaatgttattgtaggctaccatttgtaaagtctgatttaagatcttttttttttgagacaaagtctcactctgttgcccaggctggggcgcaatggtgagatcccagctcactacaaactctgcctccaaggctcaagtgatcctcccacctcagcctcctgaatagctgggactacaggcacacaccaccatgcctggctaatttttgcatttttttgtagagatggggtttcgccatgttgcccaggcttgaacttttttttaaactccacaaaaatacatacaatcaccagtattcctattgttacaactctggaaagtgtacagaggttaaatgacttgtgtaaatcttatcctttcaactcccagctctaatcacatctcctctatttctacaaagccttctctgaccaactctcatcttcatgcacccttatcaatcaactcattagtataatgttcttctaaacttcctgaataaatcatgtcttacactgaaacatccaagttgaaggaggggaagggagatgtgttactaagataaaagggagtcaaaatttattgagtacctactatatagcaggctgtcatctaggttgtgggtgcttgatacacacacacacacacacacacacacacacacacacacatatatcataattttccagtatcattgtgaatgtttagttgatgagggcaagaactttatcagtcttgcccaatgctttatatccccaatgttaggtgctcatgaaatgctgaatgagcaaggtaggtattatccccatttttcaggtaagaacactgaggctcggaagttacatagctagctaaattataaaacccttgtcccagtactatactagtataggttgtccattccataattactgaaattattaacttcaatatgagttaagaaaaaaatctcagggcatagtggcttgtgcctataatccctgcactttgggaggtcaaggcaggatgatcgcctgtgtccaggagttcaataccagcctgggcaacatagcaagaccctgtctctacaaaaaattgtttaaaaattagctgggcatggtagcatgtgcctgtactcccagctacctgggagggtgaggtgggaggattgcttgagctcacaccactgcgctccaacctgggcaacagagtgagaccctgtctcaaaaaaaagaaaaagaaaaagaaaaacaatgaagcatttgagctactgtttatacttgatcactcacagcaaaagtctgcagagtctaagattaaacttccctaagctgcagattacccaataaatgagtgtggcagcaacaggaaagagatgtcaacaacgctgaggataaaggataaagggatcaggtacaggtaagctccaaagaagaatcatctcagtctgtggagagaaaagaaagctgtattttctgacttagtgcccaggtcacaggaatgaatggagtgttccagaacttctttctttatcacccacattaatctgtgacattcatccacttccactaaccccatcaagggccaagtaatgtgctaggtgccacaaggggtaccaagaatgagtaagatggtctgtttgccaagatttttaaaacttggcaagtgctaggaagagaaaagcgggcacagggcagtcctcagattccctttcatttgggagctcagacttccctctttgaagcctaacaacaggcaagagccagaggcttagggccccaggtgcaatgccagaccccaagcaagaaggggacatcaataatccaacctgcgggcttccaaatccgaaatgagatcatcgatcccaaccctaatctatggccccattatgtcccagatctagaaggggcccagatcccaagtgaggcccctgttgcctgctagggcagatggtaacttcagactctaactccatggttcctgaggtctcaggctcatgaaactcatttcactaatttgggaaagccacctgacctttctgggcctgttttttaacctgttgattgataaagttaaaatttcaagttccctataaacaacaacaaaataaaaaaaggaaaaaataaataaaaaccaaagggaaggaagatacaaacaaacaaaaataataaaaacaaaataaaaaaaaattcaagttccttttcatctaaaatcatttgcgtcatcccaagctgcttagccttcagtagcctcaggtcctaactccaagccaggtcccatgagcactcccaacccttattgtggacactactcaaaggttgcgactcatgggtctccaggctataaaccagttctacacattcacccccaactttcaaacagggagagccttaggtttcctcccatctcaattcaactggctcacacagcacatgtcacctctcactctgccccacgtgttggagatgcttctcctcccctccccctaagtcataaatcattatcaaaatctcccgacctccagtgcctggaatgtaaccctgattctggacaattcacctccaactcgcaggtaacctgggccataaagctaattgcctccattcagcctgtaatctagatgcctcggcccagggctcactctacccctcaaacctttccagtctctagacccttagtggaattaatcagccctcacattccctaacccaacacttcaacactgaatccctcgggcactccaatcctaactcagactgccccgacctccaatttggaccctctccgaaatgccccaccagaaccgagaccccggccagcgttccccgcaggccttagtccccggcccgctccgggcaggtccagggcttctagatctccggccgccttgaccttggagttcagcaggctccgccgccaagcccagtcctgccgctcacctgggtccctttaccggccccgggaggccccagcagcacggcccggatgcctttaggatactcgggttctgccgctggcacgctgggagccatgtccgccgaagtctctcactgccaccagttcgcacgcctcacaggtccagtgcttcccaggtcaacgcacgcacgccacgcac

SEQ ID NO: 1521 - DNA, 15254 bp, Homo sapiens
tttctgtaatcttgagaggttccaatcaacatttattgccttattctttttatctcattcctttttgaatgtgtttatctcctaagattttatctgtgatggagatgggatgcctgtgaatacaaaagttgcagtggtggcaccagggtgggggggtgcggccggggccaccatggtctcccctgagagggggtgctgtcttaggtgccccaagaggccctcgggcagcaagcgtggggtgctgccaaaatacagctccccctgggtgggcaggacacacgtggcctcctggcagacaggtgcctgggtgagcccgctgctcctgattagtcatgaatggcacctggtctgggcgacagtcacccgcaggaagccctgagctggccaccatcaccctgggcagtggctcccggggtgccaacaagacctgggcccctcgttctttggtgctgagagccccagctgaggctgtggaggaggccctggacctggtctggtgtctgtcagaggcaggtgcccagtcctttgacttgcttctctgaattgtcataattgtgctggaattgtgccagaaactggtagtgataacagctcctggaaggcctgtggctgctgagggctgcctggtccccctcaggacggccgggggagcctctccagaagcaccagctttgtctgcaggtggacgttgaaggggggcagttgggtcaggttcagactcacacctgtggtccccacgacgctggccaggacccggtgtgtgtccctgtagagggccaggagcccaggggccgcctccatgaggatgtgtgtgtatgccagcatgcctgtccccggctgcacatcctccctcttgtcgtacctgtgggatgagagctggtggtcctgcccagggcccccacatcgccctgtcccccgcccccaaggggccctcacatggcctctgggagggccgtgctgtgtgtggatcctacctccaggcgctgttgacttggagaaaccgagacacacctgtctgggcggctgccacgtcaatgtgcagaaggacgtctaggaaaaccaggcctgccgtcagagcccagccctgcagtcggagccacagcagtccccaggcagtgcccccagcacccacctgtctgggggggcaccagctggtgcagcctctgcattgcgacgccacctgggtagttgaaatgggacacatacagggccgtggctgagtaggcggcattcaccacgaggtgtccgatcacaagcagagaccccgctttgtacagccaagactttttatagttattcagcctgaaaaaagaatggttacacatcataggcagaacgtaatgacaataaaattaatctacctacaaaacatactaggagcataacctgctgttcaacttcaccaagtcataacaaagagttcaccaccaaataaaacagagtcagtaacccgtaaaagtggttaagatactgcctcaagaattgtctgtgaaattctacccaagatgccaatttaaaatttagatgagattttaaaatatatatatatttttgagacagagtctcgctgtgtcacccaggctggagtgcagtgccatgatctcggctcactgcaacctccgcctcctgggttcaagtgattctcctgcctcagcctcccaagtagctgggactacaggtgcacgccaccatgcccatctaatttctgtatttttagtagagacaggctttcactatgttggccaggctagtcttgaactcctgacctcgtgatctgcccgcctcagcctcccaaagtgctgagattacaggcatgagccactgcgcccagcctaaaaatatattttcaaacaatcccaagtgactgtgtaggtcagagtgccacccgcgcggccaagcccactcccagcaggtctgagtgaactctctgggacagggtgccgccggttctctcacaatcgactatgccaatctcaggatcctacggcagagttagcagctgccacagacagtgtggcccacgaagatgaggctctttattagctggtccttaacggaaaagcttgccaaccctggtctaaacgccctgaacccccgatcaagactcactctcttccaaacccaccaggctcctcggagccctcttctccacaggccctgccctttgctatggtttggatctgcgtccccaccaaatctcatgtccaactgtgatccccaatgctggaggtggggcctggtgggaggtgactgggtcatggaggtggagccctcaggaatggattagcgccatcccctccatgctgttctcctcataccgagtgagttctcgagaggtctgcttgtttgaaaatgggtgacacctcccccgtccctcttcgtcctgctttggccacataaaagcgtgcccgcttccctctcgccttccgccataatggaaagttttcccaggccagcctggaagctgagcagacaccagtaccacgcttcccgtacagcctgcggaaccgcgagccaatgaagcctcctctttataaattatccagtctcaggtgtttctttacatcagtgcgagagcagactagtgcacccttgaacaatctctggtgcggtttctgagctcgaggccccacctaggatgaccgcagcctcctaagtgcctgccccaaagagctcagcactgccagggcgttcgtcctttgttcccgcccaaacctggagtgggcagtcactgtggaaagctcgcaatcagaaaccttccacccccaggactgtctcaaggccctgggccctgacaccgtgggaaacggcctgctcttgctcccagggtggccgggctgaggacctgacttcggagggggccttgctctaccctgcaccccctcatttggactccccaagtttgtcctcctccggataaggccgactggcacagcaggggcccttgcatggagcagcccctcacgcccagcacaccaggcctcaaagacacagagctgggtccagttcccactggatcttcttccctgctggaaaagcctgtcaccgaatacaatccatccgcgccgctctccccgtctttcctaccctcttttccatgactctggctggggtctgctcctcctccagccctgagccgacccctgagacgagagggagccaaaggcacagaaaagcagaggcagagctcccaggagcccccactgaggcgcggctacagcagccagaggagcccccaacccaggcacggccacggcagccggaggaacccccagcgaggaacagtcacggcagccagaggagctcccaggcccgagggcagtgcggggcagtcggagctggggggcaccatcccctcccctgtaacaagtggcaccggaaagcacctgaccgctgcctgagatcagggaccgcattgtggggcttcctctccagccagagtgggcacctctcaatgccccaggccgcggccctcctggcctgtagccctgccgcccctcaatgcccagcgtggcctgagttggcctcctgttcccatcaaggcagcaaactctgaacgggcacagagctggccagcctcagccctgggttcttccgcagcacccacagggccagcagtgatggactctcctgggcctgagccccgggtccttccccagcacccacagggcccggcagtgatggactctcctggctccctgaggcttgcaacactgagtggcagccgcgctcagaccaccccaccctcagcccaggcagtgccctccccaggccctgccaggcccccagctccacctccatcacctgctgcctgcagtccctccccgcaggaagccccctgccctccacaggaccttgagcctgggccacgctgggccctctgcacccagccataggcacctccctcaccatccccctcttccagccagatgacccgccttgacaaacgccctcaagcccgaggccctgtcaggatggccacgaacgcccttcctctacctgacctgtcgccctcagagcctcccaggcctggctgcccctgccctctgccgctgctacctatgtgagtgtcactctcccatgacagagactgggaccgctggtgcatcaccatatgtggaccagtcaccaaattaacccaagacagagaccacctgagcaaagccctctgtcagcacaatgccaggccggtcccatcccatgcagccctcagggaggagagaggactggggtcaccctcctttgacataagcgcctagttcaacacaccctgtgtttatcttaaaaaacagccctggtggctcacacctgcaatcccagcacttccagaggaggaggcaggaggatggcttaaccccctaggagttgaggggtgcagtaagccccactccagctgggcgacagagcaagaccctgtttcaaaaattaaacacacacatacatccccccaacagtaaatcagtgaacctgtttccaatgaaactataaaaatgcatgtcacaaaaagagcactcacaggtaggagcagcctctggcagccgtgatgttgagcatggggaaggcatagatgatgaagcgtagctccttgtgtggcaggagggagtagagtgccatgaagcccagtgccagcaccgtcggcgcgtgcgtccttctgtctaccaagcccagggggatgaagagcaggctgcagcccaggccgcggggcagggctgagtagaagtaccacagcagcggggaggtctgcgggctgggttaaggaggccacgcacctgtccacgcatgagcccgtgggctaggtggcagggtcaaggtggagaagacgcttgaagacagttgtgctgagagatgcagcctggaccacggctcgtgtgcacagacaccactcaggcctcaggcccctcctaaaagacagagcccaggccacagctcgggtgcacacataccacttgggcgtcgggccccctccaggcaggaccaaggcagcaagggccacaggacgttcggtctctgtacccttttcttcactgttaaaaacagatggtcggccgggcgcagtggctcatgtctgtaatcccagcacttcgggaggccaaggtgggtagatcacgaggtaaagagatcgagaccatcctggccaacatggtgaaaccctgtctctactacaaatacaaaaattagctgggcatggtggcatgtgcctgtaatcccagctactcaggaggctgaggcaggagaatcacttgaaccagggagttggaggttgcagtgagccgagatcatgccactgtactccaacctggcgacagagtgagactctgtctcaaaaaaaaaaaaaaaaaaaaccaaaaaacaaaaaacagacggtcacgggtgacacacatgttgggattcgttatgctgttccatctatgcgtgtatgtttgacataattcctaagaaagcactttttaaatgcagattgtccgggccgggcgtggtggctcacacctgtaatcccagcactttgggaggccaaggcaggtggatcacctgagttcaagagttcaagatcagcctgaccaacatggtaaaaccccacctctactaaaaatacaaaaattagccaggtgtggtggcgtgcgcctatagtcccagctactcatgaggctgaggcaggagaattgcttgaaccagggaggtggaggttgcagtgagccaagatcataccactgtactccagcctgggcgacagagcgagactcagtctcaaaaaaaaaaaaaaaaaagcagattgtccgaggagcagaggagaggctggggtaatctggggcagggctgtttccagccctcaggctgtttcctggctgagagagggcagccaggacctcacctcccatggccagcatttcccaggagcaagtgggagggaggggctccatcctgaccctgcagccacgctgcagagaagggagaagcagctgcttccactgcccatggaggcccaggagatgtggctgcaggtcccacccatcgccctcctgcacggacactgaaggataccccccagttggagcttttgttcaggacagtgttgtaccaaagcacctttccttccggccaagtgagctgccgccaaaaataagagtccacagcaaccgtcagtcctgacaaaataaaatagagtttcttagtcgcaaacacagccatcagtaaacatcccgccacaatgcagcccccatcactacagaaactacaagctgctttcatataaaagaggttgggcagggtgggaagattgctggagcctaggagttcaaggttgcagtgggccatgatcatgccactgcactccatcctgggtgacagagcaagactatctctaaaacaaaaaaagaaaaaagacaccaactgtgtcgaggacaccactgcccagaaccaccgcctggcgcagggacaagccgccctccactcttgtggcctcccccagcccaaggacaagggacagaccagtgaacaggggctcctaaggcgcacggtgggtccccctggagatccccgggcagggggcttaggattgaaatgttttcaacactgctaaatttagggtcattttatttcatggggatgaaaacctcccaaatttctcttgacctttgtaaaacaaggcaaaacaaaatccagttagaagcatcccacagtgactgacttacctaaacagaggatccctgccgggacggcgtggcgaagggctctgactacagaaacctttcggttgcccaaggccagcagcagcaggaggcccaggaacaggcacagctccaccctgaacacgatgatggcgaaggctgacagccagatgaagcgggcccactcgtgccgcagccaggccgcgagggccagcaggactgcaagacagtgcgggagggtgctcgtcaagacacagggcccacccggcccagaaaacacccggggaagtgaagggtgattccttttcctattataaaagccacacaaatatcccagaaaagaaactgctcagagccgctccccgcacctatgctgttggccaggaagtgtgtcccaacccagcatggaaaacaaagagcctggtttcaggtcacagaccatcctgaggaacccagtggggaatggccattacgggggaggcactgccatcagctgcacagcccgactcaggggagcccctgcccggcaccatgggtgtgcaggcccggccggcagctacgtacctacaggcagggccagcacattgggcagtgtccgcgtgcagtagaacatcaggtggaactgcatggccgtcacccagcagaacatggtggccaccatggccccgaagtgccgtctcacttccttttgtaacgtccagagtccaaaaatcacgccgagtccaagcactcctctaactaaacaaagacagtgacagcacctgagcctgcagtggaggagtatccagtggggccccctacgtgggtccttctacacagatctttctatatggagttttctatgctgctgcaatgccagctgacggctacgtcaggcaaagcagccttgagggcatcgtctccatgttgaaaacagacgactggacccaggccccctgcgctcctgtcgggaactgaggacccttgcgggggctgctctctgaagcatgagggaggacacacaacttgggggtgccacgagctgagccctacactaaaccagagaccccaccgggctgtggcatctccaggggaaatgtttgcaaaggccgggctcagaccttgctctaaccagcagccatgaggaggtgggatgtggcaggaacacaggctcccaggcaggaagggggtcaggacccctctccccatttgacagcaggagccacctctgggctggtggtctgatgaggaggtggtgagggggcaggtgtgcccaggacagtacccagccgaccacacatcctcaccgtggaccggcctgtcagccgctggcaagagactgaaaacaggaagaaaaatgaacttctgggtggctcttgctacctttccagaaggccagaggaacttcgaagccatgtgagaagcaactgggtccaggcagctgtgggggccaatgggcagagatacccaggcactgccaagggggccacggatgtctgagggctggacctgctgttcccagaataccccatgtgcataccaggcattttcttttcactgattgctggattcggactgcaaatgtctttttttttttctttttaaggacagagtttccctctgttgctcaggctggagtgcagtggcataatctcggctcactgcaacctctgccttccgggttcaagcaattctcctacctcagcctccggagtagctgggattataggcgcatgccaacacgcccggctaatttttgtatttttagtagagacaaggtttcccatgttggccaggatggtctcaaactcctgacctcaggtgatccccccgcctcggcctcccaaagtgctgggattacaggcgtgagccaccatgcccagtctgaatgtcttaataggacatttttcactgatactcacaagtgggtctggctccagctgctgtatttttggtgctggaatttcccccgggcttttaaacaattcacagaccccagcaaagccccgcttccccttttccccatcaggtccatcccctgcgtctcttctcttggttttccatcttcccaaatgcccaacaatctcaaccccgtgcccaacaagggtagcctcggcctcacgatcagcctcggctgcgggatcaccctcggccccgggatcagcctcggccacgggatcaccctcggccccgggatcagcctcggccgcgggatcagcctggccccgggatcaccctcggccccgggatcaccctcggccccgggatcagcctggccccaggatcaccctcggccccgggatcaccctcggccccaggatgacatgctcttcatccagagaggaaggattttggcctgtggcaggggctggggggggcactagcaattccaggtcaccttagtgggatcaggaaggacacagggtgggctcccgttcaccagctgaagctgcagccctccaaggttctgtccagctggagtccacccagctctgcccaacctcccaacctcttgctgccaaccctggaataagcagaagcttccaagggaatgtggactcagccccggaattgcctgtggacttcctttccctggctcgtggccccccaactcctccccatttggggcttcctgatgcctctacaggacatgcacggcttgtccagctgtccccgtgccatggtgggtttccgttcccaatctgccccttcaagaagcagaactgctccttccccaggaacgtgctacttcttaaagctctccacacaagctggactgactcgctggaagcatgtctgggtattaaaagcaataaaagcgtactgaaataaaaaagtggtgattgctgacttcaaaaactcaggttgtgtgactgggcgtggtggctcatgcctgtaatcccagcactgtgggaggctgaggtgggacaatcacttgagcccaggagttcaaagctgtagtgagctatgattgcaccactgcacttcagcctaggtgacacagcaaggccctgtctcaaaaaagaaaaaaaaatcggtttttagaacaatatgtacaaaacgttctaattttttttttttaaagtcctcatgtgggcacagagaaagacccaggatttgcacacaggccctgcagtggtggcctctgggaatgtgaggtttctgtttgtaacattccccaaggcaaatggtgctgcttctgcaggaataaaggctgttgaccccatgggggcttgccaggtgaggcgggagcagcaggctcaggtggcgagagctgcctcacaggcagtcggcatttctcttgtacctgccgtcacccctaatttcacagtcaagagtgtggaggcacagaggggctgactcagacgtcttaggcctgacctgagcacctgctctgagccgccatgccacggtgatcgagggcaggcaagactaacagacagcgttcctgggcaggagggaccgcggcctcgctgaggtcacccgatgacaccacagtccctcactccctcctcctttgttgaagacccccttacctattagctgagagtaaaacttggacatttctaacagcgaaagcacgtaaaccgcggggctggagaacactgcgatcaccactggcccgaggaacgtcctggggacgactccggggaactcaagatggtcgtactgcgaggagaagggcaggtcagtgcaccggggccctgccagctggtaacatgaggttttccccaaagacagcaggggcccctcacctgctccaggtcttgccagtggtagagcaggtcatgtgtggcctgcaggttgaagctctcctccactttggtgtagggacagatgaccaggtggacagtggctacggccaccagcagccccagcagcaggggccgcctgcctgatgacccctttccagccattccaggctttcagcttcacgtaccttcacaggccaacagtgcgagacaccagccgttagcactgccactccacgcatgctggaaaagtggaaacagattcctgaggttcgaaagtcacgcttgcgctcacgtttgggagatccgggtaaagggttagcagaattctctgaactactgtcttagtcgcactactacaaatctgaaaacgcatcaagatggaaagtttggagaaaaaatcacacttgagaatctttcatactgtaaccagtgatctgacacttccagctctgtgaatgtttttctaggcagaaggatctcagtcgcagaaccctgagtctgaccaggcctgggccacgagggcaatggagggtggtaaatggcccctgccccccagtctaaatctggcaggagagtcagcaaaacccaggcttggccccgagggaaccggctgaagaagacggaatgggaggctgaggggtgccagttagctgggtgggaggcaccaagctggagagtggtggacaggggccccgggagggcaagaaactgaacgtagtacagctgctgggacacagggctcgagtggccagcaaagcccccgctcccaggaatggtgggatggggctgtggacgcctgcgccgaaccccaccctgggggctgggagaagccatggccggctttcccaaaggtggcaccacactggccatgagcctgcatgtgagcctgggaagactggcaatgggtcccccaaacactaacaggacaacctcaggggcccgtggcacggagcttcctgagaggccagcaacatgtccagctgctacacgtgagagaccaagggaggggagggggcaaactcttcacgtttctggcttcttttaaaacagatttgattttattcaatccaaaccagaagggccagaagcaaagggagagagaaccccagggcttaccatttattaaaactactttaaaaattttttttaagagacagcgtcttactctgtcacccaagctggagtgcagtggagtgatcatggctcactgcagcctcaaactcctgggatccttttgcctgagcctcctgagtagccgcagctacaggtgtgggtcaccacactcagctaagttttcttattttttgtaaagacagggtcttgctttgtagcccaggctggtatggaattcctggcttcaagccatcttcctaccttggcctcctgaagtattgggattacaggcgtgggccaccatgcccagccaaaactatcttttgatcaaacggagagttaagaagtatacaaagatggcaaccaaaggaaaatctgtagattagaaggaaggagaaccctatttgatatggtgggcagggggtggagagaaagaaaaaagaaagctttaataattttacgactgaaatggtatgcagttctctcctttgccaaatataaaaacctggggccgggcgcggtcgctcattcccgtaatcccagctctttgggaggctgagggccaggtgcggtggctcattcccataatcccagctcttcgggaggctgaggtgggtggatcacgaggtcagcagatcaagaccatcctggccaacatggtgaaaccctgtctctactaaaaatacaaaaattagctgggcatggtagtgcacgcctataatcccagctactcgggaggctaaggcaggagaatcgcttgagcccaggaggcagaggccgcagtgagccgagatcacaccactgaaatccagtctgggccacagagcgtgactccgtctcagaaataaataaatagataataaaaaaatttaaaaaaataaacttggtatcaaacaaagagaaaggtcgaaggactaggttaggaatcactaactgagggagggcccactcagctgtctcccacttgctaagacacaagctttttgacggtggggggtttttgatgctggatgatttttcccaccagcgcagcctcagcaccaaggacagaggccagccgctgtggcctgaaggctgcctcgctgccacctcccctgctggactcatcctgcgggcagggcttgcttggtggactcactgctgaatcagcaaagcctgccgcacagtaggcactcaacaaggctgccgaagaagaaatcggtaaaaactcctacatggggttctcatcacaccagctcacgtgcttattaaaaattccagcagccgggagcggtggctcattcctgtaatcccagcactttgggaggctgaggcgggtggatcacaaggtcaagagatcgagaccagcttggccaacatggtaaaaccccgtctctactaaaaatacaaaaaaattagctggagtggtggcgagtagtcccagctacttgggaggctgaggcaggagaatggtgtgaacccaggaggtggagcttgcagtgagccgagatcgcgccactgcactcctgcctgggcgacagagcaagactccatctcaaaaataaataaataaattaattaaattaaataaaaatatgttccaacggccgggcgtggtggctcatgcctgtaatcccagcactttgggaggctgaggtgggtggatcacaaggtcaggaattcaagaccagcctagccagcatggtgaaacctcatctctactaaaaatacaaaaattagctgggcatggtggtgtgcgcctgtaatcccaactacttggaaggcagaggaggagaattgcttgaactcgggaggcagaggttgcagcaagccaagatcgcaccactgtactccagcctggacaacagagccagactccgtctcaaaaaaaaagaaataggaagcaagccggatgtgttggctcacgcctgtaattccagctactcaggagttcaagaccaacctgggctacagagccagaccccatctccacaaaaataatcccagctactcaggaagctgacatggggggtactgcttgaggcccggagttcaagaccaacttgggctacatcatgagaccccatttctacaaaaataaaaaataaaacggaacggggagcatctacgtgccaagatgtgggaggtgcacacagcaagtgctgcttggcagtcccccacaaccccactccacacctctccacccaggggagttccccagcaaggaagagttcagctgtggggtgaaaacattacgtgctgactctgacactcctggcgggcccccagcacctcctcggacccaacaaggtgtgccttctgctgatgaccagcacagctcactttcgagggcatgagaagaccaagggtgagtctggattctctgccaggagcacgggaagaccaagtcaacaccagcaagcacgaaaaccacgacgaaccccccaccaggcgagggtgaacggacactgtcctgcactagcccactctgctgggcagctgggcagcagctgtggctaatctaagtgacgggtgcttcgagagcacccacaggttaaaacgggcccaggccatgacactttaaaatggtggtttacagaacaatggcatctcagattagggaatgacctgcaaagaccctcttgtccccatcaatccagattttaaggcctctaccgaaattgatcaaatcaggctaagcatggtggctcacgcctgtaaccctagcactttgggaggctgaggcaggcagatcgcttgaggtcaggacttcgagaccagcctggccaacatggtgaaaccccgtctctactaaaaatacaaaaattagccggacctggtggtgggtgcctgtaatcccaacttaggaggctgaggcagcagaatcacaggaacctggaaggcggagcttgcagtgagctgagatcgcgccactgcactccagcctgggcgacaaagtgagactccgtctcaaaaaaacagaaaagaaactggtcaaatcagatgttactttttttttttttaaatgtgcagtgttatctgcactccttccttccacaggcaggagttctctgaaatccagacgctgcacgttttatttcccctaatttaaaccaggggttcctgaacatgagcgagtgttcatcacctcaagcgcctgtagaaatgcagatccccagcccccagagaccctaagtggaccccagatccccagcccccaggtgaaaaacccatcccccaggtgggaggtccggccccaggtgaggagcccggccccaggtgagaggtccagccccaggtgagaggtcgggcccccggatgagaggtccggcccccgggtgagaggtctggcccccaggtgacaggtccagccccaggtgaggagcccggccccaagtgaggggtgcagccccaggtaaggagcacggggctgtgacgcgtggacatgcgcggtgaggcctcaggaatccagcgccagcgccagctcgggtcgcgccctcgcccgcctcctccctggtctcgccgcgcgcccgcctgaaggccccggtcgcggcagcgcgcactgacctccgcagctcccggcggcgtccttcgaagcgcggctgcctgggccagcctcggcaggaagcaggacggcggaaacagaacagagcccgaatctaaagtccttgcccaaatctaaagtggctaccgcagccccggccgctacggccgcagagaccctctgtgccctgagtaaagatggccgccgcgggctgcgcgc

SEQ ID NO: 1522 - DNA, 69048 bp, Homo sapiens
ccgggcctcactcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggtaaggattcgacgctgccccgcgccctggttccccagggccccagcggacgtggtccatccccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccctcctggtgcctccttagccgtagctctagagacctgggctgccaaccccaaggcctcgtggcctggcgccctcccaggcgtcccacctgacccggtggggtctaaagcagtttggtttgggaggaggagagggcaggaggcgcttggaatggggggcgtggcgggaggagacagaggacacccgcgtgggtgtcaaagtgtgggcacccactgtgggcaccgcagctgtggggcaaagctctggagcccgcgaagccgaaggagcctgccgccccctttaggctttgcgaggtgggcctcccagggctgcttccctgcccagtcttggtaagaaagggttaaacgcaggtctcagcagaaaggcaggaggccgaggaaagcctcccccactccccattgtgccttatgactctttttcaacacataatggggtcgaaggcggggcctttacaaaggcctctgggtggagggtgaaattccttgagatcaaaagagggggcgattcttgggccaggaagggctttgggccctgggaaaaagtcagaccgctcaggtgggcccagctgcccagggaggcaggggttgggtcccagcctcagtgtagatactgcaactgttttttgaaggcctaccgtgcgtagagggacctgctctgacatctcatgtacatcatttcattttacaaatggggaaactgaggcttagacaatttaagtaagtggtgggaccagggtttgaatccagactccaaactctgcagccctagcgtcctgctcccactgtgttgcctaagagatagggggctgagccttggttttgtcttccggctcctcctgggctcagcccgctcttcctccactctccagtcttgctctttccaactgtttagtcctccccacctgtgggtgtccccacgctgtcctgccccagccatcccactccctggccccatgcatcttgttcctgtgtcacctttttctttctttaactgaatacctgtgaattccctcagaagaggcccctggacacagcttctcaacatcccaactggtgaagactaggctgagtgatgatcccggtccatgtgcccatttgtaaaaaggggtgtattcccctttcgggactattgtgaggaataaaactgaactgaggccagaacaagatgctatcttcattcagcaaatacttaagcatccgccgtgtgccaagctctgttctaggtgccgggaatgccacagtaaatcagccaaaagccctcttctggattggatgtttgcataacaaaattctttcaggctttgaaactgtcagaattcacagtgtagacttgaaatcaagctattcataaggaaggagattaagacgcaatcacctgtaaaatggattggccaacctttggccctcactttagcaaaggcagccttgctgtgggacctgggatcagttctgttccctctctgtgcctcggcctcctcccataagctgtggagatcaatagtgcctaccagtggtgaggtctagatatgatgaatgcttgcgaagggtttaagctggtacctgtgcttaagaaaatcctggctatcctcagctctcttctcagcagaaaatgcaatgcggagactggaagttgggttatgtgcctaccctgcctctgaacctgttacccacttctgcccaggcccttcccatcctgttgggctacacatgtggggtggcatggtgccctctttgctcacactcagatgccaccttctgtcgccatcctaaacacagcctgggctgggagcgcagagctccatgatgagatcagccctggagccatcatctctgcagcgcttcctgccctctgcctgttcttgtgcctcaccgtgtcctagctcaggaccaaactcagccctgttctgtcccatgacttacatacccaacattccctgcaagctggatatgatcttggaaaggggaagtgagttgcccagaggcacacagatgctacctgaggagctggggctggagcctgcgtatctagaattccaaatctagcaatctccatgctgtacccatctctgggcatatgaggccttttaatccagggagtaggatccagtagcagagcccgagttctcaccttgaaatcagtctgacttggctttttaatacaaaacccagagctctgagagaacattgctgggagagtgagcaagctgggctgagaaccagcactcagaaatctccatgtggccacaggaatgctgacttggcttcccagcaccatgtcgtcgtccttggcaggctggagctgggctttgtggtatgttagatttgttttttttcttctggagatgtcctcactttcagagggcagttaggggcagtagactgaaggttcattcccagcactgccatgcgaccctggacaagtcaccttccctttcgaagcctcagttttctcatctgcaatatgggttaaaattatatactttgcagggtcgcaagatcataaatggttttccaactttgggctgaaccagcattgatgttattaagacattcatatttcctgtggagcaatttcaaaagcagttaactttatccctaccaggtgatcctgagggcctgagggaagtccacgtttaggtcacaaaagcctacacagcagggaaaacactggtttgggggctggtgtcttggattccaatcgccagctgtgtgacctgaggcaagtcactttacctctctgagtgtcaagctcataggaggcccccaacatcaagatatgatgctcagtgtctgaagaacatagtctccgtatttttctgcctccttgtaccagctcccaacccccccgccaacacttcgttaattgctcccagaaaaactctatgcttaaagttttccatgcttaaattctcagcctcactgtggcatgaaatcaattgtttgcattgaatttgacttctcaaattaaggggtaaaatttgagatgagagtagggggttagggaggagatgaggacgaagttaaaccagatgtgcttttgtttaattgtaggatggtggttaagctgctcaagtattaccatcgttctttctgaattccagtaaccaggagtcaggtttcacaaaaagtcgtagtgttctttcctggctggtgtggactcgccctctctattattattattattattattattactattttgtattcatctgaggccacagagtactggccagagaggagacatagatccccagaatttcagttggaaggcctttagaagctggctcggtcaactgggctcttggtgcaccagggagactgaggcccagagaggagaagaggcttgcccagggtcacacaattgcttagggcagagtggactgggaattcagtctcctggccttaagctacatgatctttccaaaggcaaccactctcctgaatttggtgtgtttcatttctacagtatattcttagcatatctgttttttgaaaatcattgtttaagggaggatgcagatgatgtgggttggtggaaaaagatattaagctcaggagagctgagctgaagtccttgaatacctctgtgaccttgggcaagtcacttcccctgtctgagtctcagattcttcatctgtaaaccaatatatctgaggagtaggagtggagagatgagacttccctaagacttggaatgggtctaatgtattcaactggtcctcagatatttatagcctgctgtgtgctgggttatgggagatccatcacaaactgccttcctaaggctgcagggggtgggggattgttgacttttgcggtgattaaacaacttttatttagttgctggtgtttttaaaccaggcaatttcattttatataaagataaggatttctggcttctcttgaaagatcagaagatgtggccatatggggctatgtccctgcctggccacagtggctggagctgattagcagctgctccatccactttaccacagtctccaccacgccccactgcctcacacttgcccacctgcctccctgacattacctacctaccttctgagcttgcggtttctgggctagatgcagtgaggccatgtaagaggggctcaaattccacttgaatgattgtgtggggcttgggccagccctcagggggctcagggtgagaatatgggacacgtggacactagcccctcttccatagcctggcaacatctacaaaacatgtcagctaggcgaaggagcttttttcctgcttcggtggtcctcaggaagagtctgagggctctggaggtttgggggtgatagagcatctacctgtcaaggctcagcgagttgagcccagggtctagctggggacaggcatcgctgggtacttcattctaaagattgcacagcccctgcagggaagagactcccttgacagcttccaccttaccccttgctccccaagagccctgtgcattggtgcgccacttcaccctgtgctccctaacagccctgtgcatcagtgcataaccacttctcagacaggaaacacgatcttgcactctgaacccacagctctctgttccaccccctttgctgggagccagggcctggtgatgacaggcaggtaccatggtggctgcagcaagcatcttagaatcgccatgtctgagccagagggtagcacaggaggctgtgaagcctgatggttacatgcggggggctctggaggcagctgctgtgatgtgagattctaggtctccacgaatcaactgctccaggggttatgagatggacaagggagactgattgattgtcgattgctgatactaacctcacatcccctggtccttacacctgcagacgacttcagaaatgtgccctgtgtgggaagtggcattttgtgagcaccattgggtaccaggcactttcgcacattacctttgatactcacctaccccctactctccagcattttgcagttaaggagactgaggctcagagggcagacaccttaggattactcctcccctaggtctctatgcctctctgctttgacccagggaagggaggagaggacaggctggaaggtcatttctggaaataaggccgtggagaccctgtagtgaggccctgaccctccagactttctaagccaccccctcctcctccactccagcttgtttcagagatgcttcttcatccttccagagctcagtttgtcattcaggtgcatgaactttacctggccaggtctgcaaactgctgggcagagctcagcaaatattttatgttctttaaaaaagtttttaggtggctgaagcaaattgcttttactggaaaaaccagaagtgtgacctttattttatttttgcagagatggggccctgctatgttgctcagcctgggttcaagaagtctacccaccttggcccctgaaagtgctgagattataggcatgaaccattgtgcctggcccacaagtgcaccctttaaaaagatctaccaggtgacccttttttagactgagtatcgctctgttccccaggctggagtgcagtggcgtgatctcggctcactacaacctccgcctcccgggttccagagattctcctgcctcagcctcccatgtagctgggattacaggcacatgccaccacacccagctaatttttgtatttttagtagagacatggttttgccatgtcggccaggttgatcttgaactcctgacctcaggtgatccaccctcctcggcctcgcaaagtgctgggattacaggcatgggccaccacacctggccccagtgactttttgttgggtcaacctcttgccttctttagtgcacctttactaggtcagtaaagccacagggtgggtaccacttagctctcaggctgacgttctcaggcctcttgctggctgtcactgaagtgtctcaggcttgttgtttttttgtttgtttgtctgttttgtttgtttgttttgttgttgttgttttttgagacagggtctagtggctctgttgcccaggctggagtgcagtggcacgatcatggctcactacagtgcagccttgacttcctggactcaagcaatcctcctaccccaacctctcaagtagctgggaccacaggcattcgccaccacgccccgctaattttttttattacttgtagagatgaggtcttgcaatgttgcccaggctggtttcgaactcctgggctcaagtgatcctcccacctcatcctcccaaagtgctgggattacaggtgtgagccactgcatctggccagcctggccttttggaggatctcatccccctccacctgtctccacctgtctccaccttgacttacctgtctctcagcatacaggagttactaactgacccgtctgccgccattctggtgagaaaatgtctcatctgaggcccatttcccctcctccactccttctgagcccttctatagctcctcttctttctctgcctcattccgctggtccctgccatgccactactaactaaaagtccatagactataagcccaacatgcacgtactaggcatggtgctcagtgccttgcctgtaattactatttggtcctacagcagcgctgggtggcaggtgctattatccccacattacagatgaggaaacggaaacacaaactcccccagctgggaagtgagaagtagacatgtttgttccctgcggtgacccatccatccattcaaggctactgctttctccgtaatgcaaatgacataacccatcttcctagaagagtcagttccctatttatcttaaaaccatccaatatagaaattcatattctaggtctgttagcctatcaagatatcagagataagcaggtttcctctcaacagcttgtccaagcccttaatcacctaagtgatttttttgtgtgtgaaaatgctgtttttttgcttttccccatgacctaatccttatacagatgctccttgatttaccaaaggtttttgtcctggaattgtaagttgaaaaatatcataagtagaaaatggttataacacctaacctgtcaaacatggtagcttagcctgacttaccctaaatgtgttcagaacagttacattagcctatagttgggcaaatcatctaacacgaggcctatttcataataaagtgttgactatctcatgtcaatttcttggctatactgtattgaatgtgaaaaacagaatggctggttgggtactcgaggtgtggtttccactgaacactgtagcttttgcatcatcgtaaagaaaaaaatcttaagtgtaagttggggacagtctgtaatgaacatttaagggcttactctgtgtcagaaactgagctaatcactttgaatgaccttattgtattgagctcataattctttccattttgcaaacaaggaaacggaagctcagagagattgagtaatgttctcaaagtttggaaagtgcaggtgagactcaaatccagggttgcccaatcagattggcatctggattcaaatttgcatgtttggagaagagctctcagggcaccttgtggtacacatttgtttttcagtgagtgtttgcaaatgacatgggggtgggaggccccagggggaggagacagaacatagacacacctggtggggcaccagcgtctgttctcccagacagtgtttcttagcctgttcaccccctcataggaaatgacaagcctagaaggaagcatcctgagaaacccagaggggcctgggtttgaatcccagccctgccatttcaagctgtgtgaccttcgccaagtccctttccctctcttagcttctggctaccctccctaccacgcatggtttatttgaatgaggcaaggccttaggatttttcgatttgtggatggcgaatagccagcatgtctccttcctctctcctgccctgcacccacatcagacatcactagtcaaccactgcttgctttccttcccagattccttctaagtacagtgctccagacagccattagcaactaatatagagttggcacacaagataaaaggacatcccagaaccagattagatttggtcattgtgtgggtgggggtagggaagggataggcccaggtggcacccagttcagtgtcacggtgctccttggtcttcttttccttgtctttggaggaactaagctagactgtaccagggcccaccccaggtgtggggtaggaaccttttatgaggcacagagctgtgcccgtgttcagtcccaagggagaggcaggtttctgggcctcatcactgtctaggcttaaagtaagagtgacgagaaagaggctggtttcaggtcctcctggaaagagttaggcctgcccctctccaccctttgtaataacatccatagtagtaataagagttctcgacactgacggaccacttgttacgcaccaagccactctgcgaaatgctttgtatacatttacacatttaatccttataccagcccatttttcaggtgaggagaatgactcagagtaattagcctgggtttgcccagctggtaagtgtcggagctacgatttgaattcatatctgtcaaaccccgaataaataactcttattactacgatggatattattacaaaggatggggaggggccagcctaactctttccaggaggacctgaaactgagctctttcttttttttatggtattcagaacatcactttataaactgttgtcagattaccatttaaacattaatacccaaatacagaatttagacaattactttaaattgtaactgtaccatccccaagctctcagctatgaatttggtttggggagagggctccgtaataggccactgaagtcccccgtcccaccccttttttctcccctgaaaactagctgcctgactgctctgccagacttgggctagaacttggcttcactgtgacagtgggaccacctgggccctacagtgtggcaaaaccgacccgcccacaaactccatcccaggtgttgagatgctaacacactgaagctgaaagaccccacttggttttgccacagatcaagttgcatctgactagagagcctgtcctctaccctatttcctgcacaagtctttttctttgtaatgcaacaagcgctactcagctcagatccagtgggacacagggaaaggggctgtagtgtagcccagccttgctgagggagacccctgcctcgccaaagcacttcgctcacaaaggctgaaactggcctctttctcgtcactcttactttaagcctaggcagtgatgaggcccagaaacctgcctctcccttgggactgaacatgggcacagctctgtgcctcataaaaggttcctaccccacacctggggtgggccctggtacagtctagcttagttcctcctgctttcctccaccgcaggctcagtgcggggcccgcggcctctgcgtctttctctcagcttaccatgatcatttctcattgatgagtgcgatacgtctttgcccgtggaaagtgctttaccatcggcagagccttccacgtttacacatgcgcagcacagcaaagggcatctctttttaaaagggagaaaactgaagctcagaggctgggcacaagggctcacgcatgtaatcccagcactttgggaggccaaggcgggcagatcacttaaggtcaggagttcaagaacagcctggccaacatggtgaaaccctatctgtactaagaatacaaaaactagctgggcgtggtggtgtatgcctgtaattccagctatgtgggaggctgaggcatgagaatcacttgaatccgggaggcggaggttgcagtgagcagagatcgtgccactgcactccaacctgagtgacagagtgagactgcatttcaagaaaacaaaaagaagattgaggctcagggagggagggtggtgggccccggaccacacagcgaataaacggtaaaccctgcaccaaggaattaggtaccccacctgttccctaggccttctggaacaaattgcctaggggaacctgaggtcagtgctgggaacgcaggagtggtggctcagcagaggcaggggttgtgctgccccccgcatcccacccagatacaccctatcctgttttaatcagccattgaccttggacaagtcactttaacactgccaacctcagtttccaggcacttattctatttttcaggttttttttgttgttgttgtttgtttgttttttgagacaaggtcttgccctgtcacccaggctggagttcaggcacgatcatagttgactgcggccttgacttcctgggctcaagtgatctcctgcctcagcctcccgagtagctggaactgcaggcttgtgccaccatgcccagctaattttttttattttttattttgtgagatgaggtcttgcttatgttgatgaggctggtcttgaactcctgggctcaggcaatcctcccacctcagcttcccaaaatgttgggattaacaggcggtgagccaccaggcctggcatatttttcagtttttaaagccatttcttttttctctttttttttttttttttttgagacggagtctcgccctgtcgcccaggatggagtgcagtggcttgatcttggctcactgcagcctcccaggttcaagtgattctcctgcctcagcctctggagtagctgggactacaggggtgtgccaccacgcccggctaattttttgtacttatagtagacacggggtttcaccgtgttagccaggatgttctcgatctcctgaccttgtgatccgcccaccttagccttccaaagtgctgggagccacggtgcccggccgaaagccatttcttattcatgaactcaccgaaccatcaaagcaacccaataaagtattcacatcattttgcaaagtgggagactgaggcttggggaggcaagcaacttgcctgaggtaaaattgatggtaaaaccaggcctcaaactcaggtcaggatcccaggctgaaggtctttccccagctgtgtctccagtctctctcatcgttgcctttgtacctgccatcccctcccctgcagcaacctctccctgtttgtgttgccagttggcatcatggctgtttttctagagcttgctttggatatcttgaaccctttgtaatctgatcatccacatagcatctggctctgagtttcagttcctggagggtaggagccccatctgagtcactcgtgaattcccatgcctaataagatgcctgctttcagcaagcgtttaatgacttttttttttttgagacggagtctgctctgtcgcccaggctgtagtacaacggcgcgatctcggctcactgcaacctgcgcctcccgggttcaagcgattctcctgccttggcctcctgagtagctgggattacaggtgcctgacagcacgcctggctaatttttgtatttttaggagagacagggtttcatcatgttggccaggctggtctcaaactcctgacctcaggtgatccacttgccttggcctcccaaagtgctgggattacaacagcccatttaatgacttttgagttcatgaaaggctgccccactcggcaagggtttccacagctggcctggctttgttaccatggggaagcctgggagggatgccccactgggtgtgactcttgagccactcaatgcgaagcctggccaccctccccagaccttcactggtgtccttgcacgaatgccaccagctcataaatggttagtgattggcagcaggacaagccagtgtctctgggtccagttttcctgttggcagttcaggcctttagtctcactcaggtatgaggtgcccagtgtcatacctctggccaatgtctttgtccattttgttcacagatgtacccccaatcccaaacagccttaatttctttaataataataatagtcatagctgtaaatttgctgaatctgcatgtaccatgcttcctggtgcatagtaggcacttaatacatatttgttgaatgaatgaatactcgcagcgagttaacatttcttagagactgagagtccctaagtgaaaggtcacttgcatgacctctgtgcctcagtttcatgtgtcgactccgtgagaggtactcagaggagtaaccaatacatatgtccatttttttttttttttttgagatggagtctcgctctgtcgcccaggctggagtgcagtggcgcaatctcggctcactacaagctccacctcctgggttcacgccattctcctgcctcaacctccccagtagctgggactacaggcacacaccaccacgcccagctaatttttgttgtattttttagtagagacagggtttcaccatgttagccaggatggtctccatctcctgacttcatgatccgcccgccttggcctcccaaagtgctgggattacaggcgtgagccactgcacccggccaggtttgtttaaaatatatcatgaaccaggctgtgttctaagcagctcacatgtattttttcatttatccttgcacctgaggctcagagagattatgttcatgtctcctaggtcacctggttggtgtcacgtgcaaatattttaatatctcccaggacatgtgtgttccaaataacataatatgggaaccacctcccctaccagcctcctcccataacacacacctcacgccccagatcctaggcttagaacaaacgggaacagtagtaggcgagtcaagcggtcatgttgtccctgactataaaatgcctcatccagtgtcgggcacacaataggtcttctgatcaccatctgtgggataggcgccaatcatgatctgagcagaagctggcaggagggagccccgaatctgctggaggaaactcggtgctggggggactttagagaagaaatgacagcggtcataaatcattgtaacagtaacagctcatattaactgagtggcaggcactgttcaagcaagtcagatacattaatcatttaatcctcatatcagccctaggaggtagatattattgtcattgtccccactcacggatggggagccaggctcagaaataagctcatttgggctgggcgcagtggcccctgcctgtaatcccagcactttgggaggccgaggtgggtggatcacctgaggtcaggagtttgagaccagcatggccaacatgatgaaaccctatctttactaaaaatacaaaacattatagccagatgtggtggcaggtgcctgtaatccctcaagattacaggtactcaggaggatgagacaggagaatcacttgaacccgggaggcggaggttgcagccagctgagattgtcccactgtactccagactgggcgacagagcgagactccatctcaaaaacaaaaaacaaaaacaaaaatggggaataagctcatttgtccagtaaatggctagtaaatgatagctctggagtgtgaacaccagcactcaggctgtggcatcttgctgtcctgcctccttctgtaaagactcgtgaagcttcctgctgggtagttcctggtacctctgctccaggttggccactggcagcaggcctgtgccagggtgcatgctggcgctatatgatccgtggggcggaggggagtatccccatctcctcaggggcctcccctatgtcacaccctgaggctgggcccagaccggtattcaggaaaggaaactgatctgtcacctcacccctgcctggggcagcccagcatgtgtcagccccctaatccccgggtactgcccaggacaagcagtaacagggacaaccaccctccaacatggggaggcctgcaacagctctggggcagaaggaggctcagggaggtagcaacttaccacccagcagctcgtggagctagtgggtggttgagctgggatttggacccagggcttggctctggtgaggggggatgtgtctgccatggggttgtctggtccagagatccaggcctagctcttttatgaaaccttaatttgttcactgataatagcaagagttgtcatttcctgaatctaacctccccaaagggtagatactcaaatctctgcttttttttttttttttttttttgacatggagtctcgctctgtcgcccaggctggagtgcagtggcgtgatctcggctcactgccacctccacctcccaggttcaagcaattctcctgcctcagcctactgagtagctgggattacaggcgcgtgccaccacacctggctaatttttgtatttttagtagagacggggtttcaccatgttgctcaggctggtctcaaactcctgacctcatgatctgcccgcctcagcctcccaaagtgctggaattacaggcatgagctactgcgcccggcccaaatctctgcttttacaggtaaagaatggaagcacaggctgggagtggtggcacatgcctgtgtcctagctacttgggagactgaggcaggaggattgcttgagccaaggacttcaaggctgcagtgagatatcattgcacctgtgaatagctaccgcactccagcctgggcaacatagcaagatcccatctctaaaaataaaaaatataagaaaaaaaaatgaatagaagcacaaaggaagggaagggatcacccaaggtcctatagctcatacatgggttaatccagaattggaacccgggcagccttgctccagagtccggtctcacttaatgagtactagataattctctgcatgtcagatgggtacactcttcttgaacctgctagttcttttggagccagatctggggagggggagcaaggcaggagttgagcaaatagcaggaacagactgtgtgacacttgctgggaggctccgaggctccagctccctgagcttagaagtgcggagtttatctatcccctgcgcgattcctgggggaagggaaggacaggcgaaggggcatggcggggcagtcctggtgtctccaggaccagggtcagggggaggccagagcaattagcctggctgaggcctctgctaactcagaaacgtaagtgggggattggtccaggcctcactccagggctctggcctcgagcctgaccctcctgagtttctatctgaggcttccagagtcttcctggggcagtgaatctcagagtgctggtttgtgtgagaactttgttctgaaatttcccttttcaacaaccaaatccctgggctggcctgcctgccccacttccccctcttggaggaaacggatgctttcctcttgggcggccacatgatttgaataatcaagtgtttcccagctggcctctggccaaacggagctcagctgggcaaggcccccagttggggcactgaggcaagcctgccaacctcctcatcccgccacacgctccagccaccgagggtaaaatacaggaaaaatgcatggcccatagacttggctgggccaggccccagactattcctgtgatggaggcagcgcttgtcttgggctttgtcccatctacctggagaaagctgagtggaggaagaaaaaggctgcccctgctcaggaaattcctgatggagcggcctctcctggcgtgctcacctgggtgctggcgtcttggcacttgtcagggtggagagaggaggaagccagtcaagaaggggaaagacgggtgcgggaggacattcactgattcaacaaacatctcattagcccaactgcctgtgaggcccagggttaggtgctggaatcacagatggatctgccctggattttgccttcaaagagtgtgtgtaggctgggctccgcggctcacgcctgtagtcccagcactttgggaggccaaggccagtggatcacctgaggtcaggagttcgagaccagcctgaccaacatggtgaaacctcgtctctactaaaaatacaaaaattagccgggcatggtggcgcgtgcctgtaatcccagctactccggaggctgaggcaggagaattgcttgaacctgggaggcagaggtggcagtgagccaagatggcaccattgcactccagcctgggcaacaagagcaaaactctgtctcaaacaaacgaacaaaaagagtgtgtacagaaatggtcttgtaagcagactcccccacagagccctaggtggtagaggatgagggaaagcatgagaggccacctagctaagccttgggcagaatggccgcaaaggatttctggagacagcagatttcatttatttattttttttgagatggagtctctgtctcccaggctggagtgccatagcgccatctcggctcactgcaacctccgcctcccaggttcaagctattctcctgcatcagcctctggagtagctgggactacaggcatgtaccaccatacctggctaatttttgtatttttagtagaaatggggtttcaccatgttggccaggctggtctcaaactcctgacctcaggtgatctgcctgcctcggcctcccaaagtgctgggattacaggtgtgagctaccacgcccggcctactttattaatttttaaccttttttgctgcattatataatttttgatatgtggtgtttttaatcattcagttctaagtaattttaagtttctactatgacttttctttgatccttgaaatttttagggactttttttcatttctaagtgtaggggtaatgatttatacttgtaaacgcttagcttctcacttaattgatggtcacaggatgtggtctatgtgaaaacttattatttgaactgtgagacttactttttggcctggtaggtgatgaattatttaaatgtttgcatgttcctgaaaagaaagtgtgtttatgtattttgtttctaccatcctacatttttatttcaatttgttctgctttttctgttttatcactttaaaaaattatctgtggcttttccctacaaagacaagattagcattttctcatgtcccttgctcccctgcctctcttcagtttccacacccttcactgacatgctcccctcagcccccatgatgtcacatgaaaattgtctagatttttaaaaaattgtctaattctgagttacagatctatgttattcttgttcttttcttttcttttcttttcttttctttcttgagatggagtttcactcttgttgcccaggctggagtgcaatggtgcgatctcagctctccacaacctctgcctcccgggttcaagcgattctcctgtctcagcctcccgagtagctgggattacaggcatgcaccaccacacccagctaattttgtatttttagtagagacggggtttctccgtgttggtcaggctggtctcgaactcccgacctcaggtgatctgcctgcctcagccacccaaagtgctgggattacaggtgtgagccaccacgcccggcccttcttgttcttttctttgaacttgaatttgttttgaaaaactaaactttactaaattatttgctcagtcttcagatatcttgaatacaatctgtggaatttgctcctaattaaatcattcctttaaaattatttgattctttttttggagggggcgaggggctgtctttttgtacaaacctgagcccttgatgctgtaacttttattagcctttaactttttttttttttttttgaggtggagttttggctctgttgctcaggctcaagtgtggtggtgtgatcttggctcaccacaagctctgcctcctgggtttaggcgattctcctgcctcagcttcctgaatagctgggattagtggcacctgccaccacacctggctaatttttgtattttcagtagggacaaggttttaccttgttggctaggctggtctcaaactcccaacctgaagtgatccgtccacctcggcctcccaaagtgctaggattataggcatgaccaccacgcccggccagcctttaacatttgaatggctgtttagctggatagaaaattcccagctcaatctttttttccttctgtagtttggtcaattcgacatttattccatttgtaagtgttctgttttttgctaaacctttaggatgttttcattgtgtgtacgtgttttttttttttttgtttttttgtttttttgttttttttgagacagtcttgctctgtcacccaggctggagtgtagtggcacgatcactgctcatacagcctcaacctccccaaataaagtgatcctcccacctcagccccctaagtagctgggactgcaggtgcacaacaccacacccaggtaatttttgtattttttgtagagatggggtttccttatgttgcccaggctggtctcgaactcctgggcttaagcgatcctcctgccgtggcctcccaaggtgctgagatttacaggagtgacctattcaggcatgagattacatgcctgacctattcagtttttttttttttttttttttttgaggcggaatctcgctctgtcacccaggctggagtgcagtggtgtgatctcagctcaccgcaacctctgcctcctggattcaagcaattctcctgcctcagcctcccaagtagctgggattacgggcatgtgccaccatgcctggctaatttttttttgtatttttagtagagatgagatttcaccatattggccagactggtctcggactcctgaccttgtgatccacccaccttgacctcccaaaatgctgggattacagacgtgagcctccgctcccggccgacctattcagtttcttaatggtatgttttgataacaagaggttttcaattttgatgaagtccaatttaccttttttttcttttatggaattagtattctttgcctaacccaaagtcatgaaaatattatggagtcagggccgggcgtcgtggctcatacatgtaatcccagcactttgggaggccgaggtgggcggatcacctgaggtcaggagttcgagaccagcctggtcaacatggcgaaaccccgtctctactaaaagtacaaaaattagctgggtgtggtggtgggcgcctgtaatcccagctactcaggaggctgaggcagagaattgcttgaacccaggaggtggaggttgcagtgagccaagattatgccactgcactccagcctgggtgacaagagcgagactccatctcaaaaaaaaaaaaaagaaaatattatggagtcagtattctttgcctaccccaaagtcatgaagatatccttttatattttcttctagaagctttgtgattctgacttacaattaggtttatggttaatctcaaattaatgcagtaagattggggttaatgttcttttaacttttctttcaatgttctgtttctttttttttttctgagacagggtcttactttgtcacccaggctggagtgcagtggcatgaacatggctcacttcagtctcaacccctggccttaagcaacgctcccaccccagcctcccaaatagcagggaccacaggtgcacaccacacttggctaattaaaaaataattttttttgtagagatgaggttcttgccatgtttcctggaccttccaaagtgttggaattccagtcatgagccaccaagcctggccaattttctgtttcttaatccttccctgcttcctcctggaagcgtcctcaagctaataacttagctctctcctccatcgttcagcagctggatacactctgtaatttattctacttatgtgtttgttatttcaactggtttttcacatagagtgtttccactggggtcttttaaccattcctctttctgttttgctaacatctttgctcatttcttttgcatgtttctcacagtttatggagactttttgtttgcttcattttgtttcgtttttttgagacagggtctccactgttgcccaggctggagtgcagtggcgtgatctctgctcactgcagcctcgacctcccgagctcaagtgatcctcccacttcagcctcctgagtaactgggactatagttgtgcaccaccacggccagctaattttttttgtattttttgtagagatggagtttcattgtgttgcccaggctggtctcaaactcttgggctcaagtaatccacccgccttggcttcctagagtgctgggattacaggtgtgagccaccgcatctggtcctgttaatggtttttctttagaattcattgtgctatggctggtagtggcgtggggtgggattcggggagccatgcacttcttgcccttaaaactagcagccagggaaaacgtatggctcctggatcctccctctcaaatcagtcccaaatactgaaaagcaaaacatcactaaacctaggcaattacgatttttgcttattttaaattctcagtaaatctgatctaatacggatgattccagcggtatctctaatcagtttgggtttcttttgaagtcattgtgctccttggatactctgttctttaacttgtgagcttactccgtgggggatttcagctattctgtttgatgctgtgtctttggtaagagtctaaggctgaccctagtcgcccagttccaatgagtccaaggagacgacattgccaggacgggaatccctggacatcagaaccacttggtttctcactaggtgtgacatcaccattctccctcccccagtgactcactccacaggattgggcctctctttcagaccccagggagaaacagtgaggagaaggggctatatgcctaggtcagaattcttcagactggggtctggaaaggaaggggtggtggagtgactgtagaggccccctgtagtgactgtcggtcccctcccaattcctgcagttccacattgtttgctggcaagctttgaatttttttttttttttttttttgagacatggtctcactctgtcacccagactggagagcagtggcatgaacatggctcactggagcctcgacatcctgggttcaagcacacctcctgcctcagtctcctaagtagctgggaccacaggcgtgcaccaccacatccagatcatttttgatttttttttttttttttttttggagacagagtcttgctctgtcacccaggctggagtgcagtggtgcaatcttggctcaacctctgtctctcaggttcaagcaattctcgtgcctcagcctcccgagtagctgggattacaggcacccaccaccacacccggctaatttttgtatttttagtagagatgagatggggtttcaccatgttggccaggctggtctcgaactcctggtctcaagtgatccacccgccttggcctcccaaagtgcgggattacaggtgtgagccacggcgcccggccaattttttgatttttttgtaagagacagggtctcactttgttgcccaggctgtctcaaggtcctgggctcaagcgagcctcctgccttggctcccaaagtgctggaattatggcccagcccatgctttgactttatctcagtagacacttgtgccatcctcctgggctgctttatgcaagatactttttgtgggtttcatgaaaatgtgggcttagtgataagccataagttaattgaggggcagaacaaaggtgggttggacaatttggggctcacatgtcctgggatagagagccaaaggggctctgggaaagggaggaggattctgggaggacacggagtcagcagagaggaggatggagtttcaacaagcccagagctgaagttggagactgaggtctagggtagcagatgtgggctttgccaggaggcaggtccagagggtggctgtggggctgaactccaaccccacacccagctctgaccttagttgttccaggacagtgggtgtgtgtatgggggcctgggcttggaacagagaggcaagaggagaactcaaaccctgttttcttttctgtaatattctctccaccctaaagaccatgccctgccttttctcctggctgcagcaacccctccccgccaccctacacacactagtttaaactctcttccatctcccaggagattctgtttccccattgttgcctaggcttagtggtattttgttctgttgttacttgggattgatgttgagaaggaggacccaggagccatatgtcttctctctctgttggggcaaggagcgtgtggattccccaatcccctgtcccaccaccagccagagcacaatgaattcaaaagtaaaaccataaactgattagagacaacccagagtcagtggtattagaataaaaagaccaagattttttttttaattttttattttttgaaatggagtcttgctttgtcacccaggctggagtgcaatggtgtgatctcagcttgctgcaacctctgcctcccaggttcaagcgattctcccacctgagcctcccgagtagctgggattacaggcacctgccatcatgccctgctaatttttgtatttttgtagagatggggtttcaccatgttggccaggctgatctcgaactcctgacctcatgtgatccgcccgcctcagcctcctgaagtgctgggattacaggcgtgagctactgcgcccagcccaagaccaatattttaaataaacatcagaaacatgagaaataaggaaacaagagaaataaggaaaaacatttgcagcataaagtagaatgagagagtgtaaaaaataaaagagctgaaagcaaatattcaatatgagaaagcagcctcattctctgccccacccaaacctctgcgtgcaccttacagctccctgttctccaggaaagacgttcacggcttctggaccttggcatgggctgttccagcagcttagacttccttccctccacttctgctgaaacacttcagcacatcctcaagactccttccctgaccatgcctcatggtcaaggtgacactcagtgatggcatagggttctggagtcaggacaccagggtgcctgtcctgattcttcaactaattggctgtgtgactttgggcaggtcatgctacctctctggacctcaggcttctcttggagaaaaagatgaaggtgttgggttagagtattcctagagtccctttcagtttgttgtgataccatggtggggagcacaagctttggagtggggctgcccaccagcccttcctgggtcagcacttaacgctatgtatcatggagcagttctttcaacatggaaagccaccgtttacttaccctaatatatgggttaagagcttgtagtttggagttggacaatttgggctcagaatcccagctctgctgcaggtctgctgtgtgacctcaggcaagttacttaacctttctgtgcttttttcctcttcataaaatgtgaatgatactaagagtacctacctcaaagtgtaggagcacagtgaatgcagctgtcattctgctggtgacagttgtttcaccactatacagacatctcctttcagtttggtagattcttgatgattatctgccgggctctgctttccaaatacactctctgttgaattttaacttttaacggatgctctccactgcattttatctgtaaaacaaccctgcaaggtgaggatgaccaaccttgttttatggataaggaacctgaaaccccaaagttgctttcaaagctacacagccaggacttaaccccaggtccacttcccacaagaccaaggtctttccaccatgccacactattcagaagattagactgggtctgggcacggtggctcacgcctgtaatcccagcactttgggaggctgaggtgggtggattacctgaggtcaggagttcgagatcagcctggccaacatggtgaaaccgcccatctctactaataatacaaaaattagccaggtgtggtcgtgggcgcctgtaatcctggctactcgggaggctgaggcaggagaatcgcctgaacctcggaggtggagtttgcagtgagccgagatcgtgccatttcactctggcctgggtgacaagagtaaaactcttgtctcaaaaaaaaaaaaagaagaagaagaagaagaagaagaagattagactgggacttgggagattaccaaatacaggcagatgggaaagcacagtgagaagtctcccaggctggagtgcagtggcgcaatctcggatcactgcagcctagacctcctgggctgaagcgatcctccagtctcagcctcctgagtggctgggcctacaggtgtgtgccaccatgcctggctaatttttgtagagacaggatttcgccatgttccccaggctggtcttgaaatcctgggctcaagcagtcctcctgccttggcctcccaaagtgctgggattacacgtgtcagccaccacacctggatcctacatgtatattctgactgtccgcccttggccatatgcaagatgccttttgtagtttcatgcaaatgtgggcttagtgataagccagaagttaattgaggaggcagaacaaaggtgggttggacaatttggggctcataagacctgagatagagagccacaggggctctgggaaagggaggaggattctgggaggacacggagtcagcgaagaggaggattgagtttcaacaaacccagagctgaagcttcagactgaagcctagggtagtggatgtgggctttgccaagagataggcccagagggcagctctggggctgaactctagccccccaccgctgtccctcaccctggtgtactcttgagggtctgggtttgtggtttcagtttcttcctctgcaaaagggctgctagtaccccttggtagagttaggggagagggcacgagggagacaggaggccctgggcaagaatccagttgcgctggttgtattgacatgcatggacttgagagttatcctgaaaccctatccctccttatctgtgatttgggaatcacgttctggcctgtgtgggatcattgcaaggccacagtgaaatgatttcttggtgagaccttctctgatctttctatttaaaactgcaaacctccctgtcctcctccctgccttctttttccccgctgtacttaccgccacctggcgttctattgcttttacttacttccttgttgtctgcctgccacactgacagggatttgggctgttatgttcagcacctagaacagcccctggcatattgtggctgctcaataaacagtgttccagcgaatgttggttgaataacatatagggaaagccctaggcatagaaggtgtttagtcaagatcagctggatcttagagacatagggcagacgcctgagaaaggctgggacagctcacttggggtgacgaggtctcccatgaaagcatttggggtctggatttcagggcagtgctggtttcctctctggccacagcctgcaagcagcgagccatataggagaggaaagtttggctgggtgtggggcctcacccgggagtcccagcactttgggaggctgaggcaggaggattgctggagcttaggaggttgagagtctgggcaacatagcgagaccttgtctctactaaaaataaaatcaccagccgaacgtggtgctgtgcgccggtggtcccagctacttggtctcttgctgaggcaagaggatcgtttgagctcgggaggttgaggctgcagtgagctatgatcgtgtcactgcacttcagcctgaatgacagagcaagaccctgtctcaaaaaaaaaagaaaggagagtgaagctggatgggccaaatactggggcttctgaagaagtcaagaccttcaggcagacaggaagctcatgacacttagctttctcgttttctttagctttttaaaccactctgactgctcctgagtggaacaaactctcaaagaaatgatagcctcagcccactccactccaatgactaggagaaaaagcagtagcactgggcccaggcagatctggagacatggcttggccctgcccctgtttagcagagggacctagggcaagtcacttcaccttgctgagtctctactttctcctctgaaatgggtgtagtggtattctccctccgaggccttttgtgtaaaacctactagaaaggtgaattataaccagtcattaccaaactgaagggcctggaaggcagagcttgtacctgcaagtcctgtcacagggctggcacacaatagatgcatggaacctggtggtcaaagggttgtaaacttcaatggacaacaacctgtcagaaagtgaggatctgagtcctgcagggctattagacaagtccagccccaaaactttctgtaattctagaagtttatagattccaagtagaaagtgacttgtaggaagttggactcttacattaccacatacttgaaacttgtcagctttagcttgtttgcaagatttttcctctggcagaaacagctggcagaatatgaatgacctgatttggttgctcacaatctaaagcgctgagaaaaactggctgagctgcagttctgaggtcagactctgtgttccaagtaacagaaaagccaagacgcacaatggggaaattaattggctcatgtagccaggatgttcagaggaaggcttcaggcatggctgcatctaggagcccaagtgatgctatcaaagactcaaggtctctacctttctctagtccatctctgagaggttgcttcctcttcaggctatacaaagtgcccttccccaccacttcacaccctcataacccagcaagcagacagagtcttccagctggagccagtcagggtccacctggagctggaggcgggatcagtcccacccaaaccaggctgaaagggggagggtcacttcccaaggaaacttggtggtattgttaggaaggggaaacagactctgggtggccaaaaatgacagtagatgtccactccactcaccagagggagtgcagtggagagccgtagaaacttctgcattgtaccttttgatttgcaaggttccttccctttttttttttttttttttttttgagacggagtcttgctctgtcacccaggctggagtgcagtggcgcgatcttggctcactacaacctccacctcccaggttcaagcgattctcctgccttagcctcctgagtagctgggattattggcgcccgccaccacgcctggctaattttttgtatttttagtagagacagggtttcactgtgttagccaggatggtcttgatctcctgaccttgtgatctgcccgcctcggcctcccaaaatgctgggattaaaggcgtgagccaccgtgcccggccaggttccttcccttctaagacgctgatactggaggcagaatggagtttattatccctgctctacagccaaggaaacagcccttgaatattcagcgaggactctgacttgtaaccctgggctgcccccactgatctcagcctctctgtgcaaaattataagcccagaggagctgacccaggagggagaggccaacgtgactgaagcccctcactttgtggagcgggcactctgtctagatacaagaggcccccaggaagctgcgatcacgggaaagtacacagggagctgagagagcagcatgacatgaggaccagccacagggcagcagccaggcatggcttcctgcagctctcattgccagaaccaccccccccaccgccatccccctacaccccagcagagtgagctcatgcagccccactgaggcagggctccctgtgcctgggatggctgaggcacgagctctgccattggtgaccgaggttgtcctggcatgtgactgagatgggggtggcacgtacactggacatggagctggacggacctggcctgaatcccagcgctcccacgtggttgctttgtgaccctgaacctccctcctgttctgagccttggtttttcctcctgagccggagctgatcatttgcacttcactggaattcgaagactgggtgaaaagcccccggcgcgtagtagttgctccatagagtttctccctcttcctctttgggtcctgttagtagctatgtgaccttggcccagttccttgacttttctgtacactgggagcaatgagggcgttggtgtgaggaccagatggctttgcgtgtaaagtgcttagagcagtgcccggcacactcgtgatcactgttacttctggctaacacctattgtttaatgcgtaccaggccctgggtctttctctccttgtttattgtctcactgaattcttgttcctccagtgacgtaggctctcaccaggatggtccccatttgacgggtgaggtggtgtgcccaaggtcaatgggggcctgctgagctgcatgcccttgggtgggacctcacctccataggccccagtttcctgtctggggctctcggcgtcagccctgccctactatgtcccaaggtcgccgcggagatcaaacgcaaaagccaccggagccttctgtggccggctggagcgtcctctgggaatgcgaggaacgctgttatctggagcccagctgccctgagcactgtctctgggaacacccgcgtccttcctcctctgatctgagccctctgcgcccgccacccagggattcggcttgtgctggccgctgcccagcaagctacaagttcattgtcccttttcccacagcccggcgcctcctcagcctcctctcacagggcctgcgtggggccatctgcacaatggacacatcctctgctagggggaggggagtggggagagccgggattggccaatgccctgtcttgaggatgagttgaaggaggggattatgggtgggggtggccagggtgcgcccacctggccgggggcagagccaggtcttgaatgccaggtcttgaatctgggatcctcccctccctgccactgcaagccccaagtgagttgcactgcagggctggctacaagataccgtgcaaagatcagaagagacttggaccctagatgtgacattctcttgctgtgtgacctctggcaagtcacctcacctctcctgtaaagttatgattataggaagccctcccactgggaaccgtggtgcagatacaatgaaataacatttgggaacagagtgtagtgagtgtgaatcaaatagcagctgcacgcaatcccttcatctgcaaaagtataatgtgtctgtgtaatgtacatattgcagagagggcaaatggtggtttgtttccagtcttgcctcctgtttgaggagtttatgcttagtcctgggagacagaaacatccccaagtaaggctgaattctggctcgctcacttactggctgtgtgaccttgggcatgctccttaatctctctgtgcttctgttttgtcatctgtaaaatggggataataatagtgcttaccttgaaggttgttgtggggatcaagtgagttaatataggtaaagtgtttagaacaatgcctggcacataataaggtctatgaaaaggtttgttattattaatcttatgaatacgatgacaaaatatgtaaaataggatttttctaaaatagtctcagtttgaaatattttcatcagttgccgcaaatcactaatgtacggaagtccaagacattggcatccaagctgcgccttgaacactgccttgcctttccagtaattgccccccaaatcctcagctggttagtggggagacctatccctgcccctgatgtgctgtgtgacactggggaggttgtgtaccctctctgtgtcttccttttctttttccttttttttttttttttgagatggagtctcactctgtcacccaggctggagtgcagtggcacgatcacagctcattgcaagctccacctcccgagttcacaccattctcctgcctcagcctcccgagtagctgggactacaggtgcccgccacccagcccagctaattttttgtatatttttagtagagacagggtttcaccgtgttagtcaggatggtctcgatctcctgacctcgtgatctgcccacctctgcctcccaaagtgctgggattacaggcttgagccaccgcgcccggcctgtgccttccttttcttgttgtttgtgagagcaaggatgggccggccatgtctcctagtaccagggaggctccccctgcagagggctgagggaagtgctggaggaggtggttggcgaacaccgcagatgtagtgcgtgcgccaccctcccccaccgctttctgtacttggcatctaggcttggcacagagtgaggtggcctggggcagaacatgtcctttccatggcatggcagaaggctgtgtgcctgcaaagcagccatgctccgcccccgacccctgcctgggcactgcaggccccaggcatggtgtctctgggccctgctatctccctcccctgcgatctccctactgcgcctccctgctgcttctctcctgccactagtcctctggcttcagtcctctgcccacagagttggtttggggcatcatgaccgtcctggagcctcagggacccccagagaagctttggcttctctgaacccagaccctcagggtttctgattccagctctgctgtgtggccttgagtaagtgacagtcagagcctcaccctcctcacctgtaaaatggagctggcaatggggcatgtagtgagatgaggcatgcagagggcctgctctccaccaggccgtgcttggggagcagagccctttgtggtgggtccaggctgcccctctgtcctgaatgcaagccgcctgctcgtgcctttctccctgaaccccaaactccacacattcctgcctccttgcctttaaacactcaggtcctgttgggagtgtcctctctctctctctgctcatctcaaccccatcatccttccagcctggtgctcgacccacccccacggacacttctggcccataccctgtcctagactttctctctctccccttcaagatggaaaggaagtgtcaggctacctggcaggttactcctttcttcccaagtgagtgtgtgagggagagagagatctggttctctttggagatgggagccctttgactgtaagaataggacctctgccgcttaagaacaggccctttgaagggaaagtactcagcaggcaggtgagcttctgggttctagagtctcagagctggaaggactgtctgcagccatccaggtgaacaggtctctgggaaatcccaaagcatatggtggcttgatcgagtgggcggggaagggtccatccgttctctgctccagcccctcatctgccccacttgcccatctctgccccgcagtccatccacctcatttgctccccctccccataaccctagctcctgactgacattcactcagcacctaccacatcccagcctccgttttacacccttgtgtgtatgaaggcatccttacaacaacgcagtggcttctattaggtgtggaggggtgaggtcacctgctctgagctgcccagctggtgaggggcagaggcaggatcagaatccaggcagcctggctccagcatccatcttcactgctgctgagctgtctcttcagccacccaccctctgaccccatcatccttccacctagcgacattccctggccacccggcctgtgccggcctctgccagccacggggctgctgccatcagcagagcaggattccagctccctaggagctcaccacggtgagagggtgacaacctatgattctctaaggctctgattaatttcaccaagggcttcatggcactgggtgctgggagcttggggaggagccgaaactgctgtctgggctggggtagggtagggagagggcagggggagggattcattggttggacagcatgggacattctagtctgggaagcacagagtgcagaggtgttgaggctgggagcgctcaggggacagctgggttctcatcaaagccctaaagatgcagtggcttggcaccaggcctctggggtacttccacgtctgtttcctgccaggatggggtgctgtcaatggctagaagtctgagccttactataatccccagcactggcccactgccctctagggaagtccttccttggatctgacctgcagcccactctgaaaccaccacacattcctgcgcaagcacttcatccagctcttcatgacagccataaataacttcctccagtaatgaatacagtcctggccagcaaggcttgccagagatgctgggcttggcggagagaggaattccatgtcccttccctatgactctgcagctgaaatgttactgggctggtcttcagcagggctccctccctaggcagctatgcaggtgccccccagcccctgcctcattcctcatgcccaccagggacacaagggcaactcagcactcctctctagccacagctccttggaagagcccagaaggcccagctgacaggctaggggatgctggctccaagctgactcagttccctatgtgtgcctctggtggggagcagctgagagatgcagggtctgcttatagtggttcctctcaccgggcaaggctttcctcctctttaggcctcagtcttcccatttggacaatgggatgatctctaagacaaagtttcccaaatgaatctgctcagaaaatgacttgttaaaaatatagcttccagccaggcgcagtggctcacgcctgtaatcccggtgctttgggaggccgaggcgggcggatcacgtgaggccaggagttcaagatcagcctggccaacatggtgaaaccctgtctctactaaaaacaaaaattagccgggcatggtggtgggcctgcaatcccagctactagggaggctaaggcatgagaatcgcttgaactctgaaggcggaggttgcagtgagccgagattgcgctactgcactccagcttgggtgacagagcaagactccatccccccaatccccccaccaaaaaaatacagcttccagctgggcacagcggcttatacctgtaatccaagcattttgggaggctgaggcaggaggatcacttgaacccaggagttcgagactagcctgggcagcatagtgagaccccacctctattttaaaaatgtaaacattaaccaaatgtggtaatgtgtgcctgtagtcccagctacttgggaggctgaggcaggaggatcgcttaaggctgcagtgaactatgatcgtgccactgcactccagcctgggcgacagagtaagaccctgtctcaaaacaaaaaataaaaaaacagcttcccaggccctgacctgggagattctgaccgagtaggtctggaataggagaagtaggaatttatttagggggctgttatgtctttctaatctgtccttttaaacttgcatatagtcacatccctccactaaaccctttttttccccaacactccctttattgaaatctcatcagctcctccccaaaaacctcacgatatagacagggtagggacgattagcccctcgacaacttttcacaaatatacacacgtttaactacttctcaggtcatgataaagaccggccgggcagaaacactgtaatcccagctactcgggagcctgaggcatgagaatcacttgaacctgggaggtggaggttgccatgagccgagatcacgccattgcactacagccttggcgacaagagtgaaactccatctgaaaaaaaacaaaacaaaacatttccattgccccaggaagttccttcatgcaccgcctagtcaatcctcctcccaaggtaaccacttgggaataagactttttccataagcacctcaagtgatttttgtggctcggggcatttgggaaatcgcaaaagaccttcccagcctggacagtctggggctgcgtgctctagaccgggggctccctaagggcaaatacctgaccctgtgagtcctgccaggtacaagctggggcataccagctgatgctccctggaggcacatcagtttattaggctgcttggtagagccttggagggtgtccttggagcaggcctgggagctgggtgggcttggatggggaaggcccccggctgagctgaggtggagagagcttggcacaggggtgtccctgggtaggtcccacatggaggcctgtgcagggcctggcccagtacctgccatcgatgtgacctcttcaccatggccaagtggacctccattttctcacctgtaaagggggacagctctgtctcactctcagggttgttaatgaggacacagcaggtcaggtgtgtcacagtcagcacctggtgcaccgtagttcttgaatgggaaaccaatgttagacgccaaaggaaacagtttcggaggtgcagggactgacccagcaacacacacctgggaagtggtggagcttgggcttggatcagatttgctggctgtgtgacagctcacccagtgacttcattgctaggccttggtttcaaaatgtggtgactgagagtggtgctaaggccctaagtttgggtcacactctcacctaagtgagaacctgaccaaaaagggggaattttaaaacaaaattatgagctgggcgtggtagctcacacctgtaatcctagcactttgggaggccgaggcatgtggattgcctgagctcaggagttcaagaatagcctgggcaacatggtgaaaccccgtctctactaaaaaatacaaaaaaatcagctgggcatggtggcatgcgcctgtagtcccagctactcaggaggctgaggcacgagaattgcttgaacctggaaggcggaggttgcagtgagctaagaccgtgccactgcatgccagcctgggcgacaaagtgaaactgtctcaaaacaaaaacaaaattatgagaggctgttgttttggactaaatgcatacactaggccccaagagaccagacgaaacctaaatagagtcacttgtgctaaatgtgatatcatcaaactaaaactttaaaaagaacacataaatgctaaaaccaggttttgttttgtttttttttcttgtaaacaggacattccaacattaaaaaaaataccctctaacccttaaaaaaaataacctaaagtctttattcccaccttacaaaacccactgtcctactgtttcccagtgggtttcgagaccaaataagtacatttacaatggtgatagtgacatcagtgactcgttttggtcaatgtctcaaaatttaaaaaataactaaaagaagggaattattaaatcaaatctagcctaatgctgccttcttacatattttaagttcagcctagcagtttctctacattgtaaactataagaaatagaggtgtaaacagactatagcctacacttgtgccaatcaccaagttttgggggtttttttgtttttgtttttgtttttgtttttttttaagacagagtctcactctgtcgcccaggctggagtacagcattgtaatctcagctcactacaacctccgccacccgggttcaagcgattctcctgcctcagccacccaagtagctaggattacaggcgcctgccaccatgcccagctaatttttgtatttttagtagagacagggtttcatcatgttggccaggccggtctcgaactcctgacctcaggtgatccaccctcctcagcctcccaaagtgctgggattacaggagtgagccaccatgcccagccaccaattaccaagttttagccaatcaaatgtcgccaactgttcaaaccgtgttcaaatgacaagtgctaagctgtaaccaatctgactgcacctcactttccttttctgttcataaatcttcttctactaagtggctgcgctggttcctactccggctcaggaggctgcctaatttgcagatcgttcattgctcaattaaactcttttaaatttatttttttatattttattttattttattttgagacagagtctcgctctgttgccaggctggagtacagtggcacgatctcagctcactgcaacctctaactctctagttcaagcgattatcctgcctcagcctcccgagtagctgggattataggcacacaccaccatgcccagctaatttttgtatttttagtagacacggggtttcatcatgttggccaggatggtctcgatttcctgacctcgtgatccacccacctcagcctcccaaagtgctgggattgcaggcaattcttttaaatttaattcagctgaagtttttcttttatcaatagggctaataatccccaccctgccagtatcactaggatgttgtgaggatctgacgcaatttgagttacgggaatgttgagaaagaaaagggcgtaatggagtaacgagattagttttcctgttatggtgaggtcagtggcctttctggggtcaagaagaggggactttccttggcaccaagagggtaaaagtgtctcctcctgaccttgggtattttggaccatgggatctgaggtgtaccaggagacaggaagtgtgatcagaaaaggcctggtctaatggtgcacagctgtgcatatccaagtggcttgacctctctgggccgtttctgaatctgtgagatgggaatcataaccactctcctgacttcacaggatgttttaggagagattggatctgggttggggagacaattttggaagcagaaaaggcccctccgtgctggcaacagctcgtccacctccagcctgtgtgtgctgcctcctgggtgactgctggctttaggccagcgcctggcagggcttcactaaagcctccgtaggctgctgctatctcagttctgaggtacgggccgtggagacccccagatttgggcttaaatcccaactccaccattgcacctctgagcctctgtttctctgcaaatggggatactagtccctagcccagatggggcctggtacacagttggtgctcaataagagcagttcgtcttcttctgagcatgggtgcatccctctggctggggtaagcaccaactcagatttctaggcccatagatgggctggaacagctgctgctgttaggggaaaacctactgtgttactagccaaggggttcccttccatgtttttgccccacagggcacctggcacaatgtctagcatacagtaggtgctttgtccacactggctggtcagttacctccaagctgacagaaactctgtcccgttcccgactgtttccatagaacctagcacagagatactcagcaggtgctctgtaggtgtttgggagtgaggaatgaatgaacaaagttgaatgaacaagcatcgggccctcccccggggctcaaatgggagagaggagcttcgtagcctgctccccctcccaccccagcaccccgtttcatcccttctgactaatccacaaagattaacccagggataaagcgggtcacggccactgacccagggctttggagctagtgtgaccgagtgtgtgcagggcgtggtggctgctcccaggggccctctttgccccaagatggccctcctgtcccccatcctggatgtggtcctcacggtggccctcagcctcctcctcctggggctgatcctgggcctcctttgtttcttcacttgccgcctggccaggccgctcaggtaggggaactcagctggcctgactccccctgcatcccgccaaattccctgccctaagctcgttcagcttccatttgttctcgtgagatggagcaagcggggcactcatttctcttactcttcatggtggggaaaccaaggcccggagaggttgagccctggcgtcagcctgggcttaaatggcgcatagtcgaagactagccaaaccctctgttgggtttcctaagctacaaaacgggggctcttcatccatattgtgagatcagggatgtaaacagcatggggctgagtggaacatgagggcctaagaaatggtagtgacacgtttgtcccattcttctatcatttgccccagatcttctgagacccagcccaaggctggctttttgccccactccaggatgctcccgggccctctgcctgggttgctgaatcagtcctcagagctaaggcctgcctggctcctcagccccctgcactgaactgccaagtagctgctcctctggcgccacagcctagccggggcttctgcactggccatgcgtaatcaggctacggaggagccgggagcctggcagagaagggagggagggggtggcgatggggctgacacacacccggaggccccattttaagctggcagacattggcagagggtggtgggcagccggggcccccacagccccaaactgggcccctccgcttccagggctgccacagagcagccaggagcctctgcgagggggaggggtcctaggggtggggccagcagggaggctctgggttctgaaggctttcccaggtccccaccctctccttgtcctgagcggaggctatgggagaaggcacctgcctccaggccaagcctatctcaatgcctatccctggggccaaaattcagagcatcccagcctgaactggtggcacttatggaactgctaccatgtgcaagggctcgggatgcagagatgggtaagatgttggtctttacgttcacagagcttcaggctagcagggaggagagacagaccaataaccggaagaataatcatgtggggctggatgagcctttcagtgctcccgggtcactacacttttatttttctttattcgctcacctgttttggaccctcagtgcagagagagtgggatacgttatctcacttagcacatgacatacccaaataagctctcagttcttgttttgtttattcattttttcctttgtccctgctccctgcctccccactgccattcccacagctcaccgaagtccctatgctaatgtacttaatatggccttggagttgtaagtgtccttgtacgttacacagcattctgtccgtgggggtggtttgcacttacatacactgcgtttgattctttacattcatcactcagtcctctgcctttagaccccaccacgctgctgtttggacatctagttttaataccactgccacgcagacattgcctccaccactccttactaattcatttccctagttgtggacgagactgccccggctcctcaccatcataagccagtgttaaaaggagtttgccaaagctttctccagcgagtatgatggtttctgcaggttcttggcataaagcctttatcagattaaggaaattcttttcaatacctggtttgctgagggcttctgtcacatcgttttctgtgaccccattccctctccctaggtgagcacgtcaagtttgatcagggtgttaactgccacccctgtgcctatgattcccaaatttatactctaacccagacttctttttcaaatgccagagccaaatattcagctgcctccttagtgtctccacttctaaaagacatctccaactcaacatatccaaaaacaagttcctgattgtctccacctcacgcctcaaaagaccaccccaaacgccgaaaggctgaatgcttttttctttttcttttttttttttttctgagatggagtctcactctgttgcccaggctggactgcagtgatgcgatctcagctcactgcaaactctgcttcctgggttcaagtgattctcctgcctcagcctctcaggtagctgggactacaggtgcacaccaccatgcccagctaatttttgtagagagagtttcaccatgttggccaggctggtctcaaacacctgaccttaagggatccacccgcctcagcctctcaaagtgctgggattacaggtgtgagccatcgcacttggctcggtagtatatggctcagaaacattgccatttacaatagttccccaaaaagcaaaattcttaggtataaatctggattcagagtccagaatgctaaccattacacgatggaacccgtaggtataaatctaagaaaacatatccaagatctacaggctgaagactacagagtgctgataaaaccgaagaactctgactgaatgagtggagagacgtggtgtcttcatgactgggcaactccatgtggtatagacgtaaaccctcccacattgatctgtggatttaataccatacctatcaaaaacacagtggtggaggacagatcagggatcgccaggtttagggatggggggattgtgtaactataaagaacgcaagagagatttttggggtggcagagctgttctgggtcctgacggtggcggtggtggttacataaatctatccatgtgtcaaacgtcagaacactcattttacacttgggggcaacagaaatccctccctctggagggggtgactgatggtaacctgattgctaattctggaatcaggagccctgtggtcaggtttctgctctgcaacttcctgttggtaaccttgggcaagtctccgtccagagccttggttttctcatctgtaaaaggagatgataggtccttttctgtccactgcatagctgattagtgaaacatcatggtgaaattctttatgaactatggagtgcagcacatagacttgctttcattttgtcagtatcctttatagattgttcatgtaagctcccaaagagtagtatttattttattgaaataaaatgcacgtagagaaaaatgtgtgtatcatacattgacagctgaacccaccgtgtaaccagcacccacccacccagatcaatcataaaccgaaccgcaccagcaccccagcagcccgttcccgtttccgtaccctccacgtggagcctccgttctgtctcccaacgccctgggttagtttttatactttctgtcatcggaatcacactgtaagtgctcttgggtttagcttcctttgctcaagcttaccttgtgcgattcattcatgttgttgtgaggagctgtggatcatccattctccttgctgtctgtggtggtttctgtgttgtgaacacacacaatgtattatccagcctgccgtagatggaggcagttttgaagccattataaacagggctgatgtgcacattctgctggagagaaacgggtcccagggtacaggtaggatgatcagcttcggtagatcctgccggttttcccatgcgctgtgcctgtctgcactccaccaacggcgagcggaccttccggtagttaaacatcttcacgaactcttggactttcctgcacacacagagaagataattttggatggctcttcccttccccccacaaccttccttagggcactggctttcaactgatgtaaatatttactatgccaagcactaggagggcagagacaaacaagacaaagtcctcacacttagaaactcccggtgtggcagctgagatggcccaggaaagaactatattaccttcaaaaagagaggtacatgcgatgtttgaggtggcatgaagctcagtggtgttatattggaatgagtgagtgaccatcctggagccttcctgaaagaggtgacttcatttttaagtgattttaaataatagtttaatgaattagtatttcgtattcagttaataacatttttctgattttaggatttgctatagaaatatttggaaaccgtaaagtagaacaaaaaaaaaaatgtaggaatcatctgaaattccaaattctaccactcacagttaagtgttgttagatgttagatgtgggatattgccttttaatttccactctgcgccgctacccccagcccctaccccagagccgtcacttctggcactggagcgcagcttgcgtggttttttttttttttttttttttttttgagacagagtctcgctgtcgcccaggctggagtgcagtggcgcgatctcggctcactgcaagctccgcctcccgggttcacgccattctcctgcctcagcctcctgagtagctgggactacaggcgcccgctacctctcccggctaattttttgtatttttagtagagacggggtttcactgtgttagccaggatggtctcgatctcctgacttcgtgatccgcccgcctcggcctcccaaagtgctgggattacaggcgtgagccaccgcgcccggccatttgcgtgtttttaaggttgaatcaagatccttcttctggtggtagtggtttctttttctcccttcccttcccttccctttcctccccttccctttcctccctcccctcccctcccctccctccttccttttctccttttctttttctctatttttaaattaaaaaaaaaaatcttggatgggcgcggcagctcacacctgtaatcccagcactttgggaggccaaggtgggcagatcacctgaggtcgggagttcgagaccagcctgaccaacatggaccccatctctactaaaaatacaaaattggccgggcatggtggcgcaagcctgtaatcccagccactcgggaggctgaggcaggaaaattgcttgaacccggggggcggaggttgcagtgagccgaggttgtgccattgcactccagcctgggcaacaagaacaaaactccgtctcaaaaaaaaaaaaaagaaaaagaaaaaatctttttcctttgagctggagctgcaaagagaagaatttttaaaaagaaaagaaacttttaaaaaattaaaatacaaaaatttttcttagagacagggtctcgctgtgttgcccaggctggtctccaactccaggcctgaagcgaacttcctccagcctcagcttcccaagtagctgggattacaggcatgttaccaccatgcctggctttttttctttaaacaacttttaaaaaatgttttattttgtttttacttaacatataataattggactagagtggtgtcttatctgtcacaacacttttctaacggtagagtgtgtattactgctgtttcccacaacaaatggtgtcatatcttggttttggctgaagcaataacatttcccagtgaaactcttgccacttaaaattctttgtcttgtaactcatgtgcaacagggttagtacatttctcagctgccagtggggttgttctttgtgatttaacaggaagaccacagtgtaaaaacattcttatgccattaatacatgcttgttttaggctacttggaaaattcaaaaaaataaagaggaaataatcattcatagtcctaccacccagagaaaaccacagttaatgttttggtgtatttccttccagtttttttttccacctaaactcttcaattacatccgactttaaatatatatatattttttaaaaattgtaaagataatactgtatctcagcacaaaagaaaattttggaaatgcagaaaagacaatggaaaagaaaaatcagttgtctgtgatgtcaccacccagaaatggccacacttaccagccagttttttcacatatgtgactcctaccatttttatatctcttaccataaacgacaagctctagaagagaatgtagcaaatgtaggggtcctgaaagaaggggtgcactctgttttgtccctgatgttcctgggacacaggtaattaaaaggctgaagaccgagtgctgtagaacagggcttctcaaggtgtggtccgcaaagcagcaaagcagcagcttctcctgggagcttattagaaatacaatcggagcctcaccagtgggccgggaatctgttgtaacaagcccttgggggattcagatgcttgctctccttacagtttgagaaacactgcaccaaaagattggactctgggaggtagggggcttcagatgaattgaaagtggaaattcacttaggaaatgggacggaactgctttgcagcatggaactcattgacactgacacagctgtttgtgtggttaagcttcctgagacagggaccagctgggtttggcatcccaatgttgagccccatgcctggtctgtaataggtgctcaccgaatacttgttgaatgaatcaaggaatgaataagtgagtgaaaaaggatctctagagctgtgccccacatgcctctttttctctttttttaatttctaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccaggtatgcttggggacacaggtggaggcataaaaaggtggtgcagatggggtatgatgagggcagtgtctatgttttaaggtcccagaaccatccaaagtatttaagagctgaaaacagtgttcagagcaggaaacctcagccctgctacttgcatgtgttagttggataggtcactcttttcccatatatatatatatacacacatacacatatatgaaatatatatatacaaggaaaatatatatatacaaggaaatatatattttccacatatatatttttccatatatatatttcatatatatatttttccatatatatatttcatatatattatatatattctttcttaatttttttttttttgagacagggtttcgctctgttgcccaagctagagtgcagtggcgccatcttggctcactgcaagctctgcctcctgggttcacgccattctcctgcctcagcctcccaagtagctgggactacaggtgcccgccaccgcgccaggctaattttttgtatttttagtagagatggggtttcaccgtgttagccaggatggtctcgatctcctgacctcatgatccgcctgcctcggcctcccaaagtgctgggattacaggcgtgagccaccgcgcctggcctgtctgtctgtctgtctgtctgtctgtctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagaccaccaaacaggctttgagtgagcaacaaggctgtttatttcacctgggtgcaggcgggctaagtccaaaaagagagtcagccaagggagatatgggtggggccgttttataagataggggtaggtaaaggaaaaattacagtcaaaggggggttctctggcgggcaggagtgggggtcacaaggtgctcagtgggggagctttttgagccaggatgagccaggagaaggaatttcacaaggtaatgtcgtcagttaaggcaaggaccggccattttcacttcttttgtggtggaatgtcatcagttaaggtaggaacagaccatttaaatttcacttcttttgtgattcttcagttacttcaggccgtctggatgtatatgtgcaggtcacaggggatatgatggcttagcttgggctcagacgcctgacactttctttttgagacagagacagactctcactctgtttgcccaggatggagtgcagtgacgtgatctcagctcactgcaaccttcgccacccaggttcaagtgatcctcctgcctcagcctcctgagtagctgggattacaggcgtgcgccgcaacacccggctaattttttgtattcttattagagacggggtttcatcatgttggccaggctgatctcgaactcctgacctcaagtgatccacccgccttggcctcccaaagtgctgggattacaggtgtgagccactgtgcccagcctttttcttgtcatttgtagttctcactagtgaactcatcttcaacaggagttttttgtttttcttttttttgagacagtgtctctctctgtcgcccaggctggagtgcagtggcgcaatcttggctcactgcaagctccatctcccgggttcacgccattctcctgcctcagcctcccaagtagctgggactacaggtgcccgccaccacgcgcagctaatttttttgtacttttagtagagacggggtttcaccatgttagccaggatggtctcgatctcctgacctcaggtgatccgcctgccttggcctcctaaagtgctgggattacaggcatgagccaccgcacccggccgagttttttgtttttctgttggagattcacgcggaagtgtttccacagcatggcatggtgttttcaggacactaggggttcaactaattctaggccagtttttatgttgatttcttggtttacaattcttatactataaattcagatccccacttagacctggctcagatttgacttgaattcacatttcttatgaatgactgtctttctctatcccttccatagctccaaggcaaaatgtgtaccttaaaacagcttcagcagacctggtgtggtggctttagcaggcctggtatggtggctcacgcctgtaatcccagtgcgttgggaggctgaggtgggaggatcgcttgagtccaggagtttgaggacagcctgggcaacatagtgagacctccatctctagaaacaaacaaacaattagctgggcatagtgctgcatgcttgtagtcctagctacttgggaggctaaggtgggagaatcacttgagcccaggatttcaagattacggtgagctataatcaaaccactccagtctgggtgacagagtaagactctgtctcataaaaagaaaccagcttctggccgggaatggtggctcacgcctgtaatcccagcactttgggaggccgaggtaggtggatcacttgaggtcaggagtttgagaccagcctatccaacatggcaaaaactcctctctactaaaaatacaaaaattagctgggcatggtggcgcactcctgtaatgccagctacttgggaggctgaggcaggagaatcacttgaacccaggaggcggaggttgcagtgagctgagattgcgccactgtacttcagcctgggcaacagagcaagactccatctcaaaaaagaaaagaaaccagcttcagcctgaacctgtacctggcttgccgtcgcaggcgttcctctctgcatcagctcctgtgggcccctctggttttagattccctcatcaatgctgcctcctgaggattttccttcccccttttcttcctttttcaagctatgtgctatttttttttccccagcatttctgtatctggagctggagaagagagccttcctcggctcagtccattatgtggctagaagtccccacttgccttccccacactccagtgtctccatctgtccagtggggatgagttcctcccgcttagggtcatcatgggaatcacatgggatagtcacagtgtctggcaaggagtggatgctcagtgaatgttggtctcttctcttaggacggctgtatttcagcagatgaggagatggggtgcagtggggcactgagcctgagctgctgagctctcaggccattgctgcgtctgagacctcgtggtgccatttgcatccctgggggaccaaggtcactctgggacggggtccctgccttctcagcacttacagcccacctgggtgaaagatgaactaatggatgaaaagggaaaaggtgaaaaagtgacaacatgaaaaatcttcaaacgttcagcagttcaactttttgtatctgctgttgccaggctggagtgcagtggcacaatcatggcttactgtagcctcaaactcctggcctcaagcagtcctcccaccatggcctccaaaagtgctgggattacaggatgagccacttcttcagccttcttttttttcttcaattagatataacttacagaaaagggcaccgatcttaaatacatagcctgaaaaaattttgacatatatttatacccatgtaaccgccacccagatcaagacagaacatttctggttgtgaggcatctgtgggcttccctgtgccaaccccctcccaaagccagaggagatgcccaggcttacattggccaccagagacttgctttgcctgttttgagcctcatataaatggaatcatatagtatgtaccgatcagtgccctttccctggcattctatcgtgagcattagcacatatcatttagtagtctccaaaaacaatagcctcttggaatccagttgtccagagccattgttgcttaaaccagactccaaacccttctcagggacaggccctgggtggctctggtgaaaaagacaaggactctgcccttgtgggactccagtctagagagaacaagcactcaacggagcaggggacccggtggcagaggctgggctgaacaagggcaacaggtgtggggcgggctgatgtcagcccagccctgggacctccaagctgttaagtcaggtacaggttgtagcgggtcagggtgggtagaaggtcttcaccacccagtggcacccaactggccaaagaggctctatgaccaacagcaccgtggtgtgttttgaggaaggcaggagggaggctggaaccagcctgggcctgggggacctctgaggaaaacctctggccccggccttgcccagactttatctcatgtcatcctagaactgcctgtggatagctacgggtgtcccatttcctggggcagaaactcttgtccaaaggcaccctgtcgggcagaagggccaaggtgctcccaattcccagtggggactgcgtggggacatctgaaattgatgccctcagcagacacttccagaagagagagggtggacctggggctgtcgggatgagggtagtgggctgagggattggggtggtggtgacgtaaggggaggcctcttggggaggggcgtggggtgtgcttgggtccaaagctagaggtgcactgcagcaccctggcggctcctcgcctgtgctctgcgcctatgctaggctggggcagagccacggcgacgcgtgagtttccggttctcccacttggggccctaatctcaggctctccatttcctaatgtggaggagacactggtgcccacctgccaaggcagttgagaggaataagagaagctgtgtggggggtccctggcatctcgcccagagccagtgcgtgtgtgaggaaggagggctgttctttacccacggccactccgagagccaggcacgcgtcggagctgggccaaaagatgagaattgtgtccccagcccacgaacatgctacacggccttggacaagaccctcccattcctgatctctcctcccgttctgtgcagtgggaggccttgaaagaggaaaccgctagggagcctcctctctaggcttctgagcagatctgatagggccctgggacagaggggagccccgcagactctgggagggactccagctcccatagccagggtcctggtccagccctggagacgggataatggggatgggaggcaacttttgagcctctcctgtgggtcaggtgtgtcacttgccttatccggcccagtccttagagcgaccctgaggggatgatgccagcaatgtcatttaacaggggaagagactgaggctgagggaggtgacagagctagtacttggagcagctgggggttttttgtttgtttgtttttgagacggagtctagctctgtcacccaggctggagtgcagtggtatgatctcagctcactgcaacctccgcctcccgggttcaagcagttctcctgcctcagcctcctgagtagctgggactacaggtgcacactgccacgcccagctaatttttcatatttcagtagagacgggatatcaccgtgttgcccaagttggtcgcgaactcctgagctcaggtgatctgcctgcctcggccttccaaagtgctgggattacaggcatgagccaccatgcccagcagctggggttttaattgaggtctgtctggcactaaagctgtggattggttgctggacacacacacacatgagaaagagggagagagaaagaagtgttcttagttctcattttatctcaaaaccataaagccccagccagaagtcactatcagccaagagggatggagggggcgatgagagatgcagaatgtcgtccttgataactaatcctaacaagagtgagatcacctggctcctttaaatttgacatattaagcaaaaggcaagcttcgctttccagcactgctattaaaccaagtcaggttcctgctgagcctactttaatgaataagctaagcagagttgataattgatggctggctatatcaggggaccccttctgctggaaggagtttgttgaataggttaaacattactctcttaattgtgctagcacaattcatttgctgccttagcagctcatctccctactgggtagaaggaatgagcatgggctttggagcgaaacccagccctgccagtgtctgcctgtgctgtgtggccttaggcaagttgctcgttgtctctgagccttggtttcttcattctgagatgtgaggagaagaccccagggtccacaggcttttctggaggatctggatggcacatatttataaaccacagatgtgttgtctgggtgggcaactattgcacccacctccaagttcaggcattccagcctgagcaatcagaagtggggggatctgtacgtctggagataggaggctatccttaccccgccaagtaactgcctctctctgtgtttagagaaagagaaagaccccaagtactggcgagaccaagcgcaagagacactgaaatatgccctggagcttcagaagctcaacaccaacgtggctaagaatgtcatcatgttcctgggagatggtgaggcccaggggcctgtgggaggggtggaacaggacacctagctaggagccccgggagccaggctgagttgaagggggctgtgttgaaggggctagggctctggaggaagggtgtttaaaaggatgaggggccaggctgtggattcaagaggcctgctctgccagacagccccctgaggatctgggggtgaagggagagaggggctgctcactgacatttacagagccatgcccagtgccaactgcccgagcctgccttggtaccgaactagagagcttctgggtacccaagcaggctgattggagaggcaggagcacgagagactgaggcccccactccccactgcagggatgggtgtctccacagtgacggctgcccgcatcctcaagggtcagctccaccacaaccctggggaggagaccaggctggagatggacaagttccccttcgtggccctctccaaggtgagccccatccccaagcccagttcaggtctgtatatccagtatccaggtcgagcatctgaacatgacagcagccagaggtcccctgaccccctgagccccctccatgcccaagcccactccccacctggagcagccactgccctgacttctgacaccatagcatcactgtacctgcttgcgggtgtgtgtttagagagagggtcttgctctgttgcccaggctgcagtgcagtggtgcagtcatagctcactgcagcctccaactcctgggctcaagccatcctcccacgttagcctcccgagtagctgggactacaggtgtgtaccaccacatatggataattagagacccccccaaggtctctaattcttgggcttaagcgatcctacagccttggcctcccagtcttgggattacaggcgtgagccaccatgcacggcctatatatgccttttttttttttttttttttgagacagtcttactctgtcttccaggctggagtacagtagcatgacatcagctcactgcaacctctgcctcccgagttcaagtgattcttctgcctcagcctcccaagtagctgggattacaggcatgcgccaccatgcccagctaatttttttatttttagtagagacaaggtttcaccctgttggccaggctggtctcgaactcctgaccccaggtgatctgcccaccttggcctcccaaagtgctaggattacaggcatgagccaccgtgcctggcctgtatacacttttgcatgaagttccagttcattcattctttcccgaggcagttcgtgaagttaattagactataggcatacctcagctatacttcgggtttggttccaggccactgtaataaagcaaatattgcaatgaagcaagtcacacattttttggtttcccagtgcatataaaagttatgtttgcaccctacagtagtcttttaagtgtgggatagcattatgtctaaaaaaatgtatataccttaatttaaaaatatgctattgctaaaaaacgctaatgaagtgagctcatgtttttggaaaaaatgatgctgatagacttgcttgacacagggttgccacagatcttcaatttgtaacaaacacagtgtctgtggagtacactaaaatgaggtgtgcctgtactgacctaggttgttcaaggcagtgtgcactgccgggtagctattgctattggtggtggtgatagtggtgttatgtaataacctccagaccctgggtcaggccccaggctcacttctgggggagtagtggggactatggtgccttctgtgccttcaaggtgctctcaggctggtggggaagggagacaggcaaatagttttggggtctctgctaaacatccggatgtagggcaaccctgtgatggtggccgcagggcaggtggcagagaagtcagcgctggtcttggccccacccttcccttccccagtccccttccccctcactttcactaccctatccccagaccccccactccttcaagaaggcccctccctctcccttctccaggactcccctgctccccaaccccttgctggctcctgcagccccaggcccggagagaggcctccgctgaccccacctgagccccaatcttccgccggacacttctctgtactttggagagctaaggtcctgccccagtgctgccagggtgcagggaatgatggcaggaagcaggcagctaggtagtcctgtggctctggggggcttcagtgggcagtgggcctggtcaaggctatggggtcctctctggtccctcacgccccagtccccatggtgtgagtgtaggcggggtgggtgccactggggcgaaggcctggccatctcctgaccctcctctcccacctgcagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctggtgagtcgggggagcagtggggagcagggccagcttcgtggcctgtccaggcctcagtctttctgactgtgtcatgggaaggggctagaaaaggcttctctgtggggctcccagctctgatatgctgggagtctgtaatatccatgggattccttccgtgacaggggaagctgagggtttggggttcactcagtggtgggttctggtcccagttcatttctctgagtcgattcttcatttgactataaaacgggtgggaacgtagccccctcatagggttggtgtgaggagggagaagtcagcccagggctagcctgtggggtgcagtccatggccacgccccttccctcctcagaattgggaggcccagcctgtgcccccagaagctttagtcaggggccaaggccaaaacacaggtgacaaggccaacatacaggtgacagagccacagtccacttgagatccctcaggggtcctgtgggcgccttgatgaaggggaggactccagcccaggtgctcacatctcaagggccttcggggtgaggggagagggttccagaggcagtgttctggctgctcggctacttggaagccactgccagacacctgctgctgtggatggggagactgagacccgggcaatcctcagaactgaagcgggggcctgtctttagcggggagggggaagggagggaggaggcctctgggacaccccgatctgtggataaagccaaacccgcccctcctgcaccccagggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgagtgctcgggggcagccgggcagggacggggtgaggcggggcctctggtgggcaggaggcctcaggcccaggctggcccggagaaagcagcctggcctggctccccacacacctgggaggctcccagcccattaggggatttgcggttgggcaggcaggcactgtgggatttctctgcggtggggctgcggggtgaaccctcatgtgaccgccaccacaccccaagaaccaggcatccagggatgattccataaattgaaacctggtgctgtgccctcctctgccccccactacacgggaggtggtgatggccaagtgtcgtctgcctgccctgcgtattcacatggtcacagatgggtacatatctgtacactcaaccaccagcatgcccggcaaagagctggtgtgtacagtggttggctagtgccagctctcgtgtttaaacttccgagttccagaccttgccctgcgtgttgctagctgtgtgaccttgggtcagttacttaacctctctgaggcttccctttcacaactcctttgtgaactgtacctgcctcataagcttatgccaagaactgattaagataatccctgtggagctcagcacaggacccgaggcctagcgagtgcccagaaggtggtggcacttacgcaggagccacatgtccttgccctgaaacacacttcaacaaactgagctgactcatggagacagaagtcatccatgtgacgcttactctctgttcttaagtgagaatgcccggctcgttccttttcaggcttttattgcctactgtgggggactgctgaggcgatctggggacttctgccccttgagcctggaatggggattcggtgaggggcagagaaagcccccctgcccagctacacctcacctctttctctccaccaccagacaaactcacctgccttcagccctccatgcactgccccccacaaatttctgggggctacttggcccctccacagtagagacccacgtctgcccttttcccagcatggtggattaagtacccgctttcaggacacacagtgctgttggcccctttcactgaacagacatctgaggccaagccactcatcctggcttgccttcacccgacatgtggcctggggcgagttccttcccctccctatgcctcagtttccccacctgtgcagcagaaacagagagccacacttgcttgctcccagggccgtgggaggccgtgatgaggtcatggatgtgagaacatttgttgtacaggcacagggtataattacatggggactgctcctcagaggggtttgtcagggacagcctgagcaggggacaggaacttgaaggaaattcgaggggagggaagatgtttcaggtgagggggtgggagatgaggagggggggccgcaggggccacgtcaaggggcacaagccagggagtgagtgaggacggaggacctgtgtgaggatccctttctttcctcctcttcctttctctcccagccccacctgcctctccgtcaccacccccccaaaagcctcccagtccccagactgtacatgaaacaaaaatcctggtgtccaccctgaaaataaatactgttgcttaaaaaaaaaaaagaaagaagagaaagaaagaaagaaagacacaaacctaaaccccaaagccaaacagcaagtctgttatttgggagtttaatgagcccgtgtgaagtcgctgccgggctggaaacgatgaggctccctgcaggaagattgggggcttcgttttccactctgaagatgccaagaggtcaggttctgtgggaacagttgtggggggcggggcaagggacccgtgacctggggtccccttctccttcttctcccagcccaccctgccccctgagctcctggctgcagctgagagcaaggactctgcctctctgaaccacttgtttccccactccttctggcaatagaaatgccttccagtggcagccaccccctgggtgctggggacttccctgggtgactgcctttcctcctgtgatgggtctgtggatggatgttagttgcattttatttattattattattttgagacggagtctcattctgtctctaaggctggagtgtagtggtgcgatcttggctcactgcagccttcacctcccgggttcaagcgattgtcctgcctcagcctcctgagtagctgggattataggcgcacatcaccacgcccggctaattttttttttttaaatttttagtagagacggggtttcgccatgttggccaggctggtctcaaactctggacctcaggtgatccgcccgttttggcctcccaaagtgctggcattataggcgtgagccatcgcgcccggcctattttattttatttttgagacagggtctcactctgttgcccaggctggagtgcagtggcgtgatcatggctcacttcagtctcagcctcctgggctcaagtgctcctcctggctcagtcccttgaatagctaggagcacaagcctgtaccaccatgcccggctaagtttcgaaacaaattttatttgtatagacagggtcttgccatgttgtccaggctggtctcaaactcctggcatcaagtgatcctcccgcctcagcctcccaaagtgctgggattacaggcatgagccaccgcgcctggccagtcgcattttatggataggaaaactgggctcacagagtttaggtggcaggcccttggtcagtagtcgatagagtcagggttcaaacccaagtctgacttcaaagctcacggccatgaccatggcctggacccaggctggtcctggggcacctttcccacctctccagccatcctgtgttcctggccccctgtgcattccacaaaacctaggatctaaggtgggagacagagtggaggatagagcaagggacctatgagatgcaggcctggaatggtggatctggggccagtgtcagccaggctctgcactcccaaggtgtcagccaggggcagtggcccgggctggcacccgcggtgacaagagaacactagtgtggtggtcaccgcaggcggctgctgttatgctcttggccctactttaaaaatagtcagaacttcaaacatggactcccaaggaaaacaaacagtcccgcgtccgtctgcccgcacacaccagctggtgggtaaaattagcctggtggtgactacagagccgtgaggcccggccccgctgtttgcccaggctgcggtgggctggctcccagctgtgggctgccccaaagacctccctggctggagcctctccctgcacgcattcagccttccaccgtgggagaggaggctctgggagtccctgcccttagctgcacgaatacagcagggccctagtgccacagccggaaaagccctgggtttgaatcctgatgctgccacttcctggctctgtggccttcgggggaaaaaaccaatttctgtgcccatttttttagttggaaaacaggtggccagggtttattgcagccttggtatgaagttgagtcagaatgtatcttaaatgcttagtgcctgacacacagggaacgctctgtaaatggtctgattcttattcgagtgggagttctgtggattccgggaagccaagtaaggtaagttatcagctcctccaatatccctagaagcgccaaaccaccgtcccaatagactcgtgatttcatctccccacgctggacaagtaaggcccagagatgactgaggcctggctcaccaggctgggaaagtgtccacaccatctccagggactccaggagtccaggttccaagccgaggtcactggggcttctgggcatcttggaaccctgcagaagtgatggctcctgtctcttttaggtgatcatggggggtggccggaaatacatgtaccccaagaataaaactgatgtggagtatgagagtgacgagaaagccaggggcacgaggctggacggcctggacctcgttgacacctggaagagcttcaaaccgagatacaaggtagcctgtgctggggccatgtggctgcagaggtggcctgtgatggggagaggctgtgtgacccctgctctgaagttctgttgtcctctgtagaaagggcatcggaaatctttcctccatgggctcaaatggcctaagagatatacaagcagtagatagtcagtgactaatcatttccttcccttggaggggataccagagagaggcggatggtgaggaggaggctgggccagggaataacctgcgtggacattgagtcaccctgagcacctattgtatgtaggcacctggcggggcatgcgtgaggcacagaggctgagtcagatggccaaggaaacatggaatgctgtgtgcctgcatgggggacgcctggctctgcaggcgccctggggggacagatgacagggaggagccaagaagctctgggcaagtaggaggatggagggaggaggcagcgctggatggatcaggggaggacatggttggccccagtgtgcaagccatggagggagcggagaagccctccacagtgagtcccccttggctgggggatggaatagattggggaagggaggctggaggacggaatagattggggaagggaggctggagggacctctggaaggaccccaagctccagctccttggagtggcctctggccctttaaatctgagctgctggcctgcgggcctggggcagctggggtctggaaatgactgtggtcagggctgaagacagtggggagtagcctggcagccactttgatgtcactctggggttgggtttctgcaagttccaggactggcccctggggaggcctcgtgggatgaggctgggccaagaacgaggtgggggtagggactagggaagggcccccgtggggatggtgggggtgtggaactgagtggctttgaaccctttccatcccttctgagtcagctcaggctgggccagagccccctccaagctcaagccagagagacaccagcctcagtttctctacgtggcacatggggccagagcttcatcctccttgcccaggcagggtgcttacccaggaactcggtctagacctctaagacggggagagagcgtctacaccatggccccgagcctggccacattgggtatcaggtcccgtgtaggccccacatccctagaaaatcatgccttaagagtgggttttagagtcagtttcacctttaccattcagtggctacgtggtctgtgtgcctcggtgccctcatctgtaaagagggaataacaggaacaaccctggagggagagagcacaggagagccacctccaggaagcaggggctgggagggggggtgcggagccccactttctgagcctctctgccctcctccccacaacagcccctgaggcttgcaaagccactgatcccactgtcattgctaagagaaggcagggggtcttctaagggcacacagcagatccttggtagtgctgggacccctggtccaggcccacatggtgccctctccaggcctggcctagctggcttctttctgtggactttattccctggggaaacagccacgcctttatctcccctcccagatggggtccccaaagcagagctggggctttgcttcctccctggccctccacggcctccagaaaacagcccacacctgtcagcactcaaggcccctggagacctgtgcctggctcttctttgccccatgatccctcctccctggaatagccttcctgaccctaggctgttcaattcccacttgtcctccagggacccattagaacatcacctccaccaggaagccctccctggtcctgtgtctgggctcacggcctccctgggctctatcagaattctcatccccttgcattatacattataatgggctattgattcatcatttcttgaggtcagggatggtgggtcctcagggagagatttttaagtgagggaaggaaacaagtaaaggcctcagactctgatagctgctggggtcagtccttccgactctccctagcccccggcatgtgctgacacagcccttcctcctagcactcccacttcatctggaaccgcacggaactcctgacccttgacccccacaatgtggactacctattgggtaagtggagggggtggaggggaggatgcatggctcggagcctggtggccggagctgcgtgtggccagcacctggggacaaggccctagcctgacgcccacttaggggcctctgctcttgggcttcaggacctgggagaggcaaggaagggggttctggttcctggaattaggcctgaaatctgctggctgtgcagggggattagcctcattgggcacaagaagaaactgaagctcagagaggggagtggcccgcggcatgtggcacaagtgacagcggtacggcccaggcaagtttgagccctggctgggaactgggacttaacagctcctgggctatggagcctgggacctggagtcagctctactgtgtgcatggccagggcagaagccagccaagttatctctgcccatcctgacgattgccctcctccccaggcagtggggagcatgtggtgagggcccaggggcagcttcaggtctggtgggatgcagccctgagcaccaccatgcagctatccgggttttcttttccagctgtctgtagtgccaagcaagtggtggcaaaatctcctgcagacatttcccaaggaacacagctccgcgtcctgggtgtcattagaggttatgggctcagagctgtgcacctggtgggtcctccagacacatgcacacagcctcttgcttgcctgggtcacatggcacacacccagtaccacatgggctgtgcatgcacccgtgtatcatgctggttttgctcatggatcttagagccagagtgctgggttcaaatccagctctaccacctctaagctgtgtgaccttgggcaagtgatttctcctctttctgcctcagtttcctcttctataaagtagggataatgatgctcccataaaatggagatagtgatggggctggagacaacccctgggttgtcatgagcatgacatgaacttgtgttgtataagttatctgttgctgtataacaaattatctcaaaacttaggccaggtgcaggccgggtgcagtggctcatgcctgtaatcccagcactttgggaggccgaggtgggcggagcacaaggtcaggagattgagaccatcctggctaacgaggtgaaaccccatctctactaaaaatacaaaaaattagcctggcgtggtggcgggcgcctgtagtcccagctactcaggaggctgaggcaggagaatggtatgaacccgggaggcggaggttacagtgagccaagatcgcaccactgcactccagcctgggtgacagagcaagactccgtctaaaaacaaaaaacaaagaacaaacacgaaaaaacttaggccaggtgcaatggctcgcgcctgtaatcctagcactttgggaggccaaggcaggttgatcacttgagcccaggagtttgagaccagcctgggaaacatagcgagacctcaattctacaaaaattttttaaaaactggccaggtgtggtggcgcacacctttagtcccagctactcaggaggctgaggtaggaggatccacctgagcccaggaggttgaggctgcagtgagttgtgattatgccactgcactccagcctgggtgacagagcaagaccctatcttaaaaaaaagaaagaaagaaaacattagccaggtgtggtggtgccagccactcaggaagctgacgtgggaggcttgcttgagcccaagagtttgaggctgcagtgagctatgatcatgccactgcaccagtttgggcaacagagtgagaccctgtcacaaaacaaaacttaacagtttaaaacaagagtaaacatttattgcctcactcaatttctttgggtcaggaatctggggacagcttagctgggtctcccatgaggtcacagtcatctgaaggcttgactggggctggtgcttccaggatggttcactcacatggctggcgagttggtcttggctgttggcaggaggcctcagttccttggcacattgctctctatagagcagcttgagtgtcctcattacatggtggctggcttcccacagagatccaagagtatataaacagaagctacaacattttatgccccagccttcgaaatcacacaccatcatttcggtggcattctatggcatacaaaggctagtgtgggaggagaccacacaagcgcgtgaattccagggggcaggggttattgggcaccatcttggaggctggcttttgcctgcttccaaagcgctaacagcatgtggcaccaagtgaaccctgtgtgcatgggagctattgttcggctgtgtacccactcacagaggggcagggtgttctggaaggacaccagaattggaaggacaccagaatcagaagcaccagcatgggacacatggaactttgtgccatgggcaaggaatggatcattctccttatgtcacaagtgagaaaacggagcccagtgagcaggagggacaatgattccaaaccttctgctgtttcgctgcacaggccaccgtgcccttcaaatccaacatgtaaatgcacacacactctagcggccccatcgagtccaggctgtgaccctctgccttggggccacagtgctgtgtgctgagccctgcaggctggaggcagactgactgatggatttgaaccccagatctgccacttctcagctgacaatagcaagttatggaacacctctgggcctcagtgctcctcatctgtgaaacgggcatggtgatcccaccgcgccatagtggtgggaatgaaaatgaaaggaattggggctgggtgcggaggctcacgcctgtaatcccaacactttgggaggccgaggtgggcggatgacctgaggtcaggagttcgagaccagcctggctaacatggtgaaaccctgtctctacttaaaatacaacaaaaattagctgggtgtggtgatgcatgtctgtaatcccagctattcaggaggctaaggcaggagaatcacttgaacccgggaggcagaggttgcagggagccgagatcgcaccactgcactccagcctggacaacagagtgagactctgtctcaaaaaaaaaaaagaaaagaaaagaaaaagaaaaaagaaaaaaaaaggaattgggggcctaattctgggcccacaaaaatcacccagataaggatcctcccagccaccatactctaccccaagctggctgtggggagcctgcattccctgagacaccccagcttccttggagtcctcctagccgggtcacagcctctcagcatccacatcctcctggcgtcctcctcaggtctcttcgagccaggggacatgcagtacgagctgaacaggaacaacgtgacggacccgtcactctccgagatggtggtggtggccatccagatcctgcggaagaaccccaaaggcttcttcttgctggtggaaggtagggaccccgggtctgctgagagggggctgctggaaacacggccctggtgtcaggatggagaagtccagctcttaaagggaactgactggtttgggggtgaagggagaggtccctttaggagaataggttgtggaaggagacgggtggcactgtagacactcccagcccagcaagctgctctcctttgggcatggagatgcaagttaggttcagcaatccaggaaggcttcctgggagaggaggcagatttctcccctttggtagtctttcttggggacctggccctgaaggggcaagcagcccctcagcctcactgcccagaaaagcaaatccgcaggccccggctttcccacgctgtgtgctgatgttcccaggctctttcagcgccggccaggggccttgcagacagacctgaattcttggcctggcgctgccatctgctggcggtgtgacctctacctgtgcacttctgttatgtgaagccaaaaatagcatctgtctcctggagagtgattcgcctccattgtgttcagagacataaagtacttggaacggggcccagtaaagaataaaccgtgtttctattattagccttgttatggctacacaatagttaaggcgggaacaataggaagtgtgaggaagtgataaagattccagaaaccttccagtgctaacagcccttgcccaccgcagttcctcatgttgccctgctaacatcggtatgtatacacacacatgcacacacgtgaacatgtttgcacatatgctccccacgcatacacacatgctcagcgcctccgccttccagaggtgagcgtccgccagcccagcttggctgctttcttgccaaaccccggggttcccactcgagcacagcggtcttggcctggccccgaacaggcctctgacgccaaggagccagccagaaaccagcggtggtgagcacgggctcccccgggagcggtttcctttgtgagcaaggccaggatgggccgcccaggctagctgctcccagagccacaacaaagggaggacacgccctgccagcctgccgggccaccgcgaggctcagactggtgggaacagagggctgcctggcgcccaggaccctccaagctgggagtgtccaccaggcagcgccctcctgttagcaagggaagtgttcctttaaggtcacagagccctcggctgctgggccaagcctccagccaggcccctgcactcacccggaggtgggaagcgggggcggaggctgcgagggttcaggcttcggcagggctttgtggaacctgccacaggcactgcccaggcactggggactttcactacctctgggagctccgtgctttctttttagaggggatgatttgaggtagagatgaaaaacggggttaggacgagtcacacctgaattcacatcctggcaaatcccaccgtgggcttccccacactaggcctcagttgctccatctgtaaacaggactgatcatattcctctctgcccagcattgctgttcaggggaaaagagacatgggtgtgtcgtgcctggcacattgtagggattccagcgtgcccccttccctacctcccaaaggcttcagtgcctccttcaagcagctagagacagtgctgggaggggcggtgggaggagtacagcttcccggcctggtgaatttgattacacatctggactttgcagcccccatgcatgtgcctttggcaccggggctgtccctctctggcctccgtcaggttgaatggctgcgtaaaatgcctaggctgtggtgctagctcagagtggtgcccggcgaaggttcctgtccttccctagctaacaaaggttaatccagcagcagtgttgtggggctggggagcagatcttcctcccctcctccctcaccgaggcctttgccttggtgtcccaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtaggtgggccttctttggggtggacactcctggggtctcctgtctacccacctgggagcaggagtgggtgggagagccagcaagcccagagcatggtggggactcaatgacaactgggtggggaggaagagttactggggatggggagaaaatgcagggtgaggcaggggagtgagttgagtggtggtcgggtagacaggcaggtgggtggatggatggccacgttgaccatggctgggcgagaacgtggatagatgaatgagagaggatggctggctggatgatggatggatgatggatggatggatggatggatggatggatggatgatggatggatggatgggtggatggatggatgggtggatggatggatggatgggtggatggatgaatgggagggacatgggtacaatgaaaactggggaatggttagttggaaataataaggtttagaaggtggcttcttggaggcattgcagggcccttcaaagaagatcccaggggttaccaagccaccaaggagcctaatctgggggctggggactgtactcctggggccccagcatgacccctgaacaccccctccctgtgcaggtctggcccccatgctgagtgacacagacaagaagcccttcactgccatcctgtatggcaatgggcctggctacaaggtggtgggcggtgaacgagagaatgtctccatggtggactatggtgagacctccaggacccagggctgggaggggacagggcacccctcggggatgggcttgggaatagggtgtcagcttgtggtcaaggtcaggggtctcagaatgactggggcttgagtcccagtttgattgttgagtcccaggttgtttgattcaaacaacctcagtttgaatcgccttctacaatctagcagctctgagactttgggcatgtgacttcatctttctctgcttcagtttcctctctaaaagggttctacctttgacggttgtctgaatgaccaaatgggtctgatgagcttagcatagtgcctggcacaagtaggtgctcaatattttatactcatttttcttggccctataatattccagtatacgagactttgcagttagttcatcccatcccatatcattcattcgttcttgatactcccagtggttctagggggtctaaagatgcagcaatggtaagagtctccccgtcaactctccctgctaatccaagcagcccaaatgaggttaattttctctgttgggggttgagaatgcagactcctgtgtcagaacaggctcaggttcaaatcccgtggccttaggcaaaatgactttcccacattgagcctccttttcctcttctgtgaaatgggagcattcaagccagcctggaagggagatggaaaagctgcgtgcgcagcgccaggcccctggcaggctctcagcaggtgtttcccctggcccacagctcacaacaactaccaggcgcagtctgctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgcgctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaagaaaccaaagtctgccgcccacctcgctcccctctggaatcttccccaagggccaaacccacttctggcctccagcctttgctccctccccgctgccctttggccaacagggtagatttctcttgggcaggcagagagtacagactgcagacattctcaaagcctcttatttttctagcgaacgtatttctccagacccagaggccctgaagcctccgtggaacattctggatctgaccctcccagtctcatctcctgaccctcccactcccatctccttacctctggaaccccccaggccctacaatgctcatgtccctgtccccaggcccagccctccttcaggggagttgaggtctttctcctcaggacaaggccttgctcactcactcactccaagaccaccagggtcccaggaagccggtgcctgggtggccatcctacccagcgtggcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgaggaca

SEQ ID NO: 1523 - DNA, 69048 bp, Homo sapiens; identical to SEQ ID NO: 1522

SEQ ID NO: 1524 - DNA, 69048 bp, Homo sapiens; identical to SEQ ID NO: 1522

SEQ ID NO: 1525 - DNA, 292430 bp, Homo sapiens
tatgattcatatgctagtttatttatcttattattgagagataatttcatgatgacagttatcaataatcaattacaatatcaagaaattcaaagaacaaaatcttgcagagactatgcttttgtatttggatttaaaaagtatgtgatctcattttcacataccaagctgagaggccatttagactatctctttgctaatttttgcttactgctgtagggaagaagatttccaatgaactttaaatatctcattcatgtctaccattgtcgaaaaagagaaggaaaacgaggaggccaaaagaagcagcaggacagagaaaacgccacatggattcaagagttgagacaactgacagtaaaatatatgctctttggttagcaaagcaaaaagggggaaagtattgcatacatgatagatacacactagcattctaaagcaggagacaagaatgtcaagagtgtattctacccccactgccagatggaagggctattattataaatgaaaggcagcagtagtggatgccaggcacttttgttgtgtgccagattctaaagtccagatgtaagcaggttacccctgagacaggacaggcttcagttcccgcagcagaacagagccaatcacagttttctcagtgtttatgataagctgggctgtagagccttccttcagttccactgtgactagcatcaatgacccactgtgcacagttttagctgcaaacctggaagagaaaaaagagagaccttttatcataagatggggagggtaaaggagatagcatacattcaaataggattaaaataactcttttttgtcaaatgaaataatttgctgcaggctccctattgccaaaaacccaaagccaagcattcttctgaaaaatcaataaactgtccagcccatgctaaccacaagcaggtaattttagtgcacatttaaaacagaacagaaaaaggaagtctattttacttattagtttaaacaatagatgcatgtgaataattctccattacaatatatttgagaaccattcatccacttggtatttaacatttcaccatgcatagggacattttaaataagccattgtatttttatttttaaaacatgttaagaaaaggtacctttctcaaagagcttcaaaatttaactcctcatatctgaaaatgattatgtaataagttagataattttacgtacattataaaattcttactaagtttcaatgaattcactcatgtaacaatattcaaattaaatctctaatgttaatgatgacatgaagcaaaatcacgtgacagctaagtgcaacctcacgcttccctttttctttgttttgaaatgtttaggacattagatctttctttctgtagagtgtaaacaaaaacatttccagaggaaactggaggtctaaagctctaactctaaattccaagacatgaagaacctactgattacacggaactaaaagcaaaactagccttttaagcactgcaattgactgaaaagccgttgcaggcataacgaacttctgtcaatcctgctaattcattctgcatgcacagttgagcctcagggtcatgaaggaagaggacaggaacctcccaagcctcccttttccacatgaagcatgttccacacactttttgggggagggggtttgattgcagggatgactggagaaaaacaaagttgctgcacatgagcttttgaaaacactaacaagtgtagagcaggtctgtgacctgctgtgaccccactttgcagggccaatccccttgcccctttctatatgacacgtgtctgaatctgagccatctgcctcaatttgcgcaacatcttcagccacaatggcacccagttagccctgacaacagctcacaatacataaaaataaaactgccgcgctaacagcacgctgcggactattcaagagcaaaccaactggtcagtgtctcatgtctgacaattagcatgggcctcgcacagagcccacggtgtccacagggatctgtttaattaccatcaacataaaagagggagtttatcaggagacactcagaaaaacttcactcccgacttaattaaaatattagccacttaagcaggaagcagattctctttaaatgaaaagtaatttcttttttgggttttttaaaaaataacatcaagatctcataacacattaatttttttaaaaccaaacaagccatttttggacaaataaaatcatgaactaggttgtccaacaataattagaataatgtatccaaaccaaaacagatatgctaattttactaaatttcaaatattataaacactttgaagttgtgttttaaaatgttagctaatgggctatcaacaaaatatgttagaaaatcttcctaggcatttgcttgtgcactctacaagcatgctgaaaacttgcaaggaatctgacagagcagtattcctactgagagaagcaattgtaagtaaccagtttaggaatataaatcataccaatgtttttaaagaggtttttataaacctcttaacacacacatccatctgcttttcagacgtacacatgagagattatgaactaggtacctcaatttcatctttgagaaacataaagatcaccagccctaaaatgatctctcttttctaaggctcctcacaggtttatgcatttcttttgtctaaatttttcaggctcttctgcttcataggagaatgctgtttctatattcctgtaaaaccacgtcaccaaaggatatgaggtggctctattttcccattcatttatgcaacttttcccacagattcggtcatcacgtgtgtaattcactcaacaaatatttcaacagaggtccctatttctgacagggttataattatgtaaacaatagtcttattagtccctttatttacttaacacttgtgccttgggaccatagagaaggagattatgcctgaataggaacacaaaagcactgttgtttgaatttcagggtggcacagccccaaggcacattttgtctcttttctattaaaaaacttagagttaatgttacaattaatataaagttggcagagacaaatgtcaattttggtgtcagtatgttgacagaaattagaattagtatcttggacatatttttgaaatcctattgccacaaaagtctcagtactataaagaataggggtatgaaagaaaagaggcatctgcttacgctgcaatggaaacacactaagcaaatcatcctagcaacataatctgctagctggtgtaaaagctactgcctttattaactaggtctctatgttctagtggacacaaatggtggaagcaatgttttaaagcggaagactagaagatcagatgttctgacattctcatttcacagttcagaaaggatatatttaattggaacacagcatgatcaaaattggtttgttttggccctcggaaggcaaaaaccactaccccagatttattcatcatttaactcctgcacaggctatgcttcaacatacatgcaaaaaatagttatggaaagagtactaattcataagtaataaatagctagctttgggatgtcagaaacattgattataaagtcagcgtgggtcagatatttacatactaaacttaatggctgacatcagaacctctgtgcttggccttgaactaagatcacactgtgacaaaattttttcaaaaggcatgagaaatttttgatcactataatgatgatagcagctatcatttgttaagcacttactgtgttctggcagtgggttctaagtgcttcactggaattatttcatttaatcctatgaggcaggtcactttatagatgaggcaagcgaggcccagagaagttgaagaacttcctcagggccacacaccaaatttctggttgagcagaaatctgaacccaagcattctgattccaggtcacacaaattatcttcatatatacaaaaatgcacccataataatttgtttttatcagtcaacagataaagtttttcccatttacctaatatacacataatctattattgttccaaaaacattaagaaggaagagtcctctcttcaaaaattgtttacttgattttgtagtaatgcgtaattcaaagcgtgcggacttgattcctcatatattttacatttctgcctttaaagatttaaaacattttaaatatcccctactctcctctccctaaagagacaccagcaatgaaaaatacaaagcctttttgaatggagctgtaacacagggagggactacggggagaccaatcaacctcgaaaagcagtaacaccacaaatgagaacaaataagtgcgatgacagttaaagatgtattgcctgtgtatgacgggctccatgttattaaaaggacaccatctagatatttttcatttcattctatcaccaaccacttgctgtttgtaatcaccaactgagaaggtaaaactgtttggctatatctgtatttcatcttattaaatgtctttgtctattatctccagcaattgacatttaatctttgaagcctataggaattcttaagatttacgaaaaagacagaataagctggttgtcaaagctaaataaaaaaaagtttcattcttcttaaaaagttattttgtcttaactatagtcataattataaaaacagaccaaatagcaacaacaaatttgaaaaaaatctaatatctataatacacagatttattctccatgcacttaaactatactttttaagatttgtaacaaactggctataaatcatacatgttctttgttagaaggaaaagaaatcctataattcaattgttctaacaattaacattaacggtacagcatgaatttaaaagtatttatctgagaggctgcgtcagtctccagggtagtcacaaacataacattttttacacagaatcagatttgctatacttaatgcaacagctctaagacatgctttttcttctcttggatagtcttcctggtttctgatttttctattctgagttcaattttcttgtgctttctgttctactggttaccagaagctgtgacaatgacccactcaggctaaaacttttttttttttgtactctgtacatgaagccttcaattactgcctgctgaagcagacagaatcctattagtaagaaagacgatcacaagatgcagtgccctgccctagctgtataaaaataattagtccaaagttgacaaatgtgtaatgaagtcgcacgatcattatatgtaagaaatactggttggaataagcctcctaaacatcaataccaaagtatagtgatttggagcgctatctgccaaaggatttaaaattataaatctttattaccttgagttattatagtagaacattttaaacaggcagagaatttgtaagttgtaaaaaattctattttgttgactataaaattgcattttaaagttaaaccattacactattgaattaatagtgaaggacaaaaaaagcatttacacgtgatttagttttagagaatttacacaaagcaatgtatttttcccagttatttaaaaaatcacctaacaatattgtagtattttcctctaacgttcaaatgagaaaagttaaaataaaaaataaacaaccaccataatttaggactctctagttcctactctaatcttcagagatggtataaaaaaattattccccacactatcaggccaatgatgcattctctttctttatataggaaagctaaaaaatctaagtgcccttgcttaaagaagacataaaacatcccagttatttcagagcatttctggtttgtctggtgggggtggggtgagatggggttaacaagggaaaactaatagtaaaacaaatacattcttaccccattctctttgattccttacaaaattgtcaaaccagaaggaaaagcatcaagaatacctttctttcatttttacgtgaaacagttacagattcccattagtaaaattgttgcattagaggacattaaatggtgaacttaaataaaacttaaatagagaatgttttaaagtaaaaatcagctgtgcagtttggttacttctgaaatatccaaatatgctttctgtgtgaaaattaactgaggtccgcatttgtttgtcaatgaactgatgctcagggcctgcagagttcaaagcagtcagataaaaatgcagtgctgtcctctagtggacagccaccaacctgagaaagaactgttttgattactaaagaggttctacaaatcttcagtcctgtttgagactcaaaatttgtcatattgtagaaaagacctgagcctgatagttttatacttaaaactatttatacaaaattttgtttctgtttatacaatgaagaaggttgacagtagtatcagggcttatacaattagggcaacaagatgtccaatgttatttgaaaagcaaaaattctttggagaattacaaattctccaaaattacccagaattcaaatcccatatagttaccaacagagaagaaaacaactaacaaacaaaaacagtaactcaaaagttaatcaaactaagaatagagaaagggaaatattagagaccccatcaagaagtgtctttgccatttgtgtttgcaaccctagcaccagcaaaatctgtcacaaaggtctccaaaaaaatactaagtgaaggagctacacattatagatctttttaggataccaaaaataatgtgtaccagtatttcccctattaacaaccttcaaacaggtatgcaataacagtgattaactgggtgagtttaaggcctagatatggaacaagttggccaggcacagtggcgcatgcttgtaatcccaacactttgggaaaccaaagtgggaggactgcttgagcccaggagttcaagaccagcctgggcaacatagggacaccctgtctctacaaaaaaaaaaaaaaaaaaattagctgggcatggtggcatgcacttgtagtcctagctactcaggaggctgagacaagacgattgcctgggcccagttcaaggttgcagtgagctacaactgtgccactgcactctagcctgggcaacagagtgagaccctgtcttaaaagaaaaaaaaaaagaaatgaaacaagttgttctttacctgtacttgaattaaataataagacttttattttaaacctgaaataaactgtctttatgtgtgttgataaattaaaaagttgactacttggttgccaatggatacactgtttcactcacagcaccagactttcctaatagttaaggacctagtgacaacagtaaaccaacatttattcgactaggattgtaattatccacaagttgcatatggtaaaagcttgcaaatttaaaaagtgacaggataaacaaaatccaaattactaattaagatatacgggggggtgggggagggggagaggggaaggaatatcagtagtgaatacaagttaataatgaaagttgctccagaatcttactgaataagctaagaactaaaatagaatcatggcagagacaggatgttctgtcttcaatcaaatatcaccttttctcctcagagggttaatttgcggttcatgaaaaggcaaaatgagtaggtaagtgtgacaactttttcaacaatattattgtatacaaatgtcaggatttctgactatgggtgaaaatgtgagatggctgagactgctgaaagacatacacagttatggtctaagactgttttatagacactgctctaatgtactcccgtaatggacaatacactgtcttgctggagcactctgggatatgtgtaagaaaaattaaaccaaacatctcatctactggcatcccttactgactaatcagtaaaaaataaaacatataaacataggaaaaaatattttgaaatgtgtcatgtggcattacagcttgataattccaggcagcctcaaactgtggacttcggaacatttgccttccaaccacttggagtgctgcctaaaatagagattcctgggctctttctcagatttactgaagctgagtttttggggtgggttccagaaatctgagttttacacaaactcacacatgatttttttgtacagaaaaaccttagcgatttcggagctacatgttttttgttttctgctttttggccactgcacttactcataagtgctgttatcagaggacatgcaatgtaacaaaagcaaggcacctcagtttccacgacattgaacacaaacctccttcctaaacccttcctggatatttcacagagaatcacatgaaagttttcctggccctgaatgaaactgggatccccacagctaacgcctctaatctcctaccttcgaacacatgaggtcttgccctttcacctttgcagtccattcatatactggtttaatgctgtccattttgcccttgggatacactttatttatgtattagtttactagtattgtcttaagtaatatgcattaagaccttcacaatgtatatctcattaaaataaatttgaatatcttacacaggaagtgaagatattcagctacatatttaataaatgctttttgatgatgatggaacttctcatttttgtaatactccttatcatgcgttaactgtaatttggaaaacagcagattgacgcaatgaccataattctgtatctctcttttttttttttttttttttgagatggagtctccctctgttgcccaggatggagtgcagtggaccatcttggctcactgcaacctctccctcctgggttcaagcaattctcctgtctcagcctcccaagtagctgggattacaggcgcctgccaccaagcctggctacttttttttgtatatttagtagagacggggtttcaccatgttggccaggctggtcttgaactcctgacctcaagtgatctgcctgccttggcctcccaaagtgctgggattacgggcatgagccaccatgcccggccactctgtatatctcaataagatgattttgttctccaagagcaggtttttcaagtaagtacgacagaaatgaagataaagttgagtctctcaatagtatactgtttggctctgatcctatcactcatttagaaaattacaactaaaaatcatataatctaacagtagagctgctttctcaattgatctttaaaagtgttaacgaaataaaaaatgtctctggtttttgaagtgtatttcataaaacctgtgcgcctttaattggcttttcttaatgagggccattttctgttgctgtgttaggaatcattttctattaagtgttcaattaaaatctgtactttataccattacatactactccacattaataaaggttcacttttccttagataattcttacactaagtatttctttacctggcatttaatgtaaaaatgtataaaatttgaagagtagtagaaataaagtattccaaaattaggcaatggaaactctattcattaaagggttagaacgaatacactaattcttattaaaagtcctctcagaaagaaaagatcctgaaaaattaaatagaacataagccagccaagagtaacttatcatattgaaaattttaatctcttaaaatactagtagtaaaaatgcttttcatacttggtgtttttaaaaataatcccaaactgattaccattaataaatattagagtggctttggtcctactctttataaactcaaaaacgtaactatcacaaaagaataagggaatcattcaaaatctcatagggatttcaattttatcattagcaattaaataatatataaacttagatatagaaatgtattaattccatggagtagggtaatataatatggaacactatagttaaaaacatttatttcaataaagtggtaaacagttaatttatattattataatgtaaacactaattcctatttcattttaaatgaaattaagaaaagcaaaaaaaaagtacaaaagtacgttttattaacaattgtttatttttgttttaattgctattagcaaaaagaatgagaaaaagtgttacatacacaggataataatttatgtcaatatctgtataaaaaataaaaataactttaggtgtttgttacctggaagctttctaaaatttagaacattattacagtcatactttagctataaaagcaaatatgaaatatttttcaattcagtatgatgggacttgagaagcaagttaagacagcacaggctattcttaagtatctacaggtattttattgacttttgaccctgtagtaacttgggccctcccccaggttacagagccaaacaccaggccactgatgatacggctagaacagaaaagcctcaagacactgtggatgagtatgaggaccacgaacattaagttttgggttcaatctctgcactccaaagtcaaatataaatggttcttagttgtgtgtctcctctgtattagcatggacaattgagaattgattgtaattttaatttaaatcatttgagcaggtattacaggtattacattccaaaccagcaagacaagttactggcaaactatctttaataagaattatacaactgtgctaagggtccctctaagtctatctcccaataggaagatagctttcattttatgtggctttgtaacttcacttttcttctttcttttctctttttttgagacagggtctcactctgtcacccaggctggagtgcaatggtgtgatcacagctcactacagccttgacctccatgggctcaggcgatcctcctacctcagcttcccaagtaactgggactacaggcatgtgccaccatgccggatttaattttatattttttgtagagacagggtctccctatgttgcccagtctggtcttgaactcctgggctcaagagatctacccactttagcctcccaaagtactgggatgacagatgtaagccaccttgcccagccttgacattttttcttctaagaaacaaaaatctagacagctgccattgctttcagaaaagttaacaaaaaaaagaaacccaaaacaacctatacacaaaacaaaactaaactagatgttccagcataaacagtggctactctatattaaaacaagactgcagtattgctggatactaggtgtttcaggtaaaatttcatactgaagaagttatacttgataatacagcattttggtgttttagtaaattcaataattccaaggacccataaataaaacaaaacagtttctgttagagaaaattacctaggaaagtgaaaagaagtatttaaagcagaataaaattaaaacaggaaaactcaaaatatttattttcactgaaaaggcttttgttactcttttccctattgaacaacattaactgataaataagttgtatttttgtggtggtctgtatcatgaccttacatccattttcttattttatcaccatcctatgtgagatagatagagcttgtcaaaaactaagaaatgaaagacaccgggcgcggtggctcatgcctgtaatcccagcactttgggaggccgagacgggtggatcatgaggtcaggagatcgagaccatcctggctaacacagtgaaaccccgtctctactaaaaatacaaaaaattagccgggcgtggtgccgggtgcctgtagtcccagccactcgggaggctgaggcaggagaatggcgtgaacccgggaggcggagcttgcagtgagccgagatcgcgccactgcgctccagcctgggtgacagagtaagactgtctcaacaacaacaaaaaagaaatgaaagcatgagacctcttgagcaacttaaaaaaaaaaaaaacagtacaaggtaaatctatttttcaactagtacatgcagtttttattccgccgtgattagtacagtgaagttaggcaactacggatacagtaatggcaggtcagctcttctgaagtcaaatctaatgttctttcatagctatcacagaatttcatttcaatcctacctcactttttcttcctgccacccatttccaaacacataaggaatgtaaagcacataagaagttataacttccccaagattaccaagcccattagtggcagagttagatctaaaacccaaatcacctgtagcatttttcatatggggcctctcttgctcctgtgttaacttaaaaaaatgttttttaaggtctgcaggccttccctttgatgctaaatttgttttctatgattgataattatataagaaagggcacactaaatatacagtgtgtagatatttttaatggcagaagtatgcctgccatgagatggtttgcaacgaattcccttaagctcacagaggactgtgcaatcaccaaatggataagagataattatttttatctttacattcatttaaagccactggaattcataaaaatacaagagggcaaacattaatcacattttctgctgcctttcaggacaaataacttggatctcatatttcagatgcttggtgatagaaaatattactggtctaagaaacagaagctgtatttacccccatgttggtcatctagcagctctttatttactggaagcagtctcaggggatggctatcaaaaggaaatctgtatgtagtacccaaacgtcctccctttcaattaaaaaagtccaactatactgctttatagaatagttcttcctggacatctactgaatctggtgaaataagataaactctcaaccacctcaaaaagggtaactttataaattaccaagctattataaaatgtgaatatgctctgtatatctttcaggaaagaccatgccagtatgataaggatgctctgagatgggaaagacagccttaatgcaaagcaatcaacaactataccatcagaaaaaaaagggagtgtgtgtatatatatatatgtttaggggttattatttccaaagaaaacaatgaatttaaaattatatatttatacatattcaagtcatcttcacctccacatcgtgtgttagtgaacctacctgtgtatattatcctggccagaagggactgcacctacattggctacatttacaaccttctgaaagatcacagagggagtgaaattctgtggtgcagcaatgattacagcagaagtttcattcattcctgttagcactcctgtaaaagcaaaagaaggctcccttttattaatttctttttgaaaattacatttacagaattttaagctcatggccaaaattttaactttttttcaacaaaagaaacactactttaggatgtaatttacaagataattataaaactaaaacaaaatgcaattgtttcgaagttttttaaaatcctcattgtataggaaaatgtgtaaaaattcagtaaaaaatcacttaaatctaattttaagtatgataggataaaaacttagaatcacacatatgaaatatcaatttcagtctctttaaagtatactcaatctggggtttatgtaaactagtaagcttttacttcttaataatatataaatgtatttgttactattgctatttttttctattcattcaaagatctctcattgccaaatgctgcttgagaacacatcaaagtaattccaggataactagcagcaatacctggtaaatggcctcagtatgacagatcgaagttatctcaacagtgactggaagtcactgaaaatgcacaagtatttaggctatacttagagctaaaagtacttgtctagtgaatggaaagtgttttgctgacaaaaacactaattgaaactcctgaagcaaaaactttgaaaatgaaagaaaaaatgagaatgaaaactcttaaatcccagggacatttcaaataatatttaggagagaaattaagttaagcaaaagcatgaaaaaaaccatacagagttaatgcaagacatgccattaatatccagacctcctgtaaaaatgttcagtgaacaaattcaacaacataccaaacacttggaacaaatactgaaatttagtgcccgggttaaaaaacaaattaattacaacaaatgccatctatttggatcggtgatataagtcatagacatctaatggttatctattagaaccaataactctttgagatatttgatatgtgcacagtagtttacaaaattgatgaaaatagtaaaaatctgatttcatgttttcaaaagactctgcaccgtctggcatatatatttaatttagttatttattgcaaatgaaaactaaaatttaaaagaatccctacgattaacagtatgaaaacactaaagcctaacattgtgaaaagacttttgccgtcagttagaaaatagaactatctagcttctaacaacaagcatttttcactaaccactttcaaactctgggaacactatgttctgtcttagaccgtttaacttcaatattaggcaaaagctttaaaaactatacaaacagtcaaacactgcttttaagtaaagcacagtggctgacataacactgctgagagatgtgtgtactcatttaggatttaaaccttctccattaagctctattgaagagcaactgctgaataaatgaatgcaactatgtttatgttaaaagcctgtttcccgcagcatgtaattaaaggaaatgttgtacaaagccagtacttttgtcaagctcctgtaaatggaaagatggatagcactcagagaagtgaatgcattgcttcatatttaaccttaacactcttgtcattaatggtttgtctaacttgttctataaaagacaaggtactgctccattgaagtaaaattaaaaaaatcaactaaaccatgcttttcagaacagaagattcattatcgtcagctaatgtattggcataaagcaaagtaacatcctatcaaggcacacattcaatctgccttcccacccccctttatttttaactcatgctgttttattgttataggcaatttgtaccactcagcatgacagtgtaaactgaatcaagattaatttacatgcaaaagaacacttaggagagcagcatggtaagcaaatgtattgtctcgattgctgaggtggaaaaagaacctggaaagaaaaaaaggtgctctaattaaggggcatcaaatatgattgcttatggtagttaagggccagaaaatagtaaatgtctgaccatttaaagaattagcatcttgctagctaggaactcataagatagatgcataaatcataataaaattaagtaaacattttaggtttcttaaaccagagatttttctaaatgaaactatatcaggtattctcaaattaacaggaaagaaaaataggcaaaggtttcattaaaagttcctcctaaaaaataatactttaaaacactgtagagcctgttcatatataataaaggtaaaatcactgggaaaatatttaaaaactgtaggctaaataatttgtggctttattagaatctatctaaattttggtgaaggcagtagatagcacttactttaggctaatcagctgtaattaactactaaaaggcaaaccaaataacataaaaaaattcagaaaaatttctaagttttagatttgtaatttaattcacaagaagaaaatgaataaaaattcaaaaaaaattctaagttttacatttgcaatttaattcacaagaagaaaatgaataagaggagttatctcggaacacgtactcttgaaattaaaactgcgtgaagaaaccaaattaaatatttttaagtaaaaaatagatcccatgttattttcttattgaaagcatctcacagctagatcattaactaattctgcaatgcttgaaactcatagcaatgaataaatcatgcttctgatggaggcttatatacataaccgtcaatacgtagaataatctaatctttcatttaccactttgactaccaatcttattatatatatataaaaaagtttagccatgaaaccctaaacacaactgagaaaaagtgatagatcatgttgcatattagaaataaaacttttgttttaaaaaatattaatctaaaatgtaatactctgttagaaccacttttatttaatactgtacacttttcagttacgtatatctttagaatgaaaatagaaccatattccccatgttccttatttataattttttcagttaaatttaattaacacatttaacatacttcttgagttttaaaatgtgtcatatgaaataagatattaattatgtaaatccactttattcaaggtagaaaaatcggttaaagctggtgtaacacacacacacacacacacacacacacaccccttaaatttacttgcattttaccttccagaattttgcattgataaaatctgaggaaacggatttttattctgatttaggcttttccgttagtgagagatttctaggtatcttttgtggaaataagctaagctcttactagagtagtataacaaatacatgtgtaaagttgaggattgagacctctattaccaaacctgctgaaatctataactaaaaagatgctattgaaaagactctttaaacctgtgctaaatttgccagcatcaagttccacatcaaagaatgaattcaggaagacagaaagaatgatacagaaatgccaagagacttgcaaggatttacaaatacttcatataaacaaattttcaaatagctttattcagagtagcctttctgctctattaaacatagcaaacagctgccagatttattcagacaaataatcaacaaccatagaagtaaaatggcagaagaaaaaggaattttggcaacaactccacagaggaccacagctattctccaagtgcacctctctcatgcacttaaggttctgtatggctagtcagcgaaaaatccctcagtcacagcagagcacaaaaaatttgatcgaaatattaagtattctaaccaaaagctgagggagtgaaagggtatataataatctgctgcttcagatatactttagctgcacttttcaaaaaaagaatatccccttaacaataaatgtgccaaagccttattcagtcaccgtgtgccactcaccttggtttgctgagcagatgtaaagcagagaggcaggctttagccagcaaagggtaagaatagcaaatataagaatcaattcaatttgtcaatagaaaaataaaatcacaaagataattttcctctatagcaataatcaactttccaagaaatgcaaatccaaagaaagatttcatcgttcttttttattgcttaaataatgcccagcaaaaatattactattaatttatggacttgtatgagattttctttttgacattgtgaattgcaaaggcttagagtaaaaacagtatcttcagcacaatagcagagtgccaggaagcgtgcccctcttcttaggtgtaggtatttgtgtgtgcctagtacgttctggaagtttgatgggtatgatttactacctcaaaatgaagggatctttgataacaccctccacaggaaaaaatggcttagattcacataaagttgtaaaaactgctgactatagcatttaaatatgccttaattttataaatgttatcgttaattaaacacataaaatcagacagttatctccccttattcacatacgaaaaaaaaccacctcgtttttattagaaggtatgtttgactctgggccaactacagatattaatacttgcattttgctgaaaatattttctttttaagtacttattttaaaaatgtttcagttctaataggttctgacaacacagcatttctttaatatagaattaggtcaaaagaaactagaagtattttaatgccataattaggagtttattttgaaggataaggtagtttaatgtgtgcagggacaaatacattagtaagacataaaaaaacagttctatagtgaaaaaatacagaaacataacaattatagtggtaggacatcggtaaagtccccaattcctggcactttgaataatacaaaacccattagtatatcatcaggttgacaagcaacaactctcagcattgaaaaggtgattaagaattaatgtatcatttaaagacatattaatcaattttcaagtatgccaggaatatagacaaacatctgtttttaaggttgtaagtgcaaagcattaacaaaaattggaagattgtgcactaatatctgttaatggctatgtacctatgaaaatttattttagagactgtacaggaataagcacatattatttggtatgtaaatttctagtaagttgtagacatctctcaccttgctctttcttaaaatctttctctgacatggccacaggtaaaagcagttctccaacaggtggctgaatattaacattgaagcaatcatccttggtactgaagaaaaacaatcaaagctgactaaatgcttcataaataaacattcttaatactaagtagttaaatcaatgcaatgaaagcctatgctagcatatacagtataagacctttttggtttaaacatcacagctaaaaaggtttaaacattttcccaaacaaacaacattacttgcagaaaaatacatctgttatctcaatcaagattttttaaaaaacaaaactacacaggtatagtaaattatcccatttgaaaaagaactttaaaaaattgcagtaattgtatataaccactaccaccaagagaaacacttcatgcagcttatagagaagtaatattttatctctagtttgcatacatcttaaagtatagaagatgaaatgctttagtctgaaacagttaagatatctttttaaaaatattagttttaaatgaagaagaaaatagagtgaccatattgtgtttagataggtgctaataaagtaatatctcatctgcaaacttgctttcctaaaataaaaaaaaagcccttatttgctagcagtgctattcattgacattattgaccaacatggtaaaagttattatttcaaatgacaggatatgaagaatttaagaaagccaaccttgtttgttctaatatcagatagaaaaacaataagtgcatttacctaagtctcatgatattatgatcaataaaaaatactaaaattgtctaaaaaattttttaaagttagatgtttaggggtaggttgatgagtgtatcctaaatgatagtagtgtgtttgatggcaaataagcagaaaatccgactaacagttttttgagaaaaaggcattgatcgtttataatacaagaagtcttagagttaccagtcacaggctcattcagtggcttaaaaaaccctttagaggcccagattcctctagctttccctctgccatccttactatgttggctttcatcctcatggttgccacatggctgctgtatctccaggtacctagtttacattccattgaaggaagggtggtgatgagagagtgttgagtaactatgtcaaccaaatctgttcctttttattacaaaagcaaaagctttcaggaagtcccatagagggacttctaccttcatgttagaactggatcccacagcctgtgagatggtagctagagaaacagggattgtggataagaaatactaaacattaggttaagaaacacttgaatttattcatgtgtgggtacagacaaatgacataatataaaaaaagaacataaaatcgacttttattttatgctattatgtattgtattcttgtaagtggccttatattttttccatatgtggattgttgaaggcaaaccaataaatccaatttatttatcaattcaataaacactgaatacaaccttgatcctatgtagtgtgtgaatatctggggatttaaagccaagtgagattggcccttgaagctcacaagtctagcgggagggaaagaaattacacttataatggaatggcaggcactaccttaggtatgtggaaagcattctgcaggaatgaaggctaagtttacttccaagaggagaaagagggcattctaggcctgtactttgggaatgatgagcagcctaatatgtcaacagaagaggttgggggaacattgcagagtatcatatatagtatgaccattcatcccagtcctcccaggaatagtcccagtttatggctgttgttgtggaatcctgtccagctggtgcctcctttcactctctaaagtgtcctgatatgtgtgataaagcatatggttactttacttatataactaagacaaaggtgtttcagtgtttcttgaagcaatgggaaactactagagatttttggcataggaaggtaaatggtcccatttatgttttagaaactccagtggcagtatgtaaggtggagtaagggagaaatcaaaggcagatacatcagttaggagtctaaattaatagtctaggcaggattttgattttttttaaggatttactgtgtgttttttacttaaataaagcctaaaaaggatcttaagagacagcttctgttatttcaaatttactgatgagaaaactgaaaagaagttgaacaatatgcccaaggtcacacagctagtaactgacagcactgggatttgaacccaggtgtatctaacttcaaagtccacatttattccactataatatacagcttccccagggtgggtagcactgggcaaggggaagatggaatattttatggatattctagaacagaagggacacacctggtgatgaatggagggaagaaacttcacaccttctaatgtgaacaactgggtgaatgacagtgtgctgaaggagtttagggacttaaagaaaaagatttggctttagccacattatattttgagtactgagttacccaggaagagatattcagcagataattggaaatacaaatcaagaatctggagagagactagctgggcatagtgacaggtgcttatagtcctagctacttgggagcgtgagctgggaggattgcttaagcccaggagtttgagactatagtgaactatgatcacgctactgcactccagcctaggtgatagagtgagaccccatcaagaaaagaaaagaaaagaaaagaaaagaaaaaagaaagggaatcaggagagaggacagggcagtatgtaggagtctggaagcagtaagaatggtgtaaatggtgtagggaagagctgaagccttatgagtagataaaaatcatataggaaaagaggataccacaaaaaggataaagcgcaaatctggtgaagacctgtatttaagtaaaaacagaagaaaagcaacttgcagaagagactggaggaagagtggtcaggaaaaaaggcgtgtgccaaatactgcagggaggcagaataagataagggataaaaagaagtataactgttaatcttagcaaggctgttcagattgcaggaagactacacaatgcagtgagttgaagggtgaagggaagattggcaatggaagaaggaacagaaagcagaagcttcctgagaatgaagaagcaaaggaataacacctaaagaaacctgagcatgcttagaggctgaggggaaagagccagtaaagaagaagaaacaaagaaataactggtagagcaaggtcttaggagaggtaaaagaggttgggatgaagagcacaagaatgaggtgagcgggttagctctagaaaggagtaggatacttctttggaaacagccgaaaaggagtgcttaagagagaaaggattgagggtaggctactcgaagaatgagaccaaacctgatggaggggaagacacagtcacattaagagaaacatgtaaacactggtgaaggactagaagaagatgtatgtatacatacatggaatacatatatataaattacaaatgaactcagtatgaaatttaaaatttcagcttcaagtcactgtatacaaagttctccaaagtcagaggcacaagacaatcaactgaggtataggcaaaaaccctattaattatatttattttttctcattccttttaaggttctgtttttctgggagacagggtctcagctctgtcacccaggctggagtgcagtggtgtgatgacagctcattgcagcctcgacctcctgggctcaagtgatgctcctatctcagcctcccaaatagctgggactacaggcacatgccaccatgcctagctaatttaatttttttttttttttttttttgagacagagtctcactctgtcgcccaggctggagtgcagtggtgcaatctcggctcactgcaacctccacctcttgggttcaagcaattctcctgcctcagcctccctagtagccgggattacaggtgcatgccacatgccgggctaatttttgtattttagtagagacgaggtttcaccatgttggccaggctagtctcgaactcctgacctcaagttatctacccgccttggcctcctaaagtgctgggattacaggtgtgagtcactgcgcctggcctttttttttttttttttgtaaagacagagtcttactatgttgcccaggctgatcttgaactcctggcctcaagtgatcctcctgccttggcctcccaaagttgtgggattataggcatgagccactgtgcctggcctctatttttgtatgttttagtaaaaatacatgttagcacagtaagaaatacagacacatacatatatatacacacacatatataattacaaataaacttctacagagtacatactcaaaatatttttactaatagaggtaaacaatttcaaaagttagggaaccactgagttacatcattatttacaacacttttgaattacttgtttattctttttaatagaaactcttcttcccaacactcctgaaggacaccacatactcctcgattaaaagtggcttgacagcaatgatgccaagggagaagggtggggtgttcagagagagaagaggcaggagatctgccttctaaggcatctatgaatgtctagctgcttgcagggggtagggaaagcgatcctgaaatgtccctcctcgcaacaagcaaggcgttagagagcccaactgaaacatatttttcggcctctcttgtagctaagagtgatcaagtgacccagttatgaccaatgaattataaacagaacttcagtagatatttctgagaaagttttgcttttctgacataaacctggcccctttctccatgtcatttctttccttttttctgtctggaatgcagatggaagcctggaggtggagcagccatcttgtgatcacgaagttgaccagcatttgctaacaaaattagcacatgaaacaaaaaggtggaagaccttactgtcctgaagacagtgggaagctactgcaccagctctgaactgccaacccctgcagttcttgttctaggaggataataaatccttatttggtcatgccactgcagttgggtttctgttacacacaaccaaatacaaaatccaatataaccagtacataactcactttgtaagccagtttcatcttgtaagcaaggcgtggcttataatagaactaagatggaacatttcctctttatttgggggaaaatttactttcatttacatgagtgttctaggatgtcctccagtttataagcatctccttttctaccattttgccttctttttgatttatttctctctccatgtagcttttcttttccttttttcttcacaacccctttgattaaacaggggagagacagattatctccatttctacacataactgcctcaacttggatagggaatgtgaaaatgactgatgatagatgtaaatttatcagaattaacagttaccagatcaatgaagcactattattagggtagctttaaatagccgagctacataggaccagatggcataaaagtttaatgtaaggcaagattctacttggtacacatttaactgtagcatatattcttgtagtacatgtaacctcagttcacggattcctttataggatccaaactggtaaagtttgtaggtaagagaaacgggcaagcagcctattctgagactcaagtttctcatctatgaatgagtgacatttaccttgcaggctagttttaactattaaaggaaataaaatgaaataatgcacaggaagtactcaaaacctacatatgtaatagggatatatcattatttcattattcccccacagattatcatttccaatttttctccattataaacaatgcttatacttggctagatctatttccgtacaagcacaaatacttctctaggcttgatacactataagtgaaattgctgaattgaaaagtatgaatattttacagatattgccaatttaagatcccacaaacagcatacaagagtacatgtttttctctaccttcctggtcaataccagacacaaaagttattctaaaactttgcctatctgatgggtaaaatgttttaatttttatttccctaaatattagtgatgttgaacatctttttcaaatgcaagttggccacttgcatttattttcttgtaaattgcctattcttagccttttccttacctttctactggattcccttttcattgattgtgagagctacacgttctggtttttaaacttttttctgccaaataagctgcactgctttctcattatcttgtttatggtgtctactttttctttacttgtagagaagttttaaatttttaatagaagaacctgttagttattttcctttatatctttctgagtactgtgtcttgcttaagacttttgtcctcagagtatgaaaatatttatctatactatatttaaatacttttatagttttttataattaaataataaatccacatggaacttgttttggtataatttgtgggaggaagctaccttgattttttccaaataatggtcctcacaccatttactgcatggtctgttctttccccacggatttgaaatgtcacctttatgacatacaaaatttctacatttctaaattctctggtttcattggttcttgtgtcaatatcaattacacagaataaaaatattcttgtggctttaaggaatatttttaaattattatagagaaagacttttttcactaaaaatgttgacttttcttgtgcatttttttttccagctgaatgttagaagtttgtcaagtttcttgaaaaagtcgactggcatttagcctagaatcacattgaatttgaagattaatttgaggtgcaatactgtctcccatttaaaaacacagtatatttattttttattttgcttatatttctttatatttaattatatcttcctttatgccctttaggaaagttccaggtttttttctctctacataagtatttgtaccacctttctaaactcattagtttaaataatagattttctgttgattccaactttatgggttaataattatgttgaataggccaggaacagtggctcaggcctgtaatcccagcactttgggaggccgaggcgggcagatcacctgaggtcaggagttcaagaccagcctggccaacatggtgaaaccccatctccactaaatatacaaaaattagctgggcctggtggcgcgtgcctgtaatccaagctacttgggaagctaaggaaggacagtcgcttgaacctgggaggcagaggttgcagtgagccaagatcgcaccactgcactccagcctggcgacagagtaagactctgtctcaaaacaacaaaaaaaaagaaaataattaaattgaataaaaattataattttggctgggtgctgtggctcacgcctgtaatgggattatagcactttggaggctgaggtgggcggatcgcaaggtcaggagtttgagactagcctggccaatatggtgaaaccctgtctctactgaaaatactacaattagtcgggcatggtggtgcgtgcctgtagtcccagctactcgggaggctgaggcaggcaagagaatcgcttgaaccaaggaggcggaggttgcagtgagctgagagcgcctgggcaacagagcgagactccatctcaaaaaaaaaaaaaaattataattttgtctcttcttttccaggatttatactgcaaatggcgtttacttgcctttctgtattggctggaacttccattataatgtggaatatagtgtggtgagcagacatccttgttttgcttttctgacttaaaagagattgtttctgatatttcatgtggctatgggtaacctgtacgggccagaagtcatttgaatttataactacaactgatgtccatcttcataggttatccttttgggctttaaaatcagggtgatgttagacttacagaatgacatggcatgatttccgtttcttttgttctagaaaaattctcttttttaaggttctgatacaatttaatcgtttttattcctaatttatatttttctaggaaataatttcatctaactactccaatttactggtgtagaactgtatggtattattttgtaacttaaaagatctctgtgctttgtcatctttctcctctctaatctttcttcgttgtcttttttctttaatcatattatcccatagttttccttttttttgtacatcctatatgttcttttaaaaaatgagtattttctgtacacaggaaacaaggaattctatgtaaacatatatatcttagatcaagcttgttaattaaatcattaaacctgtatgtatctatacctatttaaccttactctctgatttgtccatttctgatgtgcatgttaaaatatactatgattatggctttgacaatttctcctagtatttgtattgttttctgctttataaattacaaaagtgcatggtttaatggtttgtaacaattgtattttcttggaggattacaatgaacacaaaatattttattattactttttacctaaaatacttcttaatttttctagttttagcacatctatctgataaatgcatacacacacacacacacgctcacacacacacacttcatctatctaatctcaacttttctgtgccattctctcttagggaggtttctcataaatagcatatgttaaattttgttttttacctgtttagtaaaagtaggatttaatctctgacgtgaattgtgaaaactagtatgtgtggtgtgcatggcctctccagccacctttttttgttttatatttgccatgctttttcctcttcctcttggttaaactgaccaagttttaaacatttattttaaattattattatttttttgaatagagacaagttctcgctatgctggccaggctggtcttgaactcctggcctcgagggatcctcccaccttggccttccaaagagctgggataacaggtataagccaccacacgcagctctgatcaggttttaattactccctttcttcctacctttagctgtttagaagttataatacatcacatttctattattttagtggttatctttaataatttaaacaatatttaaactaatttttgccatcgatcaattctcttctcagacataacaagaaccctagtataccatcactcctccttgcacttgtctctgtggggattttggttccaatttattgttaatatttatttttcacattatgtcaacaattatttttatacgttgataaatttcgtagaatgctttgctcactactgttttattaattctatgtttttctctgtctctgatttttttttgaggtaaggtctcactatgttacccaggctggaaagcagcggctattcacaggtgcaatcatcgcgcactgcagcctctaattcctgggctcaagctatcctcccgcctcagcctcctgagtagctgggactacaggcatgcatcaccatgcctggttctgtctcagatttaagaaaatattctattacagcatatctttgagtaatcctttcagaaaagatgtgcaggtggtaaactgattgaatccttcgctgaaaaatgactatttggtatcttcaaaattttaaaggtcatttcctttaccttctggcttccagaactgataagagtactgatgtgaaatttgattccattctcattcttgtccatttttaggtaaactgcttttttctctgctttggaagataataggatattcttctccttatcaaaaattcaccaggacgtgatctttttcatagtttttcatattcaccctgtttggccctcttaatctgaaggcttgcgtgtttcttttgttggggcacatgttcattcattcactcattacgggcagggatacactctgtcgcctaggctggagtgtagtggtgcaatcatagctcactggagccttgaactcctgggttccagtgatcctcccacttcagtctcccaagtggctaggatgacaagtgtgtgccaccatacctggctaaccctttttgatttttggtagagacaaggtcttgctatgttacccaggctggtcttgaaactcctgggctcaaacaattctcccgctttggcctcccaacgtgctagggttatggatgtaagccaccacatccagcagaaaatgttcctctataatttattttctaaattatttcttcccttcattgtcttttctttcctgccagagctcctatgagatgaactgatccttctaactttccttattttctgtctctgcctttttgctttgtattctagttgatttccttgaccctttcttccagaacactcgatcagtattcagctgtgtccattccattattcacctactgagttagcaactatcattactatgggtctcctctcccctgggtgggctgactaaagttttattttttataagtggacgagatactaactggttatgtggacatgaagttggaggcaggcaggtaggaaatggcctttcctccccaccagcaaacgtgacactggctttaccctggtggtgaggatctgagaatattttggatactctcttggataaaactatatttcatctcatctctgaccatccttgcttccttcacacaaactcaaaccctgctctgttcttgtaggtccccacatccacaccaaaacgtctttcccaggcaagtggctcattctctttacagttttattcttaagtctcaaattaaatgtgtatgttgcctgctgtcaggggtaagattggggaactaaggggctggaagcagttaattccctgatgactgtcttaagacccctactcatgctgtgcttgatgttctgccagattggttcttaccattatggtagttttcccccacgagtgttttaccctgtgatttttattttctctgttattgtttatctgctcctatttgttttctgtcaataatgcctcataatttctggtcagctaatggcatctgttcttatattttcagtgttcattcactattaaagaatgtattttctttttaatggatctttggacaaaaacatgtgctcagttctctaactagcactaagctgtgtgacttcccacactggttaatgcatgcatgcctgtgggggatgaggatctgtttatgtactgcactaacttttagacagatatatttatgtatattgcgcacatatttgatctcaataaatttaatcaagaacttaatttgatgaccatttaaaatccaagcaaaaaagaggcaaaaatgcttatcagatatacatataactacatggcttaatttaacagttctgtctatatctatttatccatagatacaattataatgatatagaattaatccagaagctaaagtaggatcattttactctattctttttattctaactaataaaagagtatctgacaggcttttggtccatgttcccagcatttctgaaggcttcttatcaaatatgctgttattacccataattttatgtatcgatttgtataatgtatttcaaggaaaaaattcaatatcagccattcttgtttctttttttctttttattgaactaccaagactaatacagcacatcactaagcaaaaagtgctatttactatgcaaaaggcacagtcagtgattggcatctaagaccaattgatctacccattaccactatctccctacccccacaagcattactatgaagctattgatttaaacactgtcgatcggtttccattttctgattttgggcaggccaatcaagaaagtgagtaattgtgattacactgcttcaggatcaattacatttgatgcaagacaaagtgctctttttggaacacacacacaaaatttttgatctagcatgctgttgtgcttaacaaaatctaaaataaataatttgtatctttataataacaaaacatactaatgtaaatgcttttaatagtcaagaacattttctatgtgaaatacatgaattattttcctaatgttagtttgaaagaaatttagaaaaaatattattcacatacactccttggcataagataaaaatcaaatactacctgcatatatatccatccttaaagagacttagttaattatgaaagacaaaatgcaaatcctgttcaagagactataaaggaagtctttgtaaataaaattggggaaaaaaatccaattacataggaatcaaaaggttctttatacaaattgataagaaaaaggaatcttttttagttcttaattttggtctaacttggtacgtgagctttgtcattgggttcacattgtccaaatcattaaaatgaatatacctctggtgtcagaggcaaatctatttagagtgatgttactcatagcctgttgttcagtaatattgatctgtgttgtttgtctaatagaaaaataataaacaattactaggcaatgttgggaaaagtaatcagtttttatatatcactaatacagcagacctcccaaaacataaaggtgatgatctgcataaaatcaatgtgttatgctacattgcttatatttatcattgcaggttctcggcaataaaaggtataacattaggccagaattactggtaaactgaaaaggtatatgaaaatgaaaagttcactatgtttaatctatacatttattttaaaatgtctatttctaaaacttcaagacttttaaatcataacaaattctgttctaagctagctaaaatgtaggtaaaatgtctcaattctttttagaataaaaacaaagaaacttcaactcaaaatagccaattgggccttatatcagaaaaagaaaagagttcaaagataattctcaatgatgcatgaatacggctttgttctaatttgctaatagcctctgaatttcacaagaaatgtataaagcattatagaaaaacattaacaacaaaatccaatcctaaaaaagctcttctgaacagcattcagctatgaaacctttgccaactgcataaatgttctcttttgacttttatcaaagcagtttgtaaatggatgtaaaaaggaaaaaaaaaatgtgtgagttttaggtactgatggcatcaataatattccacttaagaatctcaagataacatgtatgtatatctcaaaagatatcttctctgagctatttaataatattattaatgcttttaatttctcctggattttcctcatgaattttctcataaattttctaaaactggagtgataagttaaaaattacttagtagtagcttctttctttaaccaacaaaccatggatttcaatcacatatggcaggttgtaatggctaggtgtgtaacgaatgctaaaaatacatatactacacacaatttgtacaactattccaaggcagtctaaacattatcaaagcaaaacatatttgtttaaatgttttgtctttcacacacacacaaaagctgttgaaagcttagtttttgatctgctatcctttacaggttatataaaaaatagaagaacaattgaacttaccacaactggaaactggcagtctgagtagaatcacaaaagtcaatacccattgaaactgtaatggatccctcaggctcaagagagtctaggaaataagataatttagacatgaaaacacagaggatgtgaaaaagaggcaaactaaacactgaaaatttaggtaatgtttgtagcttggttgaaactgtgaaatgtaatgatggcttaaaaatttcaaactaagaatattaaagcaaattacaaagtaacctaactattctgtttcaaggttttctttttcacaaattaattctgcgcatacaccaatgaacacattatacccatttgtttcagaaatacatatcttcctgagaaatgtcatgttttctaatattatctctataggtactgaaaatgagaaggaaataaatgtgttcttgtttcgcatacctgtaatggactttgggagttcataagaggttatgtacttaaaactatggcatgtttattctagatataaaaagtaaattttaaacaatgtccaaaattttcaatgaaaaaaatcctaaattaaaaaatgtaaatcaagttggaagaagaaattaagatgcactcagaaattaattaagagatctcacattgaaaccaaaatgttaagtctaattgcattaaatactcaaaaaaatttgtggcagattagattatctttataaaacaaaaaataaaatgacatttgatagatttggaatttcagaagcttcatctatcaactaaccaagtataggaaataactataccaatatacaatacagtattttttttcagttaacaatgacaaaacttaaggcaaacaagaacaaaattttattctgcttatgatttgaaagtttagctatatcttagaataattgaggggatcttaaataaatatgtatatatttgtttatatatagaaactgtccatttttgatttctactttgctcaaagtattctgtataattgcagctataccatacaatcactttatatttagctttatctattctctatacatcctatcacacgtagttatattttagcaagcacacttctaattcaatagactgtgactattctagggcttcttggtaagtatgatttgccattgaatgctaaccacgacagagatgatggtacagtcgggataaaataataattcaataagcttcatttattaagtattatgtttatatctcataggctcaatgaggagtaagcattacaagagagtatttgttcaatgctgattttaaaatgctatttgttaggcaaaggaagtatgttaaaaataaaaaaagtaataattaaaatgctatttgctcagtggtatgtatgttagtttgctgattctagtttgaatttcatttgtttacaaacctaacattttccaggatgccactcaaatactagaagacttgctccctaaatctctagcaaacaggctttactgtagggtaaataactataatgatacatatgtttttttcatttctcataaagctatgtgctgtcaacagtttagagctttgtcagtcacacgctgctccaggctattcttgagtgaattcttaatgccttctgtgccataactattttggggtttggtcttgtttttatctgacacattagtagcaaattccgtcatctccaaaacttgatggctttcatgatttagatctcccttcatcatgtatctttgcatgtcatttgacaaagtgacagctctcaagatgccttgttgatagcactctttgacactgtttgatactgtcttcagtcttaagataattaactgtgagcttagtgccatactaattctgggggacagtccatgatcaatggcatgttttattatatggatgcttcaggagcaaaatgatcagcataaactcattcaaataatggatttttataatacttggagccgactaaactgggaaagcttacccaattaggtgtctctgtttggacaccatttctagatttgctcctatatatttgagatggctatgtagaagtggctgaaaaacactggctctgttacgccacaacattaatatcaacacatgaaatcatataggatgccatttactttgatgtaacagttgtacagtaactggtaaaatcttagctgaactcaaatttgtcaaccactaacataaagccactgaatatagtaaagagagcttaacctattctttgtgtcttaaaaaaaaccctcttatatactgggtctctttggggaaaatggaatattattcctaatattcttgtaaggaatacagtttcatgccaaacacagagtgaaatccagaaaaaaaagtcattgcacattacagacaaaaccagattggtggcaaataagaaaactgcggactccttaatgtgtatacgttcttaaaaataaataaaacaaatagcttacctcccttattttactaaaacactaaaatacagtatttgttttctgttgcattcttaaaatgtttttggaggactaatttagacatattatattccttaaccctacaatctattgataatagtgtcatccaggtggtgttacatacaagtacatactgcagacaaaagaactctgtatcttgaaggcattcaataaatgccaaccaaatgaatgaaacatacagtcacaaaaatttgtctaagaatgacaaagaaaagcctacaaccaatactgaggcaatggtaaacattcatattttatttctctgttaaagtcatactatgaaatttattatatttatttcttctattctacataggccaactaaaggtcaactcatcaactcattatgccagctcaaagaaaaattaatactgttctactgctttaacctttggataacattctcaaccttcagacaattcatgtatcagctgcttgacacttcctaaactaattttttttaactaggtaaaaaaggttgaattacaagcaacaaaaataacacaataattccttggcaatatattaatgtcacacattatataataaaaattaggatactttgtgttctttaaatagtgtcttaattatcaaaatatttttaaaaattaagtggattttgaaatcagcttactttaactccactttctttgctctagttgcttataaaactttaccaggctttatcaaaaattattttattcctttgtgtaaaaatataacacacacacaaaatgactttctttaccgaaagattcatgaaaaccagaggagaaaattcagcaatgccaaagagctcagataaagaaaaatggaagagttatgtgaaacaatgagtaaagaaggtacaattacctaattttacttgatcctggtcaaaaggcattgtttatcttaagtattataaaaaggagctctctggagcattctggttataacatttggaagatacaatgacataaaccttttattacttttaattgaggttttgcctgaagcttctctcaactaaaccttagggttatctccacttacaaaaaccaaaaagaaagagatagacattctaaatattacactatttcaaatttcaaagtaagacacacaattgttacatttaatgtttaaagggtatatttttagcaaaatacttaaaaaatgcaaaggggatgaaaaatggccactgacactttgttggagagacaacaggatgcggtgggcacagaagcaacctggaaagtgcgagccaaagctgggggcagccgctgctcagcaacccactcattggttgctgcatgtggggataaagggccagtactgccatattttacgctctgctccaagaaaagtgagatttctcattttttaaaatgtaaaagcatcttcatttttaaatggtggcaacagattgaaaacatgtaaaaattggatgtggataaataccagtgatatcctctaggctactgtatattctatacatggagaggaagataagcagactagtctacatcgggggtgtgcaatcttttggcttccctgggccacattggaagaagaattgtcttgggccacacataaaatacactaaccctaatgatagctgatgagctaaagaaaaaataatcgcaaaaaaatctcataatgttttaagaaactttatgaatttgtgttaggctgcattcaaagctggcctgagccaggttggtcaagcttggtctatatcctctcagtcttcactcccttcactttcccataaattgaaaagtgaagggaaacaggaaaggatctcgagatacgagaagtattgtattcagaaatgcagagcgattttcttgcttttaatacacaataaaccacttaaaattatgcagggaatgaagctgaccaggaggagagatggggaaaggtgacacaggtaagtaaaacatgatggcaatcttgactctgcagacctagccttccatcactactggtattactattactgggacctgattcactaagagcaaagaaatgtatttatcttatatgataaattcagtttaacaagaaaaagcaaatataaactgaatatgctaattgtcaatacaatcatattctactttactattttactaaaaagtattctactttacttttaaaatgaacatatttagtgatcaaatatagttaaggttttaaatgagaattaatatttacctattggattaaaaacatgcattttcatgcctataggaagttttttttcccctatgtggatattttctatctttcgatcagtagtgttattcagtgttatttgtatagagaccatcttatcaccaaaaatgcaaggctgtcttggaaagaaataatgggcagctagtccttttccactcattcgatgaagcagcacgtgagttttcgttggtacaaatgcaggagtactgacctattacacacggcaaaaagaaaaaaagatgagttagtgaatataattattcttttagaaaatatgcaaacatttatgacatttaattcttggttcccctacagtattatatgaactacaataacaaacattagtaggatatcacacacatagatattagtcagaaatgatacaaagaagtaaatgccctcaaaactgtatgaaaatttttctgtaagcggctgggcgcggtggctcacgcctgtaatcccagcactttgggaggccgagacggggagatcacgaggtcaggagatccagaccatcctcgctaacacggtgaaactccgtctctactaaacaaaatagaaaaaattagccaggcatggtggcgggcgcctgtagtcccagctacttgggaggctgaggcaggagaatggcgtgaacccaggaggcggagcttgcagtgagccgagatcgcgccactgcactccagcctgggcgacagagcgagactccgtctcaaaaaaaaaaaaaaagaaaagaaaagaaaaaaaaaagaaatttttctgtaacctccaagcatatattaatattacaaacatactcattttttttttttttgctggggggcagggatttataaacttttttgttagtttttttccctagatcctctatatttggccatcttgctaactttcttattggttttaacagtttgtcaattgattttcttgggtgttttagccaactaccaaaatgaacgtctggaccttcatttccaatcctgactctttgaactgtttttttgtttttattttcttttactgtaaactgaagaccatggcccccaggataaggtggcttcttcctttgccttaatgatctctactttgagatcaagttaactattcacttatattttcttccagacctttgatggtttcaaattttaattcatatggaattgattttgatatattgactccatatttaattttctccagatactgaactaattgtccctacatgagctaatgaatagtcttttctcaatgattttaaatgcaaaaattctaattatttatgtactaggagatatttctgggccttgattgtcctgttaaaccagtcccatattgttttattttttgtagacctacaatataattcaattatttggtaaaacaaatatttccttatttccccctccgaatattttcttggtaaatcaccttttacccttctattgaacattagactcttaattaaattcttccctcaatctcattttcattgaaatcataggcagcatattaaataatgaaacactgtccattctaaaaccatgtgatagctttctttccattcaaaatatcagtattgcatactaggcttgacctgacatgggcaagcattaaaaaaaaaatcaatttgtaattaaacaggcttgattaagattttttcctgacaagtgttgtctcccaactagattctctattatagttctgagagtatatatcaacctattaaacattttcactatgccgtgtacacctgatgacattacaaacgtagcaattatagtaatgatttaaagttccacaaaaatccaagagttaaatatcatatatacaaaatgctacatcatgccttctaagcatcatcaaaacatagtattctttctctaaaagtgcaacaaaaaatgtgggcaatttaaaataatcatcacctctggccaggcgcggtggctcacgcctgtaattccaacactttgggaggccgaggtgggtggatcacctgaggtccggagtctgagaccagcctgatcaacatggagaaaccctgtctctactaaaaatacaaaattaaccgggtatggtggcgcatgcctgtaattccagctactctggaggctgaggcaggagaatggcttgaacctgggaggcggaggttgctgtgggctgagatcgcgccattgcactccagcctgggcaacaagagcaaaactccgtctcaaaaaaaaaaaaaaatcatcacctctaatctcagcacttcgagaggccgaggtaggaggatcacttgagcccaggagtttgagaaccagcctgggcaacatggtgagatcctgtctctagagaaaatgtaaaaaattagctgggtgtggtgcattgcgcctgtagtcccagctactcaggaggctgaggtgggaggattgcctgagctcaggaagttgaggctgcagtgagccatgattaggtcactgcactcccgcctgggtgacagagcaagaccctgtctcaaaaaaaaaataataataataaaataataatcataaaaatttatgggatagtttatttgtaaaatataataaacaattagctaaatttaaaattttggttatataaaataatagggctactggcctattcattctatttaagccttctgatgatgataacaatctagtattttaagttttcaaagcactttcacttctaaggttaggttcttttccttgaataaaaactattttcaaaactcttctgtttcctttctttcttttctttttttttgagacagagtctcgctctgtcgccaggctggagtgcagtggtgcgatctcagctcactcaggcagctgcagactctccttggtaactgagaccaggcttttcccatcaaactccttgagctgctgcacgcagtactcatcagtgggcttggctgtatatactaattcaaagccccacttctgcacttgctccacaaacacagagctggccacctgctctttgctctcaccagtgatgctatagatggatttctgtgcctctttcatgcaggagacatattttgacacagatgtcatctcatctccagactgggaagtgtgatactgcagcagctaggacatgcgtcactggctagtggagtctttgtggattccaagctttagattttaatttttgaaattctaaaattttatttattttttttttatagataggggtttcactctgtcatccaggctggagtgcagtggtgcaatcatagctcactgcagcctggaactcgtgggctcaagtgatcctcttgcctcaggtagcttggactacaggtgtgtaccaccatgctgggttaattttttttattttttgttgtgatggtgtcttgctttgcagcccaggctggtatcaaactcctggcttccagcaatcctcctgccttggcctcccaaagtgctgagattacagaggtgagataccacaactggcccaagctttagatttttagataaggcctcattgaatttcttgcaattctccttgtcttctgccacctcagagaacagctcaaggcacttcttaacaatgtttctgtgaatgactgttaagattctgctctgttggagcatttctcgagagatgttcaggggcagatcccaagtcaaccacaccaaggattaaagttgagatactcttatatcatcatggctgtccatgatgaacacatgatggacacagagtttgttgttctttttttcttctcattctcaaagaagtcaaagggagccaaacaagggatgaacagcaatgctctgaattccaaccaaccttctacagagaagtgcttgactgccaaatggtcttcctagtcactggtgaagctcttgtagaattctctatactcctcctgggtgaatgtcatcagagtttctgatccaaatgttcttgatcttgtttagttcttcccaatcaatgatttctccttgatcttgttggttttctttttcttatccttaccattgtcctcctcttcatctgaacccacccacatcttcttcaatcttggactttttctcatcatctctatctgcctttttttgtttgttttgagatggtgtaacactctgtcgtccaggctggagtgcggtggtgtgatatgagctcactgcaacctccacctcctggtggatcctcccacttcagccccacaagtagctgggacctaaggtgcgcaccaccatgaccgcctaattttttgtatcttttaaagagttggggtttcaccatgttggctaggctggtctcaaactcctgagttcaatcgatctgccacctcagcctcccaaagtcctgggattacaggcatgagccattgtgcctggcctatcttcctcttctttctcacctttctcttcctctgcctatcatcactgattttctcctctctttccttctccaaagaaagggtaatgggataggctatgaactgtaagtgctcttcactacttctttgaccttcctctcttctaagtactctgtctggtcttctttaaggtggagggtcactttggtacccctgccaatgggctctccatggtcagcacatacagtgaaggaacccccagcagagactcccaggcatactcttcatcattgttgtgctttgtgatcacaactactttctctgccacaaggtaggcagaaaaaaaggcagcaccaaactgcccaatcatggagatatctacactagcctgaagagcctccataaatcctttagtaccagggaatacaccctgactttggtagacacaggcattgacatgaccaaggctgatctcctaatttgggaaccattaccatgggttggggatgatgttaacttccagctctttaccattgtccaacttggaagggtttgtcaggctcttacaggaaatcttgtccaatgcatcagaaacattagatcaacccctgaaggaaaatctccttgttagaatagaaggtattgatgacgagagacatgagttgggcaatatctgcctgaaaggcaagtttccagctcctccgctccacgtgcactttctcaggcatctcgaaagaaaaaggctacaagtactagagagcaaggtgggctgggactctccgacatgcacatggcaccaaggctgtactgggatgactccagagctatatattttatatttatagatttatactcagcaaaagttttcttttttgccataaattcccatgctactaaggctatgataatcaaccttaaatataagctcttatctggctaattatatttttcagtgttacatgtttatttccttaatgataagcatattagagacagtgacaggtcttacttttattctacattgttccacaaacatatttgttatcaaatcattaaataaatgttgatgtagccagctttatctctgtggaaattcataaaaagttggcctacatataatatcggggaaagaaagctgaaactgtaatgtaaaagggaagactatttgaaagttggagaaaggcaagggtagaggagtgggactagagcagaacagaacaaaggtctggttcacagcggccaggaatcagtactgtagatatcatacaaggtggttagaagtatgcctttagtcatttaagagccatcaagccttggcagactcactgattccttctctcagtctaatcctaggatgcatggtccaaacatttattttgtgttttcaactttgtctcaaaattctacagctttattataattatcaaaaaatatgttaagggatgaataaagaaagaaaaacagtataattctctccactcattctttccacattcaaccaagttcaaggtaaaaagcattctctaatgaattcaccgtctaaaaaggccctcccttacaacctccaaaggttatctgtgataattcccagaggtctatgcactctttcacaataaacaggatcataaatgacacttcgtggtaataatatatacttgtttaactacagaaaggtagtaaatgaaaacatagccaggtgtggtggctcatgcctgtaatcccagcactttgggaggccaagatgggtggatcacttgaggtcaggagtctgaggccagcctggccaacatggtgaaaccccatctctactaaaaatggaaaaattagctgggcgtggtggcatgcacctgtaattccagatacttgggaggctgaggtgggaggactacttgaacccaggaagtggaggttgcagtgacctgagatagtgccactgtcctcaagtctgggtgatgaagcaaggctctgtctcaaaaaaaaaaaaaaaaaaaacacaaagaaaaagaaaatgtttgattacttttttaaccttgtttcctaagtttatacaagtcatattacgccaaacttctccagcatctagataaaatacataggtgatattttgttcaataaaccgagtgggttccataaatacttcgactacttccacatataatacatttaatccagtgttatattaatattaacatatatttagactttagttcaatattttgtacatcagaccagatacctatattccagaaatacatatgagatctgtggctgcttatattctaagatgctcaacattgcaaatggcgttcttgacttcatattttatagacaacaatgattttattagatgcaaaaaaagataaaacataattataaagtgatctagatttgggctgtgaaaatgagggtttaagaaaaagggaagatttaataagtctaaacacaatacatgtagggcagaggttgcaaactataacccacaagccaaatatggcctgctgcctatttttaaaaagtatcactggaacacaaccatattctttcatttacatactgtccttgactgcttttttactctacaatggcagaggtgagtagttgtaatacctaaaacatttactatctggtacctttacaaaaaaagtttgctgacccccgatctaagggcacaaatgttagatccttgccattccacttcccttcccttgttgttggaaacaattctctacagcagagggtccccagtccctgggctatggacctgtaccaggccatgggttgtcaggaatccggccgcacagcaggaggtgagtggctgatgagagcaagcattaccgcctgagctctgcctcccgtcagatcagcagtggcattagatcctcataggagtgcaaaccctattgtgaactgcgcatgcgagggatctaggcagcacgccccttatgagcatctaacgcctgcctgataatctgaggtggaacagtttcatcccagaaccatccccctattcccaacggtccatggaaaaactgtcttccacaaaacgggtccctggtgccaaaaagggctctacaggtctcacgtcttctgagcagaaacattagcaactttgcttctgaagctcttttcaaagatgtttccacagcaaacagcctttggaagacagaggtaatgcctccctctggggcaggtgatagatttgtttgttcattgtccaggattagaaagacaaaatctccctctggggcaaaggctgaatagatttgctaacagtccccttataaaagcctagaatctttttttttttaaaatactttaagttctgggatacatgtgcagaatgtgcaggtttgttacataggtatacacgtgccaaggtggttttgctacaccaatcaccctgtcatctatattaggtatttctcctaatgctagccctcccctactcccccaacccccaacaggccctggtgtgtgatgttcccctccctgtgtccatgtgttctcattcttcagctcccatttatgagtgagaacatgcggtgtttggttttctattcctgttagtttactgagaatgatggtttccagctttatccatgtccatgcaaagtacatgaactcatccttttttatggctgcatagtattccatggtgtatgtgtgccacattttctttatccagtctatcattgatggacatttgggttacttccaagtctttgttattgtaaatagtgctgcaataaacatacgtgcacatatgtctttatagtagaatgatttataatcctttgggtatatacccagtaatgggattgctgggtcaaatggtatttctggttctggatccttgaggaattgccgcactgtcttccacaatggttgaactaatttacactcccaccaacagtgtaaaagtgttcctatttctccacatcctctccagcatctgttgtttcctgactttttaatgatccccattctaactggtgtgagatggtatctcattgtggttttgatttgcatttctctaatgaccagtgatgatgagctttttttcatgtttattggccacataaatgtcttcttttgagaagtatctgttcatatcctttgcccactttttgatggggttgtttgattttttttcttgcaaatttgcttaagttccttgtagattctgggtattagacctttgtcagatggattgattgcaaaatttttctcccattctgtaggttgtctgtttactctgatcaggttcctctcctgtaaagcaacacaatgcatgtgcaggcttcacctagccttcagcatgtggggctcagagaagtgatgcaaatgatgctactctggctacttctattgctttaacaaactgtcctttgtctctgaccaggagtcttgtgtcttctaccagcattcatgaaattgttgcaaattaactagttagcttgtaagtagggtaacatctcagactcttcacagttcttgatgcttgatttaaaaaaaataatttaacaattcccagagccgcttatttcaaacagctaacacttagaccaccatatacatctgtgcagtggcaactgactgaaagggtgaataggagctaaaatccagcttacattcaagggaaactttttggaatctgcgcaatggtgccatacaggctagtggctttactaatcagaatacaactttacaaagtagaggttacttttttcttttggatttcctttatgaaaatccatgttatgactttaattattcctgtgggtttctgaagtatcagaaatgttctgatagccgacaacaaagtgttgagtaagtccaatgacaatgcagaataagaattcattgtttcagaattgcttttatttggttcaagactaagtgctggccttttgaggaagctttgcccccaatgcttctttaccctatagtggttatgtatgagactgtcagcccaacatgccctactattttctagaaacacattcagcccatgatggagctggcaagttcttatgcctccccatgactggctgcagttaactggttcagggatggacatttggcccaatgagttcctttcctaggatttttggatttggtacctagtaatttgagccagactctctcaagcagctaaaattctgagatttaaaactctaattttgtctgtggccacatttcctgccacattgttcagtgagaaaaaaaaataataaagcaaatttcaaagaaaagcatagatgagagacagagaaactagctggtaactttgagctggatggttcttgatgcccagacacattactgtccttgctgaagttgttttctctgaactgtagctgtaatttcctatttatttatttactacttaacctagttcaaattgggattctatcatctatctcccccactctactactggttgggattagtcagatttcaggacactaattagaaggggaaataagcttgtaatgggagaatgcccccttcccccactttctctaaagtcctggtagatatggagccaggagatcacagactcaggtaaggcttttgattagactgaaccatatgtatctgccatatctgtaggtcaaaaacagtcaaactatcaatttcatgtgactcaactaataatttgttttgcatcaaggctacttaattctacctttaatagaaaagaactttgagtccttgatgtgggccaacctaactcactggagttctgtattgcggttagagagcaaggcccacaataacaacaaagtacggctttgcctttctttgtcctctgaccctatgtctcccttgggcatcttggggagaaaggtggtaacgtgcaagaattaggtatttcacagctctctgtccaataagaacaccgttatttcaaacacaaagtaactacaaatcattaatcattactcaccattaatttattaattcattctttcatgtaaataacatttattcaatgagttgtaccagccctgtgctaaggagtatgatacagagacaaagccaaagtatcctagtcctcaagaagtttattgtttagcctgggaaaacagagtaaatcaactagtgtgataaatgtcatgacagaagcaggctcagtaggctagaagaacacaaaagtcatagctgacacctgagggagtcatcatggatgaaaacccagttattttaatgaaataatctggctatttctcactactgccactgtggccagcccggtctgagccaccaccacctatcatctggattattccaacagcctcctaattggtttccttgttcctacccctgcatcttattgaacatagactgaattgctatgttagtctatcctgaacacagcagctagaatgtatcagttaaagttacatcatgcactggggtgatgaaataatttgtacaccaaactccgtgatatgagtttacctgtataacaaacctgcacatgtacccctgaacctaaaataaaagttaaaagaaaaagaaaagttgtatcatgttacccctctgctcaaaacccgccaatggccaggatccttgttccatttccttgatcttgtttcctattactcttgaactcgttgtttattctactcatcgccatgacttccttgctattccttttgcatattagtaacagtcccactataggttattccctgggaccctctacctggaaggcactttctccagagacccacatggctcagctctagtatgtctgctcaaatattaccatcttagtaaggcttaacccattggcatccctcccttctgatttcctttttccttttttatagacacttaataccttctctaacacaatatataatttacttttttgttatgtttattacctgtcttcccatctacttcccacttttatgctcaatgtattaaacttaattttaccctttctcagaactcaaagcataattttactattttaaatgattatggaaatttgcaaataatatacctctagtgttggtcataactatacattatttaatgctgagtgctcaattataacagtgtccttaaaaatactacagccttataggaacacactgtggtgatatgtggagatcttctatattaatatttgttggttttatgatataacttgaattttctattacataaaattgtgaacaaataaagaagtacatttcttaaatgcacaaagaacagcttattgagggacttctataattcaaacactaattcttgaaatgtctacttataagtgtattattttattaaaacttatataaacaagagtatgaaagacaaagtttgaaaacattagttttgatttaattgtttaacgactaacattcaaagaattaaaaacttagatgcattataagcaaatgatataggtcatctttactatggctcgtgaggaagtaattagttcagtaactgcagtaactgtaaaataacaagcctcccccaagagttaacagaacaaaaagcatccagtaacaatgagataatcctctacaaatctttacacagcatatgtttaaataataaaagtcgtttgtgtacctttagatggtttatgaaaataagcaatcaattctgcagacacaacattatttctaaaggaaatctatgtgactcatgatgcctgtagatacacagagacaaaccacacatattttatcagtttattacagtaagcaaataagcgtggaatgagagtgcacataactgtctacttagcgcttactgaaacatttataagagctgttatctccctaataacagacagacagcgtgcaattttagagaggagaaaagcttcatattttttaacacttcactaaaaagtaactgaagagtgtaaaatgaaaaatactctgtgcagttagctggtaatggaccatattatcaactcaagttagatttataggatacaaactagtcactaatagttattttatgacatagcatgtctgcttttttttgagattattaagattaaagttgtaaaacttcttttgaacatagctgttcaaaatgattgaattataaaatttaaaatgagattcgaaaaataaaacatggaatagcaagtaagtgccttggaataagccttgttcagcatccacattactattcaaagatgacatttccacgtaaagctttatgaaaacaatgtttcccagccttttatgctttaatccacatttagttacccagtcattaagtattatcaatccattctgtttttgaatttcaaagatatgaaaatctgcagtatataaaatgctctttgtatctagttttgtttggcttactttacatcagtatctattttgatatataatttataaaaatgacgaggtaagaaaatagctataaacagaggcacagcttcatctttaaaattagtacttttaaaaccaatgtatgtctcaattgataagatttgtaatgcagaaagtcacagtattgtctcatttatcctataaactgtagaaagtgggtcttgattttaccttcaatccatttcattgaggctagcattaacctagtattgacctagaataggatttaaaaaagtaaacggcaaatttggttaactcttacatataagcacagactcgaagaaatatatttgaatcttccagcaaatattacttcaaataaatggtttttaatactaaagataacttcttccttatgtatataaattttgatatacaaatttatgataatttctcatattttattttagtaatcactatacattataaagcacacaagactttctcacctcttattttggtaataatatatattaaaaatatatttgtggaaatacgtgaacacataatgaacaaatatttaatgagcatcttatttcatgctcggtattaagcaggcaccagcaaaccatgcttagaggccaaatctggtccactgtctatttttgcaatgcctgttcactaataatgactttcacatttctaaatggttgaaaaatcaaaagtaatatgattgtaacattaaaatgatatgaaattcattttagtgtctataaatacagctttactggaacacagatgcactcatttatttatgtattatctgtggctgctgttgcattaaaatggcagggttgagtggttgtggcctgcaaagctgaacatctttactacctggccctttacaaaaaatgtttgccgatccctggtataggatatattcaatttacaatggttttgatataaggaaattaatatcccattctttctcctccccaaagacagatcaataaacttcactatcaatacacttactgcttttctatatatctgaaagccagaataatgtctatattgttttatatatcacgtacgtggtaaatagcaccagaaccatgaatactgatatgttatactattcatacatatgttctcctattctttttatatttcttttctgacttttggcttaagagtactaataaaaacagactgaatttgacttgtaaagtgttcagcatgaagttctcagtaactggttataacaaatttctttagaacccagagcattttacagaagcccaaaacaattatgcattgttaagctgtgatttgaaagatgtgataattacgtgatcttagcagttctactgctttttcattcacaagattaaaaacataatataaaaaagaaaatgctagtgtcttctcccattataaccaagctcagaaccttggcattatctttgacaccctcacattaattagaaacaaattcactgtctcctgcattcatttcctcttttctgtccctctaccaccagcttaattcaagtcttcattaacactgaaaatacttttaaatcttttttttcaaattacaacagcattatatatttattgaaaataatttaaatagtatgaaaatataagaaaagtcaagtcccagtcgggtgcagcggctcacgcctgtaatctcagcactttgggagaccgaggccggtggatcacgaggtcaggagttcgagaccagcctgaccaatatggtgaaaccccatctctactaaaaatacaaaaattagctgggcatggtggcgcatgcctgtaatcccagctactcaggaggctgagacaggagaatcacttgaacctgggaggcggaggttacagtgagccgagattgcaccattgtactccagcctggtgatagagcaagactccatctcaaaaaaaaaaaaaaaaaaagaaagaaaagaaaagtccccctcaggtaaccataacaatttggtgtcccttccgatcttttgctcccttatgacttctcttgcttatactatacgaggtctctctaatttgcccccgtcattaggttcgttttactctgagctgtaccacaagctgctacacaaaataattctcttggagttgtaactccttcatacactcagcagtgaggtgtggtgggaaacacagggctttgaaactatacagatttgagctgaaattggttttatacatagcacatgttttactagccttgtaacaccagaaaagttactgaagctgaagggatctcaattttcaagtctgtgaaatggggacactagcacctatctttcagggttgttttaatctaggctaaacataaacagctggaggcatgaagggcctgaggagcaggataggcacaagtaagggagtgagttaagatttcagaattgaaaggacgaaaaactgaagttcagtggaggtgaagttattagaattgaacagatcaagagactgtgaggttacatgttgcacaggttatgaatatgaacactgcagttccccaagatgatggtgggccagagagattatgtatgaaatactaagatcttcactgaatatggataagtgattaagagatccaaagataagaatgacaaggaggggaagaaggaataggaagatggaatgggccccataagaggaaggaaaatgaggatgaaaacagaatggcctaaaaggaacaggtgagcttcacacaaacaatcttggtagtaacaatgatttcgtcaagacagaattatcagccattatgaatggggccatgctgaacagatttacaacaggacttcaagatccaaatggagattcccagagaaaagctaggccatgaaccttacaaaattgtatgagggaaaccgtaagctgttctacatatttcagagatgggactgtggcctctaaaagctggctgtgttgccttgcatttaagtgaattgtgacttagggacatggattccccttgatgaaggatgcggatgtcacctagaagaggtcctggcgataaggaaagaagtatgtcttaggagatgtacaaattggaaagggaattttattatgggtatagtgattttaaactacagatgctttctttgaatctgacagaagggaaaaggatcctcatacatcctagatgccagttccaggtaccacaagttgctgaaaatttcctgatgcagggaaaggatggggaaatgggttccctgagaccataagacagacagacagacctacagacacacacacacacacacacacacacacacacacacacacacttacttatataaacattattccccttgatctgtgtgtaaatattttaaaattttcagtaaggaggtggggatggagagaacgtgatttactacataaggcctggttttcttcatggcaaaggcacctggctgcatggctgttccgggtcaagtcctgggattgagcctcactcctgcactgtggcactggccaggtcttctcaggctatacgtatttttaacatattaaacatttttcctcagaagtaagaatggttagtttccttctcatgaggcagaattacagctggcagtggtacgaaggaaaacactggattttaagttagaagaccttcaagctatttgatgagaagaaaatcatttaacttctctgtgcttgtatttgtatctaattgataggattcttttgaggagtcagtgtgacactgcatgtgacagtgtgttgctggtgaaagtctccttctttaattattattaaagacaatgtttattagcataagagaaaaaatagtggcagagctaagattgaaatgtaatattcttcagtgtcatttctgtcaagcaataagctataattcctttttcaataaacacaaaatggtccttatgataaaggaaagtaaaggtcagtcatgcaagctcatggggagatttttttctctccttcaaggagagaggtggaaagaactagcatggaaacttttttgaatgtgatcttaattataatcagtatccttaacaaataacttttaaaaacaaatccataaactgagattagaattgtctttaaaatatcagttatttaataaactgcatgtctgaaagtggatttcaagtgataatttcataagcatacatcataaggcaaaggaatctaaggggaagtctgaatgctacatcacaggggacaaccacaccttgagacaatattttacacttctttacttcctcaggattatttgttaataaaatttctactagatacctaccttcagtaccaaaatgacagaatcccacttttatactaattgtaaggaattaactcagtatttggacatgctgaaaagactaatgatgaataccacttttttaaaaaaagcaatgaaggtaccctcaggaaactgcatggggtatgagaccagatgtcaaatgatctgggttatagtttgaactcagccacatattaaatggtgagaccttagctaaaccacaacctcagagcttctgttttcctcttctgtaaaatggggctaatcatacatatcctgtctgtttcactgagttgtcttgaggatcaaatgagaccatatatgtgaaactgatttttaaactgcagaaagttcaataaaaggcattatttggattattagtaaattgagttttcagcccacgttaaaacaccaatctgtcagataacgcagggtcctgagattaaaagtacatgtcaaaaagctgaatcaccattggaaaaatgcttttataacaacattgctgtatttattgatagtaccatccaaaggcctttacaaaagtaatcccttcccccgcatctgtttttccctcctctgttagttgtgggtgaagagaactgttctctaaaaggtttctaaatgatgttgatgttaaaaaatatagtatcaccatttaacagccttttaaagagcagtccccagtatggtctttgttaacaactgagggaggaagggactattttttcaaaggcttttagaggatgttgttaaaagaatatatagtgacatcatttaaaagccttttaaataatagtcctctttccctcccaattgtaatgtccttggctttcatttattttgtactacaagccgaaaatggacaagccaacatattattggctatggcagcatttgttggatggagaatgatgcattgcttttaaaaaggtcggtgtccagaaataaatccaactcttctagaacatagtttcatttttatacaggatattgcccacccaccttatcatcaacttgtagtactttttgtttgttttccttaggagtttactgaaaaagacaccatgccaacaggaaagaagtcacggctaagtcattccgagatttcccacggcatgaatctagttccacaatcgactgaggtttgcttcagtgaactctccatccaatttatggcaaattctaacttttagctcctcttctgtagtctttattaatctatttcttcccactgttcctctcattttagtttagtccactaggagacagcagtggacccttagggttcctttccacacttagttcccagggaggggaaaaatgaagtcgcccgtttggtttaagacacaaagtctgatagacagtaatctttgaaaaaaagaactagccagggagataatcatatgatatgaaacaatttcccgtctcttcttgagctgggtattttcagaaaagtgtcccttcattttaagaacaggatttcatagatccataacactttgatgaaaaaataagcctttaaaacatctaaatgtacagccctctaaacacactgtattttaatcctaaattttagtgctccccttactttttgccaatcttgcacacagaactcacttgtttattctatgatttacttaaatcacagtaaatcattatttacttgtgatctactatcataaatcatatttagttaaatattactacccacaatgcaatgctcagttcaagtcccaatttatctattcaactcttcctggccctactccagcccattatgatcttaaccatattccatttgacatgttataatttaattttcacactaactttatgtgtaatcttgtatcccatgtaactaacaaagtgctaagcctagataagaataatttctttattacataataatttcataccaaacaaaaaagaattagccaggtaaataatcacagtatgcgaatcatgtttttgcatgatttttgaaaaatgtaaattactttttagttctctactaccttaatagcaccggttagttatctgtgcctgtaattatatttgatggtaaataaatattttaaaatattttaaaacatctcgataaaaattcatttcatttgagatttatatctccattatcttgagataaatgtttcactgagaagtgctattataggccggacgcagtggctcacgcctgtaatcccagcactttgggaggccgaggtgggcagatcgcgaggtcagcagtttgagaccagcctggccaacatggtgaaaccccatctctactaaaaatacaaaaattagccaggcgtggtggcaggcacctgtaaccccagctactccggaggctgaggcaggagaatcgcttgaacccgggaggcggaggttgcagtgagccgagaccgcgccattgcactgcagcctggacgacagagtgagactccatctcaaaaaaaaaaatgttattataattctgattctaaagtaaagtaagtaaaaatttttaaatataagtgttaaatttcctgacctgaagcatcaaagagacagtactaggaagatatgacactttatttaatatgactgatctgaaaatttcaaatttctcttaatttccttaactgtagttaagcagaactgcctcaaatacgaattgcttcattaggcagatggccataatctctacagcagggctgcatctgaactctatgactagtgagttatccccatggtacaatcaacatcatgaccagagaatacaagcctgggtgtggtgccgggttctgctcttcatggaaatggcctctatgagtgccatcaccctgccctcctgttcctctgcaatttgatagggttggggtgagacatgagtatctgagtcacctccttcttcccacaggttctataagtgaggtggtatacagaaaaacagccccttcaaagatgtctaggtcctaatccacagaaccaatgaatatgtaacattatgtggcaaaagggaattaatgttgccaataagttgactttgagattggaggtcattctggattttctgggagggcccaagtaatcacacagatcctgtaagtgaatgagagaggcaggagattcagtgtcagagtgatacagcatgaaaacaactcaattggccattgctggctttgaaggtggaaaagagccatgaaccaaggaatgtgggctgcctttacaaactggaaaagtcaaaaaacaaaaaccaaattggattttcccctagagctccagaaggaacatggtcatgctgacgccttgaaaaataataataaatttgcactgttttaagccactaagtttgtggtaatgtgttacatcagtgactggaaactaataaaggtaactgcggtgcctagttgaaaacccctgttctgaattcttatgttgtgaaacctatcttcagagtttatagtatagtttgtatgcatgcaactttttcaatggctgatctgtgatctgagaagcaacaaaactccgcagtattttctcattgaacttaaactccaactattatagacactaataaatttgagtggctctcaaattgtcagaatcagtttagacagctggtttaaaaaaactcccctcccctaacactccttctatgctttcaataagcgccatgggttggttttgatctatctgtagttgccagacaggtgctggcaacaaatgaaaaaaataaaaatgaactgccatcattaaattgaggcttcaatttaatgcactgcttattatctaagactccctctttaccccctttatttagtatgaatctttctggtaaaatacacataaagaagcattttgcatataagcaaaggggattattattagaagtagtagtgatagatatagacacttggttgaagaaatacaaacagacatgtttcaatggggaaaaggaaggaaaacaaaaacatgagggggtctgggtggggcagaacaagttcaggataataaaatacctaggttagaaaaatatcaatagtaagtaggtatcaaaaaagaatggaaatcctgaaaactctaaaatgtgctatttttgtctagagttacctctctctaaaataagcacaatacaaaaagtcagatgtttataaaagttataccgagtctctgaatgaggactcttaagcattctgcaaccatttgtgtcaagttaaggtgtctataacccattataaccgctggaataaatacaggtgcaccagtgaacgcttatgcaatcaggtctatgtgagaaaagtggaaccacaaaacatataagcaaatgctgctcagaaaaaatttaattcagtctgtatcggtctgatagaaacacacatgtagaaggacaaaatgtttctttgtggatattccatatgggtaaatcatattatagaaggcatgcacattataattcaagaatatattacaaatataaaagaatgttttctctgtgtatttggcagcattagtaattccttctgtcatgatcccaagacaccttatgtaaacgtccactgcagcccgactcatacgctactgaactcttgtgtttacatgatttctgtttccataagactataagataggactcaaaactgacatcatgacttatttttttatttgccacagctcataccaaagatcagaatgtagtagacattccatccatgcttattaacagaaatattcaggtttttgaaaaaaaaaaatctttcatcacaagtaccataatccctaaagttttactagaaagcaaaagagaatttgctctatccatggataaaagtctgcaaagaaaataaagggcattaacctatatccacgattctacccaaatttttcttggaggactaagaagagagaaatttcaaacaatcatgttatgtaatttttatgtttaatctgacacctgctcagatcatcacactacctcttgacatatagtggcaccctttggttgatacctttgaaaaaagaagtactgaaccacatatccataaacatacttccagaaagcacaccgctgggtctcagaatacaaataatctggtcaaacatagaaaaaaaaaaaaacacttctcttatgatttcccacatccctcattgatcaaaagactgatgaattgataaccttctctaggtatgtatcctttttaaaaatcagtgaaaaggtattgttttctaagagaaaaccagataaaaaaaagacagacattaatttctgatagtttcctttcaactgttttacctattccctgagcatttaaaactagcaaggcattcaaacttggtgagtggtatgtctacaggttctagtaaataaagctatgtaaaaatttcaaattcttatcaaggaatttgagaaaattctgacacacgacacacattaagtatggcagaaggtacaagactaagttgtcagtggctgacatgttttcaccatctatatgatgctggtatgatcaagcacttgatgtaatgcctagaagtaaaatgaacctgtgaacattttctggtataaaacatgtctctgccacaacacaatttcttaatttcaaactcatatttaggatcactgctttcagcagcactgtcagcgcgcaaggctggcatgaagcttccaactgcatattatcacccattgacaaactcgacattttatgaagagcccctctttcacactgacatcctctgtaccctgagtaaataacttacaattcatttcctaaccttgattttagagtccatccagcctttccacccttctttttcttctttccaaacaagtgacaaagaacaaggaagctgattgaaggggtccattatgtatcaacttaaagaaaggcaaagtgattgatgaaaccagcagtcaccttcactgctagctactgcacctgtatcctttttgtcaaatgacctgaaaatcctgctgacagtttaacactcactacaaggatacacagtatgagactacagttttcaatatttttatttgcagtgaaatctttagggatataatttgagaacaaaagtttagctttataatttttgaagctttgtattttcctcctacacagtctctgattgctatcaactttctctgcaaaaataccgtcatggtgtggacagggtagttagatgtggtatggtaggtaacctgaatgtttattttaaacttcatgtttttgtttttgttagtggagacaacattgttaactcagcaggattccttctgccaagtgatttgatgaatccaaattaattatattgctagaagaggtacttataatttctcattttatctctttggggtggccagtagctcaaaaagtaattaaaattaaaaagtaaaaatgaagtattctaaaattactaacactttatctaaaagacctaaagttgtctctcaactttcaataggtgaattcactaggtaaccaagcaactaagaatttcttctgtgaatagataaaagtttacttaaaaaactcatgacatttccgtatagcagtgaatttagtcataagcttactgtgttagaaataaaaatttcactaggcaacagggacacacttgagagccagcaaaatctcaaaagaagccacagttctctttgtggacatagcaccatttcctctgggcatttattacctgttaaaaaccaatcttttggtgagtggcagttcagggtttttgagagcaagctgcaatatttcttcaggtctgcagagtcataattaaagctgaactgagcggaattggagagggaaggtcagcgaggtgccgtatgagagatgaggctgggctgatgggcaccaaatgaacaaattatgatgggccccactcaatgtgatgaggtcaaatgcttgtttctacccactgacagttcaatttccctgaaatgtctctcggttctctatgagctaattatgaatgaaaagttatcaactgcccacaccaaagggggcttaaatactattttgtagagttcttaatgtcaaaatattgttcaaaacagcatgctgtcccactccaaatacaatgcttgggttaatgtaaataccagtgaaacactatcaattttcctcaggtttcccacaatgtatacataaagcaaattctccagcacttgtcagcttaacaacaaaataaagatcatttcatcaagtaaatctatattatacctacagctcatttccacagtaatagcagttcggtgcttatagttttgcatatcacaggctacataatcttcaaatagcactatatattttttcaggaacgatgctactggattattagcttctaggcatcaatactcagatttaccccagcatacagatttattatactaaatcagctcaacagcaattgacaaaatgtaaactccttttatggaacctcagtttttgaggaacaatttccacagcctgcattcatgatggacaattattttctttacatctataagcctaagtgcctacatcttcttttttgaatcctatgacacatggtaaatatttgattgaatgcaggatccaacaaattcttaaatagtatatggcctcaatcacagtaacacaaaaacagattgaagtgataacatttgctgaagccctactatgtgccattcactatgaaaagactttcacataggaatgtttaatataatacgtagtctagtagttttctagcaatctacgacacctataaaagcttggatcaatgaggttaaagtgtacatcaaataaaaaataaacaggatctgcataaaatatagtactgagcttaattttttttaaaaatgataaaatatgtaaacataataaagttgaaaatgacacttgtcaactttctaattaacactaggtggaaaaggagttttaggaatacgttctataagaaaaatggatttaaggtataaacataagaagtacttgcagggggggtcgggcaggaagagggaaagatcaattacaattcaggtaaacacagtggacattaaaaaaaaaaggagcatgaagtagggaaaaaattttgccatttaaaaagatcatgtacagatatatacaagtacatttttgggcaacttactaataatgaaagtttttagtgttaactgttgtttccacatttaacataatatgcttagatatacagtatcaatttatatgattccttaagaagcattaccttatatacgcatgtttagagatcacaatttaattcattcattaaaagaccctttctggaagttgattttttctaattcttattgtaattgcattgttctaatcttgtattataaaggcagctgcttgcctatcatttgtactttccttgttaatcctgactcagtgaattaacctttaattacagccgttaaaattgaaatgagcctcttgtctggctggggctgccccctttcagtgcatgattctgatgaaaatttttagggtcaatgaatatgtcccatgtcatgtctgatagctgctaaagatgtgaggaggtaaatgttaccttagaaagatgtgctttaaatttttagatctgctctattgacagaaaaataaaatcaaaatgttatttttcatttttcagcttaccatgctgtatttttagagagagcatttaagaaatataaagaatggaatattaagctacgtttagtcaaataatttaaagcaataacttaatccccattttactgtcttaaatattacatgctaagtaataaaaggaatgtgtaagtagcacaaccactttctagatatgggcttgatgggaataattctctcagtaatgtaataaactaacatattaaccagtggggaggggccaagatgactgactagaaacagctgtggtcagaggctttcaccaagaagaatgaaaatggtgagtgaatcctgcaccggcaactgaggtatctctcactgggactgactaggtggttggcacgacccacggagagtgaggagtagcagggtggagcaacagcccacacaggagccacatggggcaagaggagcttccacccccagccaagggaggtggtgagtgattgtactatcccgcccaggaaaccacgccttttccatggatctgtgcaagacgcagatcagaagatcccctcgtgagcccatgccaccagggccttgggtcccaagcacagctgtgcagactctcagtggcccctcggctggagactccctgagactcgtgagttcaagaggggcagccatcatcatacagctgcctgctgcctaagatgactgagctttggcaggggaaggggggcagctgccatcactgtggctgcctgctgcctaagaccaccgagctcccgggcaaggggcagcagccatcactgcagctccaggctgccgttttcccctgccagtgccggggagactgggcggtttggaccccggaggaattttccacagcgcagcacagtggctgtggcagatcatggccagactgcttctttagagtgaacatggacccattcctcctcactgagctgggcctccctgcaggaatttcagcaactccagccaggggtttagggacagaactctgatctccctggaacaaagccactctggggaagggcagccatggtcttggtggatcagtgcacttagtccttcccctcgctagctctgaggaatccgggcagtctggatgagtgggattcccgcccccgcacagagcaacccctccaccaagggttagccagagtgcttccttaagcaggtccctgatcctgtgctccctgactgggtgagatcttccaacaggggtcgctagacaccttacacaggagcattcctgctggcatcagattggtgcccctttgggatgaagctcccagaggaaagagaaggcagccatctttgctgttctgtagcctccactggtgacacctccaggtataggagggagcaaggacaatagggtctggagtgggccccagcaaactgcagcagctctacagaagaggggcccgactgttaaaagaaaaacaaacatcaagcaacaacagcatcaacaaaaaagtccccacaaaaactccatccaaaggtcagcagcctcaaagattggaggtaaagtcacaaagatgagaaagaatcaatgaaaaactgctggaaactcaaaaagccagagtgcctcttctcctcccaattaccacaacacctctccagcaagggtacagaactgggctgaggctgagatggatgaactgacagaagtaggctttagacggtgggtaataacgaactttgctgagctaaaggagcatgttctaacccaatgcaaagaagctaagaaccgtgataaaacactacaggagctgttaaccagaataaccagtttaggcaggaatataaatgacctgaaggaactgaaaaacacaacatgagaacttcacaatgcaacccacaagtatcaatagccaaacagaccaaccggaggaaagaatttctgagcttgaagactatcttgctgaaataagacaggcagacaaaattagagaaaaatgaatgaaaaggaacaaacaaaacctccaagaattatgggattatgtaaaaagacctaacctatgaatgattggggtacctaaaagagatggggagaatggaagaagttggaaaacatacttcaggatatcatccaggaaaacttccccagcctagcaagacaggccaacatgcaaattcagaaaatccagagaaccccagtaagatactccgtgagaagatcgaccccaagacactaatcgtcagatttaccaatgtcgaaatgaaagaaaaagtgtaagcgcagccagagagaaaggccagatcacctacaaagggaagcccatcagactgacagcagacctctcacagaaaccctacaagccagaagagaatggaggccaatattcaacattcttaaagaaaagaatttccaacccagaatttcatatctggccaaactaagcttcaaaaatctaccaaacaaatgaaaagcagaaaaaagcaggggttgaaatcctactttctgacaaaacagattttaaaccaacaaagatcaaaaaagacaaagaagggcattacataatggtaaaaggctcaattcaacaagaagagctaattaacctaaatatacacgtacctaatataggagcacccagattcataaaacaagctctcagaacctacaaagagacttaagactcccatatgataatagtgggtgactttaatatcccactgtcaatattagacagatcatcgagacacaaaatttaagaagataattcagaacttgaactcagctccggatcaagtggatctgatggatatctacagaactctccaccccaaaacaacagaatatacattcttctcagtgccacatggcacttactctaaaatcgatcacatcatcggaagtaaaacactcctcagcaaatgcaaaataagtgaaatcttaacagtctctcagactatagcgcaatcaaattggaattcaaggttaagaaattcactcgaaaccacacaactacatggaaattgaacaacctgctactgattgactcctgggtaaaaaattaaggcagaaatcaagaagttctttgaaaccaatgagaacaaagagaaaatgtaacagaatctctgggatgcagccaaagcagtgttaagagggaaatttatagcactaaatgcccacatcaaaaagctagaaagctctcaaattgacatcctaacatcataactaaaagaactagagaaccaagagcaaacaaaccccaaacctagcagaagacaagaaataaccaagatcagagcagaattgaaggagacagacacatgaaaaacccttcgaaaaaaaaaaaatcaatgaatccaggagctggttgtttgaaaaaaattaataaaagagaccactagctagactaataaagaagaaaagaggcctggtgtggtggctcacacctgtaatcccagcactttgggaggccaaagtgggcagattacctgacgtcaggagttggagaccagcctgaccaacatggagaaaccccatctctactaaaaatacaaaattagctgggcatggtggcacatgcctgcaatcccagctatcgggacgctaaggcaagagaatcgcttgaaccccggaggtggaggttgcagtgggtcaagatcatgccattgcactccagcctgggcaacaagggcaaaattccatctaaaagaagaagaagaagaaagcagaaagaagaagaaagaaggagaaggagaaggagaagaaggaagaggaggaggagcaggaggaagaatcaaatagatataataaaaaataatgaaggggatattaccactgaccccacagaaatacaaccatcagagactactataagcacctctatgcaaataaactagaaaatctagaagaaatgggtaaataccaagactgaaccaggaagaagttgaatccctgaacagatcaacaagttctgaaattgaggcagtaataaatagcctaccaaccccaaaaagcccaggaccagatggatttacagctgaattctaccagaaatataaagaggagatgataacctttcttctgaaactattccaaacaattgaaaaggagggattcctcactaattcattttatgaagacagcatcatcctgataccaaaacctgtcagagataacaacaaaaaaaaaagcaaacttcaggccaatatccctgatgaacatcaatgcaaaaatcctcaattaaatactggcaaatcaaatccagcagcacgtcagaaagcttacccaccatgattaagtcagcttcatccccagcatgcaaggcttgttcaacctatgcaaatcaataaacataattcatcacataaatagaactaaagacaaaaaccacaggattatctcaatagatgcagaaaaggcctttgacaaaattcaatattccttcctgttaaaaactctcaataaactaggtattgatggaacatacctcaaaataattaagagccatttatggcaaacccactgccaattatcatactgaatgggcaaaagctggaagcattcccattgaaaaccagcacaagacaaggatgctctctctcaccactcctattcaacatagtattggaagttctggtcaatcaggcaagagaaagaaatagagtattcaaataggaagagaggaagtcaaactgcctctgtttgcagatgacatgatcttatatctagaaaacccatcatctcagcccaaaagcttcttaagctgataaccaactttagcaaagtctcagtatacaaaatcaatgtgcaagaatcacaagcattcctatacaccaacaacagaaaagcagagggccaaataatgaatgaactcccattcacaattgctacaaagagagtaaaatacctatgaatatagctaacaagggaagtgaaggatctcttcaaggagaactacaaaccactgctcaaggaaatcagagaggacacaaacaaatggaaaaacattccatgctcatggataggaagaatcaatatcatgaaaatggccatactgcctaaagtaattcatggattcaatgctattcccattaaactaccattgacattcttcacaaaattagtaaaaactactttaaaattcatatggaaccaaaaagagcccgtatagccaagacaatcctaagcaaaaagaacaaagctggcggtatcactctacctgacttcaaactatactacaaggctacagtaacccaaatagactggtactggtacaaaaacagacacatagaccaatggaacaaaatggagaactcagaaataagaccataaatctacaaccatctgatctttgacaaaacggacaaaaacaagcaatagggaaagattccctatttaataaaaggtgctgggaaaactggctagccatatccagaaaattgatactagaccccttccttacaccttatacaaaaattaactcaagatggaataaaaacttaaatgtgattgggcaccgtggctcacacctgcaatcccagcactttgggaggctgaggcaggcggatcacctgaggtcaggagttcaagaacagcctggccaacatggtgaaaccccgtatctactaaaaatacaaaaattagccaggtatcgtggtgcacacctgtaatcccagatacttgggaggctgaggcaggagaattgcttgaacccaggaggcagaggatgcagtgagcagagatcacgctactgcactccagcctgggcaacagagtaagactccatctcaagaaaaaaaaaaaaaaaactaaaatgtaaaacccaaaactgtaaacaccctagaagaaaatctaggcaatatcatttaggacataggcacaggcaaagattttatgatgaaaacgtcaaaagcaactacaacaaaagcaaaaattgacaaatgggatttaattaaactaaagagcttctgcacagcaaaagaaactatcatcagggtgaacaagcaacctacagagtgggagaagatttttgcaatctatccatttgacaaaggtctgatatccagaatctaaaaggaaattaaacaaattaacaagaaaaaaacaaaaaaaaaaacattaaaaagtgggcaaaggacatgaacagacacttctcaaaagaagatatttatgtggccaacaaacatgaaagaaagctccatatcactgatcgttagagaaatgcaaagcaaaaccacaatgagataccatctcatgccagtcagaatggcgattaaaaagtcaagaaacgacagatgctggcgaagctatgaagaaataggaatgcttttacactgttggtggaaatgtaaactagttcaactattgtggaagacaatgaggttattcctcaaagatctagaggcagaaataccatttgacccaccaatcccattactgggtatatacccaaaggaatacaaataattctattataaagatccatgcacacatatgttcattgcagcactattcacaacaacaaagacatggaatcaacccaaatgcccatctatgatagactggataaagaaaatatggtacatatattccatgaaatactatgcagccataaaaaggaacaagatcatgtccttcacagggacatggctggagctggaagttattatcctcagcaaactaacacaggaacagaaaaccaaacaccgcatgttctcacttataagtgggagctgaacaatgagaacacatggacacagggaatggaacaacacccactggggcctgtcagggggcacgggaggagggggagtatcaggataaatagctaatgcatgctgggcttaatacctaggtgatgggttgatactgcagcaaaccaccacagcacatgtttacctatgtaacaaacctgcacatcttgcacatgtatcctggaacttaaaataaataaaataaaaataaataaacactcaaacaccaatggagttctttaaactgacagcagtgttaatgggttctatactgatgactctggaaaataggaagggttaattcattccaaacacatttgatgagcacctattatgtattaagcactgggaataaaaaaaggtcctgttctatcttccagaaacccagactccaatattattacatctatatttctaatgtaaaagacaaggcaacccttcccctatgctgatgatgtttactgaagccatttgaagtctctccacttactttctttagatttctagaaattttagagctggaagggactctagaatcctgttccctaatttcatagctaacagcctgaactgaatgtaaactttgatgtactagtttatatttacaagatattttgtcaggtcacatattctatgaagcatgaatgtcaaatcttcagtgaaaatatgtaaatgaatgagtttctgaaattacgcacttaaaaacgcattatgaaaaattttcaaatgtatacaggagcagggacactgatatgatgaacaactagatactgagcactaaatttcaaaattaccaacattagccaatcttgtttaatctaatcttttactcaacttctgaattattgaaaagcaaattccatgtattatttcatcagtaaatactttggtttgtatatgtaacagataaagattttgaaagaaaacatacaatattatcacatctaaaaatgatataaaacaaaaattcctctaatttcacctaaaatacagtattcacatttccttggccatttcacgcatatcattttagagataatcacaattcaagcaagatgaacacatttggctggtatcgcttttaaatctctcttaatctaaaggtatatgccttctgaattggaatttgctgaaattttctgttttgttttttggggggagtattatttgtacagaggtgtaaagcagattttccatattaacatttggaggggaaaagtcataaattcagtaatgaaaaacagctgcaaatttaaggaaaaacacttactgataggcttataaaagctgtatataattatattccctgaatgatttgagtaacaatgtgtctgatatattctttttttttttttttttttttttttttgagatggagtcccactgtgtcacccaggctggagtgcaatggtgcaatctccgctcattgcaacctccacctcccaggttcaggcaattctcctgcctcagcctcctgagtagctgggattaaaggcacaagccaccatgcccggcaaatttttgtatttttagtagagacagggtttcaccatgttgttcaggctggtcttgaactcctgacctcgtgatctgcctgcctcggcctcccaaagtgctgggattacaggcgtgagccaccacgcccagcccacgtctgatatattctaagttaagtggtttttacttttctttgatattagggttatatactgtacttgtttttactccatactctcttgtcagtggtaatcaattcttagtgttcattggacatgtattctacagctaaattcgtttctcttccttcgaagagaaataaaggttttgtaaatatcataacatcttccatgtttaggtcaggtttctcatgttaagagatttaatactattagaataagaattattaatttccataccatgccctgccctgtgttcagaaaaaaatttggcactgtttttaaggggaacagtggtaacagaagttaacttggctgacatgtaattaaataatatttgctatatgattgaccaatgcataatctaagataccataatgcttaaaaactatatttttcatttcaataccacaattcaacagtagcaacaaaatttgaaatatagcaattcatagtcacacaaaattccatcaaatttgtgtgactatgaactgccttttttaaatgcataatttcagactatgaactgttttttaaaagatagaatttcagaaactcatttatttacatattttcaccgaagatgacaaaactgccataaaagatgaatcttttaaaaacatattacatttttaaataaattatattttaaaaatcatcttatttcctactgtggtatatttaataataataattaaaagctaaaaatcataatcttagggaaaagtggatagatgttcagtgaactctcagctctgaaacaagtgaactcacagccagcagaactacttaccacaaaggaggaggaagggaagtcgaaaggcctaaggctttctttatcacaacctctttaatccttcaatttcttgcagatctgtgtgcatgtttcctttgtttttttgggtgacctgggttttttgccacaaataattgctagttcattaataactataattagcatctgattcagcggatttgtcactgtggggaattttactaaaatactaacaactaacattatgagtactatccgccagttaggacaaactggcacatatttgcttaagccaattaaaaatattttgcaataaaaaaattccaactaaaaattaataacaatctctttttaaaaagtagctccttttagtaatctaggaaaaggagagatgaaaatggtctgttatgagtacctcagaagtagcatagaaatagaaagatcaagcagcaggatgacataccttaaggtttaatttaagaattaaagcaacctcatacccagagaattgaataaaagaataagatggggcatggctaggcaatggaagcacaaaatactgtcacactttaatttaaaaatgttttcaattgaagcagacccaggccagtgatttttcattatttttaccacagttccatgactactgacattttcatcagaacaaataaaggatttttcctaaatttaaaatgacaaaattatttttaattttgacttacaatttctccctcttccaaactcaaaggaatttgatcttagctggacttgtctcttagcctggggcctgaatataccttaactttataaaatggaaaaaaaaaatttttttaaagatagttcttcaccgggcacggtggctcatgcctgtaatcccaccactttgggaggctgagacaggtggatcacctgaggttaggagttcgagaccagcctgaccaacatggagaaaccccatctctactaaaaatacaaaactagccgggcgtggtggcacatgcctcaggaggctgaggcaggagaactgcttgaacctgggaggcggaggttgcggtgagctgagattgcgccactgcactgcagcctgggcaacaaaagcaaaaccctgtctcaaaaaaaaaagatgattcttctactatattagaaaaactttatcatataattttttgaatgagatcacatattcatgaaatgtctggcatataacttagtaaacgtacatattcaacaaagacgtccctcaaagcaatctctccttgcagaccaacttgaaaaaagtctagcactctgccaatataagagattggaaaacaaaactaaaataccctagtagcaattaaaagagagtgaggagaactggtaggggggtggttggggaggatatatctaagataagactactcaagagaaactgaaatcctaaatacaatgcaactaacttcaatcacaatagttactattataatgcacaattatcctaataattccaaatactgttttagtagatttcagatggagtgaatcagatacttcttcatgaattatggtttgtttttttcttattattgttttaaaaccaacagagtgacttccataccaaaacaaaggaaaggcctgataagagtcttctgtttcccagttgagttcctacaacacaaactgggtcagggacttatccctaactcacggaagagttgtaactccactggctgccaattttcgacaatagcaaaaatccgtaagactacttgctagccaatttcccatattcctttgataaggaacctgataggacaaatgataaaaactgcagaagctacatttgctttgtggcttttctttgtaccactctgggtgcccaaattcaagtggattacaaatggggttgcttcttcctatccttcggcctataaatccatggggagctgaggggcatgagtacagggcttcttggtcatgctgccaaacttaacgtcatctttttgctggtcataggaaattccatgctagctactgatattccatgctagcttcaccctggcatggtcatcaagtgacaaagtgatggtcctcaatggtaattcaaggaaagcaaacggcgaagagtacggactatgaaaatcatccttctacttcttgctaaaggagaagagtagttcaggtatctaaatcttaagctgtgtcaaatattgaaagtaactcttttaggttttaagttataatggtacagaggaaaaaaggtggaaatgtggaatttagcaaatatcaaataatagtgtttatgttcataaccagagaaataatgacaaataaagacaacttgtatctacggatacttccaaatgggcaaaactgttacaaaaaggagagcacttggtatactgtaattacatactttgaggcaatttttctttattttcccagtcaactataaactttctcagggcaagaagctttcccatcttgtttaccactatatccatggcttcatattctggtctgaataaatacatgttggatgaataaaacacttaattggcatatgtgtagtaaggaatttgacctaacctaaagaggcttaggactttctcttagctcttgaggggcgacctctaaacccttggaatttccccagtgataaaagtgtctttgttattcatggtgggccctttgggaccacacctgataatttatgccactgaggtgactcatgacaggtccctcagatagcttatgctaaggagataactcaggataaggctggccaagatagaaagaccaaccatgtgattagagggttggggcgttgagctacttaatatcagcctgacctctagagacaggggagggctggagactgagttcaactatgtggctagagttcaaccatgtggcaatatttcaaacaatcaaggctatatgatgaagcctcaataaagactctggatgtcaaggttcagtgagcttccctggctggcaatagtccatgcatattgccagattttcatgccagtagggtaacccaaaagtttcacatttggaaccctcctagaatctgccctaggtgtgtcttcgtttggctggttctaatttgaatcattttgctaaaattgtaatcctaagcacagtgcttttctgagttctctgagttgttctagaaaattactgaactagagagtggttttgggaaatccgtaaagttacagctggtgtcagaaatcttgggccaacttagtctggaggactgtgcctttaaccttgagtttggctacctccaagaggcatacaacaacaaattaggcctttttgtttgtttcatggattgttcttgaaattccttactattcctcagtgtaccacttttgcattttgaaatgatcacttttcttaatgagccttcctgtactgtccaaaattaaattccacttagggtttgtgatccacaaggatcaaatctgttatctttatggtagctaagtcagagctccctcactaatttgccacaaatgggtcagaggtgtgctgcgatactgccccccatgaatccccaaggccaactggggtctgtggtagctggagctcctagactgggtgcctccaacctccttcagcattgtttaccctagaatgcattacaggtattgccacttttctacatgtaccggcacacaaaaagattggaaaacaagttaaggaatcattactacaattttcccatgacagtgcgtcaccaacatacttctcaagtatcagatctggttacacatgttatacttaaaccctacattgaaatactgtttcagcaatactccagttcttccacaccccaagccttcaggtatactagttcctcttctaggagcgtcattcttctactccagccacctaggcaaactcatcttccagactcagttccaaggttacatatgtatatcttctctaagagatctttgtcacccaggagaacttggtggatttgtctctagttcagcacttactacattaatgatttgactatttccctcagtaacctgtgagtttcctcataacacgctgctctatgactcacctccttctttcactgcttttatttggcttttttctttgttgtcttctaaagcatgatgttccctaggattccatcttcagttgtctcttctcacccacaaggtttcccttctgttcccctaccttaaaccattacccataacctgatggctttaggatgtgtgtgtatgcacacacatgtgcacatgcttgtattctaattagttggccctaatttttcactaaaatccagaatggattttaccttcttactggacatctctaacttgatgttccaaaagcacctcagagtaacatgttccaaagaaaatttcaatgtcattgtcctttcctcttccttattttctatcttggttaactgggtaccactatccagataatcattccggtgcaaatctcagttatctacctaaaagttaccaaattcttcctttgttctcttcctatccaattaatctttcacacaactttataaaacaaagatctgatcactatcaataacctgctctaaaatcttcagaactcctttcaactgtttcacaatatggctttcaaccagtagctacttctctctcccccaaaacatacattttgtacactagctatatctagctacagaatttggcaaaaacataatatacattttatcttctctctttcatctggccattccctgggctgaaatacgcatctcctcttcttccctgttggtaaactcaatcattctccaagacccaacacaaatatcgctatccaagtccatattgataggcactctttgcagaattacttgctcccttgtctgtactcctataatgaagttttctagtctttttcattcactaaactgtgagctcccttaggaagggactatgttttattaacctgttatctgtaattcctagcatagtgatttagtcatactgtgttcaataaagcttttaagtaaatgaaattaagctataataaagcctttcagtctgcatgtatgttagaatgcaaatatctagagaatctcactggtatctatgaacaacataaacattaggggaacatgtgttgttacctgccttacagatttcagatatgaaagctcttaggtattgcaaatttttattgactatattcatgaatacattgcaaaatgcaagccttaagtaatacagctagtattccaccatctgaaagtcagaccatctgtgtctggctttgccaaaggcaaatcctgctttaaactcatgttagaatactgtcaattcttcttactgaatgttttttaaaaaggtaccatccacaatcaactacatggctaacataagttaacatttttttttgaaataaaatctaaagggttgaaatatttctatttcattacaattttcttatataattccttggaacaggaatcttaagacattttcttttttacaaaagaattttacagaaataaaaccctcattaatctgaactctaattgagaatttaagaaaattaagcatggaatgaaggatggactaagtttgcaccatctaagaagcaaaagacctaccatggagcaaataagattttacaggacatataaatgcagttcattaattaaataattctaaggagtttaccacatacggtatatacaaagattgatttagtatataattctaaaggaaagcagaaagatatggaagaaaaggaatagaatttggaagcacaaaacccggactcaagtattaagtgtactattgatagttttattttagttatactttggattttagtatatatttaatgtagctcacatttataaaaacctgtatataaaataattcaggcaaagaagtataaagaatagattaaaacaaaaacaaaatccaacatccctcccccatcgagcatcatgagtaaaactttaaaaatctgaatgacaatcacaagtatacccatcccagattgctttcctttttgcttctggcatcagaggtaaccagaatttggatttggtgttcgccagttgcaagtatggttttaaacattttccacatatgtatgcatccatcaattaaataattctaaatacttttatactttctacaaatggcttcctatgtattcttttgtaattttcctatttatttatttatttgacaggtctcactctgtcacccaggctggagtgcagtggtgcgatcctggctcttgacaatctcagcctcctaggctcaagtgatcctcccacctcagcctcccgagtagctggaaccacaggtgtgtgccaccatgccctgctaatttttgtattttttatagagatggggttttgtcatgttgaccaggctggtctggaactcctgggctcaagcaatccgcctgcctcagcctcccaaagtgctgggattacaggtgtgagccactgtgcccagcctgtgatgtttcttactattgtttttgagatttgtctaacaggtatttccagttcattcattttaacaactggcacagtattccattgtatatgcatgccacaatttatgtatctattctagtgatagatgtagtttccaattttcttttttttttttctttttcttttttttttgctcttacaatgtgtcggtgaacattcttgcatgttttcatgtgtagccacatcgattagtgagtcatggagaatacattattcaactagagtgaatatttccaaattactctctgaaatacccactgggtatgcctccaatttttttttttttttttttttttttgcaaacacactgttaaaactaatttttagagaagcctacttttcaccactttaaaaattttaaaaataagcttcctgttttacaaaacccaacaaccctcacatgcaaccattcaataattgtaataagcacacatattttagatttgatttaaactaggttaatacaatcaatggtatgaaaatatgatcggtggaaaaacttttgattggctggtaactggatgaagtgaaaaccagctaaacaatggtttcaccaaaggtaccgtctctctttgatacacctgtgagcagacctgatgaagtatcaggtaagtaagttttcagctggagtaaaggatagcttgatcatttcaaaatacaaatggatggccctaagatcagggtttagggaaaagccatagatgttgattcagggtactcttgagttattattggccagacttgggagcattatccaataaccaattccctagtcttaaagaagagaaggcaaagaacaagatgagagatggcttaacccactgatatttggcttcagttcatggcatgctaatgttttcttcagcacagaatacgacacaaggaagagacatacttggatgcaagacgtgcaaattcctgccgagcctatttttcacagcattacttcatttttttttttttttttttttttttgagacggagtcttgctctgtcgcccaggctggagtgcagtggcgcgatctcggctcactgctagctccgcctcccgggttcacgccattctcctgcctcagcctcccgagtagctgggactacaggcgcccgccactgcgcccggctaattttttttgtatttttagtagagacggggtttcaccatggtctcgatctcctgacctcgtgatccgcccgcctcggccttccaaagtgccaggattacaggcgtgagccaccgcacccggcatacttcattattttatagaacgtgtgaattactgtaacactatccttggttgtattaaagaggtatataggaaacaaaaaaagtttgttattaaggaatagcatgtaccactcactgctccttttacattactttaggaatataactatctgtagttttttccttaactcggtaagacactgaaggtactcaagaaatttaactttcttttcccttttaagttctgaggaacagaaaaattatgaaatcaatcccaaacattttagagcaaactgatatttacttttagtatgaattctttgcaataaaaaaaaaaaacagttataatcccatcacaagctttcaggtttggcgtgcagtgacttctgcctgatttagatatgcccagtacaaaaatggccaactttgctgggcagactaagcaataatcctttctgtacaataagggtttttcagtccctgattctgcagatcctggtgcttcctgaggaccttatgttttttgtttcactgagtcgcttttcctgcatagttctagtatccaatttgagggcgggaggaagggaaagaaatggaataggtgacatcaaccctatgttattactgaacataaaggccttggagcctctctaccctgtcaatcccaattttgactgaatccttcctcctatagtctacatccaggccaagatcctcaaatctgaatctattatctgttgccaaatcactattccacttgttccacggccattggactagatttcagggtttacagctacagaatagaattcaaacattttcaggatcattatttcattttgccattggactagatttcagggtttacagctacagaatagaattcaaacattttcgggatcattatttcatttgattttcataacaaaaaaagtgtttgggaaaagtattatctccattttgtaaattaaaaaacggaagtttacgcaagtcaaagaactgctcaaagtcacaatgataataaacacagctcaggcaagggtgaaaaccaggtctttgggctccagattcaatgcatttcacaaatgtcactctgtctttctaaatgagttcttagcattttaaggtggaactctaaaagtgtatttccacagaaaacctctgacttgttattaggtgttaaagaatcacagatagtatatctccattatggtattatgacatttggggattgccttgggaacccttttttttttttagacggagtttcgctcttgttgctcaagctggagtgcagtggcgcgatcttggctcactgcaacctccgccttccgggtttaagcaattctcctgtctcagcctcccaagtagctgggattacaggcacacgccaccaccccaggctaattttttatatttttagtagaaacggggtttcaccatgttagccaggctggtctcgaactcctgacctcagctgacccacctgcctcggcctcccaaagtgttgggattacaggtgtgagccaccgcgcccggccacgttgagaacctattaacctaggaaggtcagactctgatttttccataaaaacataatcttaaatagtgagtaaataaatatattttcttacacaactagtttgataagaaacaaaaaacgcaaaggatgagtcaaggtttcatgttgatgtttaccagttaaagcagaacatacactaaaatagttaactttaactgttttattcacttaaaatttttgtgacccaaatatacaaagtaatttaaagcacaacagatcaaagtttcactcaacatttctaataccagaggtgaacaagttattcttatttcacatttattcttacacacaaaattgtcttttttccccctattcttttttcatccctgcaagaagcatacattttaaggattgatgtttatgtgtttgcaggtcttgatttaaactcaggaccaaataataatccattaaaaaaaatttactaagttaaccggtttgttcactcagatactacagcaggaaataaaatgttccctcaatagagctatctgttggccaatggccagtctctggcaagactaaaacatgctgtgtttataaataatatttattatagagttattaaaaaaactaaagcctttccttataatgataataatgtttgtcaggcattattttttaaaatctctgtgttctgaatatataattaaaaggataggaacaaatagtgacttttttaattagaaaaatatttgctgtgaaaaagcaattgttctttgggtttcactgtaaatattttgttaattgaaaaaatctaatatacataaggaaaacaaataacatttactagaataaataaaaattatagatggactagaaagtcatcatttaaactaaaaaagtttcatctctttattttaacaaacttattcaaattatcccagtgaaattattttcattaatttgaaattccatcttaggttcatacacacatagaatatcagagttaaaaggaaacatggaaatctgccttgctatcatttcatagttgaaaaaaaaccaagtgatttgctcaatatcacccaattaattagtagtggtgatctagaaagacagatatcagatgggtcaataaaaaggaatctggttgagtgtggtggctcacttgagcccaggagtttgagaccagcctgggcaacatggtgaaaccctagctctaccaacaaaaattaaaaaattagccaataaattagccatatctaccaacaaaaatataaaaattagggtgtggtggcaggtggctgtagtcccagctactcaggaggctgaggtagaaggatggcttgaacccaggaagcagaggttgcagtgagccaagatcacaccaatgtactccaacctgggcgacagagccagaccctgtcaaaaaaaaaaaaaaaaaaaaaaaaagaaaagaagagaaaaggaagaggaaaaggaaaaggaaaggaaaaagacccaaacaaataaaaaggaatcctcgtcattcatatatgtgctttccatttctattttacaagtattgctttttgggtaatagatgtattacatcttgattagagaaaatctggaaaatatttaaaaatatgcagaagaaaattaaatataaaacatccataatctcatcattcagaaaagctgttaaaattatgatgcagtttcttctactctttcaatttccttgtatttgaaaacagtacaattgtacaattttacaaaatttagattatatatataacattttgtatccttttttccatctgacattataccatattttatcttattaaaatatgtaataaaaacatcttaataattgtacaaaattccttaaattgtttttgcatactttttgtaaccatcactactatcactagacatttaggtttgaacaaccatgcacataaatctgtgtaattctaattatttccttagaagaagaatctagacatgagattacctggtcaaaaggtatacatattttgatggctttttatacagatggcccaactgccatccagaatgatgtcataatttatacttttaccagtggagcagtgtataatgcctgcttcattgcatacctcagcaacaacagatgttggtttttgtaatttttgctaatgttacaggcaagatggttctttaattctacattttttcattactaccactgaacctttttcgcatattatcatctatatttcctcctctatgaataatgtgtttatatcatttgtccacttttaaaaatattttattgaagtagaatatacataaagtacacatatcttaagtgcaaagctcaatgatatttttcataaactgaatacacccatgtaacagcccccagatcaaaagacagaacattatcagcaccccagaagctactcttgtatttccttataagcactaattctcctacgagtaagcactattctgatttgttataccataaattaatttttccagttctagtccttttgctcatttttatagtaataatttgttttaaaaagttatcattatattattataaaacatttaaacattacagaaaagaaccaaaacaatcaacaagtcattctgaaaccattccatctaaagtaactgttaaccatggtgaacgtgacatttctgtaaccactgacagatacacagagaaacagacaaattatcccttagaatgggactataatcttactttgaagaaaaagaaatggaattaaaaccaaaaaataaaaaaccctccaaaacatcagatagatgttctttgagtatatacaaatcattaagaggtttgcatttcattaaaaacaaaaacaaaagcggtttcaattttgcatattacggagtgttttcctacctacatcgaaaaaataattaccatgcatcctgtcatctttccccaccttctagttttggtttcttatttttatcatttatactcaatcacatgatcacaatttttatagctactgattctattactttgaatcaccctttccttggtttcaacaatcagcagtatccccactcttttttctttaaagtagaatccatagtaattttcatgtttcagcatatctatgtacagccttaatagtaagaagaaaacacagttttcttgggtcacacttcatttcctttataaagctgcactaatgatgtacgtgtaatgaaaatgataacaggaaatatttagttattagtacatatcaggtactgtcataaacatttcatgtttgttaatcatttaataccaacaacaatcctatgaggtaggtagcatgatcattttacagatgaaaataatggaggcactgggaggtaaactggcttgcccgaagtctctaatttgtaaagcgcagaactctgacttgaacacaggtggtctgaatcaagagcctgtggttttcactgctacataatgctttgacgtttacaactagaacacaaccggagggagggacagtaaaagatgccactagctttaaggagtgaaggccaggaatgctagatgttcgtagtaatgaatagggcagatcctgacgatacagactgtaccatgtccctcacaaaagctctgtttcctactatgagaaaatgaaactattaacattcaactgtctcattagacacgttaaacacgttggacaacgtgcttaaaattactcaatcctagaacatttcatataaaatacgaagttttttttttctttggcaagattttaacaggctcaattttccagggatgcaagtactttggtgcagaaaaactgttcagtgtttggaaaattatgtcactgatggaaataccacaacccgtagcatttgcgttgccgaataacacacctatatcaatctgcacatatagttctcacattcatgagttctatatacgagtgccagcatcatttaactacttctagtgtagtcatggtcaaacagttacatatcattgaaaatattagtttattatatattacttttattttttctattcaactaggacaacatgttgactttaaaattatagatgtactctatcatctatgaacttcatttcaggatccaaaaaagctcctagacttgttgagatctcacagcattatatgggagttgtaattcttgaggggttttctttattttcctctgatgtcttctgtccacttctttccaaattcagacacataatgaggaagcttaaactctggttgattcatcttcttttctcagtactgttctgagggctggatgtgctattaggagccatgacattctgcagtagaatattcagtttatttctacacgttccatttttcagagttctagcattttctttgtttaaagttctattcctgtccatattttattgttgctggtgaacttctggttgtcattctttttagcgctacttgtttgatcattttgttagcttttggggagtgagtgttgtggtcctgcttcactcagccgtgtcaactggcggtcattttttgcccaactttagatggagtgcttttctttcctttgaagagaccatctcaataaatactttccttagtataaaagggtgagtctgtcaattactttgtgatgaatgaaaatttactacaagcttttctaatctcaactgctttcttcttattattaataaagtagaagagtctacactcagagtccattatcacatatcgtatcactttggagaatattcgttaatatttactgagtaatgacaatgtgtcagtcactgttctaagagctttgcatatattatttcattaatctcataacaatcctatgcggtagatagtattctcttaggaaaatgaggtgtaaaagtaccaatttgcccacagtcacatagctattaagtggcaaagcaggggtttgcaccctggacatctgatatcagggcccaagttattatttattcactaccttactgccaaccaaggttttagggacctcctgttccattcaaggaactaactgcttcactattgattttttgattaacactttttctttagagactaccacaaatgctcaataaatatttattacctgaataaataaaagacttaactgcttattttcaatgcttctccctcatatcttttaatgtgtcttttccttttagaaacaagggcaaattaaaatcacaaataccattcttactcatttctgggtggttaagagataatctcattctatgcttaaggagaacattgtagcttaaaacttttcacctgtactttctgagcgaggtgaccaatgttgaacagaaatgcagatagctttttttagtatttcattgcatagccctgatagcatatttgctttaaaggaggaattttttccataataacacacaagaattaaacacttcttttctcccacttttggcagaagcagctctatgctcccaggcagctcagatgatcagttatatgccatgtagtaccctgccagccctgagaaccagatctattgaagctacctatgcccatcaaagcttactattctgtctcttagtctgtcagatttctgacaacaaattaacaggaggtcaagcatatcaacagattatacatcttaggcgcagcgtgcttgatttacagtgaaaagttagtggatataatatgctaacacaataaacagttgttgcagcttcaaataccatgatatgttgacggtttttgcattattttgtgacaggtaggttctagcctcacttcacatcacattctataaataacattaaagaataattttaaagacaccaacacatgtaaataaatgtacaaaaataagacagaaaaaaaaatcttgaacttttaaataaaaacagtcatgaatttttaatagtctatgaaaaaatagtgtggtaggaataaaacgattacggaaatgaaagtctgttaatgtagacaactttttgtggcacagttcaggtatatgtactgcgtcaatgtggtgaagaacctttgtatgttacagatatataacaataccagagaaaaacatacagatgataattaagtgtggacaacaagggaaaaaaattgagaagataatggtttgagtaaattatttaaaaaattaaaaggtcttagctaaattgggcttgttcttagagaagaatctgttcaaaactaagaatccacttcaagtatttacattttaataaaaaagatacaatggcaacataagaaaaccgagctggtggattttaaaaataacttacactgatgactgaagaggaagttgacaagtgtaaaccttcaagatcagccatcaaacttggagaaagagctggtgtgggaagtgcaactggagtggatactgggttaactgtaagaaaaggcccaaattagtaaatgtgcatgaacgtttaattcaaattattaaaagcaacatttttattttgttagtaaatctaattaaattactttgattaataaatgtatgacaattctatttaacatcttgatttagtcaacttattatcaagtcatggcagttattagtcttagctttcaaaacataatggcaaatcctataacaaaataaggatataaatatcttgagtaatagtttgtgaaaatttttatcacataacattatcactaacatttatcacccagtaatctccctaaaaaagtaaagaaacattttttttccagactatcataagaataacaaccgcttccaagagaatgctgcagtggaattagaagtcttgaaagatgttcaaatcctatatctattttattctccactctaatcaggctacctaattcccttgtaattatactttttcagcaaaagctatgtgctagatagaaatgtttgactgattctaaaactgctatatacttgagaactgatacctgtaagtttggaaatcttctaaaaatgcaagtctggtcatgttactcccctgcttaagactcttcaaaggctcataactgcctacaagataaaagcccaactcctcaattaagttcacaaagtcctctatggtctgccccagcccaaacagcccttcctatgctaatggaaatgttctacatttgataaagtggacactagccacatatgcctaacatactcttgatatgtggctagtatgactaaataaatgcattttaaactttgcataatttaagtaattacatgtggcttgtggccgccatactggactattcaggtccagcttatctccaatttcagcattgttatgcactagctctatgggataatagttcccaagatcttgttctacgtcttggagccttttatattctactctgtttgcctacttctctgccttgctcatcttgcaacttcgatctggcaagctaccctttaaaaggaaaacactctctggctcacctgcaaacagcttatatgtgccttctttgttccacagatatacttgaacaaacttctataactgtacttctcatgtaatacaaatttgtgtctttacatgtttgcatttctgctagtctgtgtgaacagacaataacattaatttttggtgtttctaaaccatttgaataaaatacattacaatgtggtcaagttttagcttccaacaaattctcattccaagataataccctaaagggaataacatttagttaatttgacatttctttttttatttttatttttggagatagggtcttgctctgttgcccaggctggagtaaagcggtgcaatcccttcctgggcccaagcaatctcagcctcctgagtaagtgcatgccaccatacccagccttttttttttattttttattttatttttttttagagatgggatctccccatgttgtccaggctggtcgctaactcctaggctcaggcaatcttcctaccttggcctcccaaactgctgggattacaggcgtgtgccacaacacccagctgtgacattacttttcaaagcatctttttctcatttcagtctcacaatatccagtgaacaaggcagaacaaatattaatccgtaaagttaacaacaaatatttattctgaaaggtagcaagtgagagacaaaaaagttcaagatcctcaagtaacaaaacctaattaagaaaaagagatacatgtatttgacaaaaaaaaaaaaaaaaaagtaacaatacagtccataaatgatacggccaaagaagaaaaatttcaaaggaaacactaaacaaaatctcaacatatataatagagaaagcagcctggaggttggatggggagggagtggagctcttggtcttccctacgctcacttagtacggctgaagcacagcttcaaacccccaggcttccttagacccacactgaaaaccccggtacagtttagcaagtgtcacagagtcaggggcaaaacaaggatcactggagaaggagtggaagaggaggcttcatgaacaggagggaatgaagtccaatttttaagtaagagtgagatttgaataagaggaaagaaagaagccagttaattgttggataacagaatgctataaacaaaggctgagaggtaggaaattgaaaaactaaggggactggatttatcctatagaccaaggggaacagtcaaaaatcgatcaaacagaggaatgacaatgaatatggtcctgcaggatggttaatcagatggcagtacaatgcacagactgaaggcagggttgggagtagggaagaatttacaatagtttaggaatgaagtgaaaaagactaaagtaagccaatggcaatgagaaggcttaaaaagagcatttaatattgaagacactggaaactgagccacagggagattaatattgacaaggtcataaaaagtgaatggtagaaccactatagaattagaaactgcttcttctaacttggatcataatatgttgccttcccatgcaacacgtaacttttcaggtaagttctaaatgcatgtttattcattcctttgtacatctatctacccacccgtccaccatctgtcctttcaaaatattagaatgcccatgtaacgaataaaaaactgaataagaaacagcctctgatttcaactgtggcttggctaaataccatcaagagacaagagaagaaacttcacaccacaagcaagttctgctgttttttaaaaaaggatgggttttaatataatttcagaagatgtgtgctctggtattaaagagatgattatgcatctgtttgcaggtatggcaagatgaaagttggcattgaaagcttaccctaaagtgaattctgaggctaggtgactgtgctgaagtatttaattagtaatgtgtaaaaacaaagtgactctatggggtttttaaaaaaaatgtcatagtatacaagttaaaatgaaatatcatgcccacctggcaaattagaaaaggtaattttaaaatacaaaatctagcattggtgaaggtacaaggaatatagcaccctcatattaatactgtgtaagctggtacaagctttctgaaaggcaattttatttacttatttttgaggagtttctctgtcactcaggctggagtggagtggcataatcacagctcagtgcagccttgaatttctggactcaagcaatcctcccgcctcagcctcctgagtagctagtattacaggtgtatgccaccatgccccgctaatttttctatctttttgtagagacaggagtctcactttgttgtccaggctggtctcgaactcccaacttcaagcagtcctcctgtctcagcctcccaagtagctgggattacaggcatgagccaccatgccaagcctaaaaggcaattttggacaaacaaattcttcaaagtctttgttccagcaatactacttctggaaatttatcttaaggaaacagttacagagatattgaaaaatatatttacaatgatgaatgttacttcactaattatgatagcaaaaaatggaaaacagctaaattcccaacaacagtaaatctgttaaacagaatttgttctaacaggataaaggacaaccatacagttataaagaacgtaggttttgttttgtttttggaaatagggtcttgctctgtcactcaggctggagtgcaatggcacaattgcagctcactacagccttgacctcctggggcttaagcaatcctcccgccttggcctccaaagtgctagattatagacatgagccaccacaccaactaagaacatgtactttaaacagaggagaaagcaagtgataaaacagtttctcagtagaatccaatttggaaggggggatttgcatatgaagagaatctaaactgatatgtcagaatgttaacctggggtgtttggattacaggttaattttattttcttctttttattttaaaaactttctataaaacttttttcttttctaaaagtagatctaatacagtaattattcaattattcttctgatcaaagctttgccttaagatttaagaataagaaaaactgaatacataatggcttaatatgttgttatttaatttgtaatttgctgcatcatctgcatcattggcatcatcagcaccagcatcatcactaaacccagtaatgcctatcatgtgttaggcacagttctaaatgcttttacgtatatcaagtcatttcatcctttgagaattaaatgactcccaaaagtatttgtaccatcccaattttatagacaaagcagctaaagcatggagagattaagtaaattgcccaagatgtcacaactagtgagtaacagagctgggattgaaactcagacagcttgctccactgtcctcttagtgactccactctactgccttgaccaaaattcactcaacaatgtgatatcacatatcataaggcttatttgaagtatgattattgttggctgacagagattttttaaatatttcactgtcagttgtactaacaatgtaatgacataggtttacatttcctataaaagaacactagaatatgatcactgatttgtgatcgtcctactgagagcacatggtatggggtcctaaaatatattgtttaatttccaggaatataaaatatgcctgaaacatagaaagcatattgatatctctaagtctaacaaaagactgttaggtcatatattatcctagaacaaatgttttcttatgtattgttaactgacccccatgaaaaagagtcatataacttaatgatctaaagaaactgtggaagttttatagtctttaaaaaaattacaaatgaataaaatgagacacaaagaaaccactaaaccgattaaaagcataggactaatacctgtgctcatgataacattccctcaacagatataatagagaaatagtaagagaaataaccaaattgttttgtagtagagtcagtctattgctagggttgctgccttagagacagacaatcattatttctggtagtagcaagctctttccctcctccataactttattctgcctagtataccctcccctcatgcctctaacagcttgactgactctttttttctttcttttttctttttttgtagtggaatatcactctgtcacccaggctggagtgcagtggtgtgatcttggctcactggaacctccgcctcccaggtttaagcaattctcctgctgcagcctcccgagtaactgggattacaggtgtgcaccaccacgcctggctaatttttctatttttagtagagacagggtttcaccatgttggccaggctggtatcaatctcttggcctcaggtgatctgcccgcctcggcctcccaaagtgctggtattacaagtgtgagccaccaggcctggccaactgatgctttcttaaactcaactcaaaagttaaattttgataccgctaggtggattaggaaccttgatactgaacagtattttgtgcatttctcctcatttcatctataatgcggcaatctaattgccagtttatctgtttttcccattacactttgagagttccttgggtagggacaatattttattcatttagaatctccagtatgtagcagattacaaagatcacagcaagtattaaattaacatttcctgaatgaagaaatgaagaaattcagtacttgcagtcttcctggtatgcactgtgtacctagcaaacaacctgtgtggattatgatgtgcctcttagataaaccacagggaatgtgtctggccttctttcaagattaatctaattctcacagttgagaactaaagccactggagagtaacattttagtatctgagcaacaaactgcatgccatgggcaatggagaaccattgcaggctaataggaggcatacagtgaagttggcactctgcttgtctttatctctaagctcagatcatggttccttcacaaggtttttgtagttttttaatttggggttaatgaaaaccctgaagaggggttttcatctccctctctgtttcttcactatactttgcatctctattttctctcgtatgcaatagttatttgtcctgttatctgtgtctctgactagattttagtttttggaagggaatgactaaattctatttatctattacagcacctactaaagtaccttgcacttagcagacaatccagaaaacacaggctgaactgacttgttaacaagagagtttcaagtgtcgtttctgacaaaagcaggactatgaaagatttttaaagaaatagcacttgggtattaaaaacaaagagaaacactatatcctatattgagttaaaaaatgtaggttgggatcaaagttcccttaaaattcaaaaaaactttcatttcaattcttaaaaacttgatttttttaaaaagcttgtgtccctgtccctctccctttccctctccctctccccacggtctccctctgatgccgagctgaagctggactgtactgctgccatctcggctcactgcaacctccctgcctgattctcctgcctcagcctgccgagtgcctgcgatggcaggcgcgcgccgccatgcctggctggttttcgtatttttttggtggagacggggtttcgctgtgttggccgggctgatctccagctcctaaccgcgagtgatccgccagccttggcctccagaggtgccgggattgcagacagtgtctggttcacttagtgctcaatggtgcccaggctggagtgcagtggcatgatcttggctcgctacaacctccacctcccagccacctgccttggcctcccaaagcgtccagagtgcagcctctgcccggccgccaccccgtctaggaagtgaggagcgtctctgcctggccgcccatcgtctgggatgtgaggagcccctctgcctggctgcccagtctggaaagtgaggagcgtctctgcccggccaccatcccatctaggaagtgaggagcgtctctgcccggccgcccatcgtctgagatgtggggagcgcctttgccccgccgccccatctgggatgtgaggagcgcctctgcccggccgcgactccgtctgggaggtgaggagcgtctctgcccagccgccccatctgagaagggaggagaccctccacccggcaactgccccgtctgagaagtgaggagcccctccgcccggcagccgccccgtctgggaagtgaggagcgtctccgcccggcagccgccccgtccgggagggagggggggctcagcccccgccaggccagccgccccgtccgggagggaggtagggggtcagccccccgcccggccagccgccctgtccgggaggtgaggggcgcctctgcccagccgcccctactgggaagtgaggagtccctctgcccggccagccgccctgtccgggagggaggtgggggggtcagccccccgcccggccagccgccccgtccgggagggaggttggggggtcagccccccgcccggccagccgccccgtccgggagggaggtagggggtcagccccccacccggccagccgccccgtccgggaggtgaggggcgcctctgcccagctgcccctactgggaagtgaggagcccctctgcccggccagccaccccgtccgggagggaggtgggggggtcagccccccgcccggccagccaccccgtccgggagggaggtgggggggtcagccccccgcccggccagcagccccgtccgggagggaggtgggggggtcagccccctgcccggccagccgccctgtccgggagggaggtagggggtcagccccccgcccggccagccgcctcgtccgggaggtgaggggtgcctctgcccggccgcccctactgggaagtgaggagcccctctgcccggccagccgccccgtccgggagggaggtgggggggtcagccccccgcccggccagccgccccgtccgggagggaggtagggggtcagccccccgcccggccagccgccccgtccgggagggaggtgggggggtcagccccctgcccggccagccgccccgtccgggagggaggtgggggggtcagccccccgcccggccagccgcctcgtccaggaggtgaggggcgcctctgccaggccgcccctactgggaagtgaggagcccctctgcccggccaccaccccgtctgggaggtgtgcccaacagctcattgagaacgggccatgatgacaatggtggttttgtggaatagaaagcggggaaaggtggggaaaagattgagaaatcggatggttgcggtgtctgtgtagaaagaggtagacatgggagacttttcattttgttctgtactaagaaaaattcttctgccttgggatcctgttgatcctgtgaccttaccccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccggggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaataaaaataaataaataaaaaataaaaaaaaaaagcttgtatctcaacatataaaaatatacttttttatagaatggaactataacaattatgtcattttataggtttttctttttttaccgtagttgccaggaaatccagagttgaatataagaagaaaaagttgtaattagtacactctagtaccttgtaacatttactcttagttcccttttaaatgtactttactgttattcttttacaattttaaactttgtaaattatgaaggttacaaacatacatatgtaagatattcaaatgtcacagaaagatacaaaatataaaatgaaagtcttattcttgtctgttcccaggttagtcctacatcacaaggaggccagagctaaccactgaacaatgctgcaatgaaatttttgtatatgcccttatatgttttattaattcaagcaatatttactgggtgcccactaactgccaggagccactctgtacactaggaatagcagtgagcaacacagagaccctgtcctcatggaacttacatcttagttgggagaaagagacaataatcaagtaccaaaattttaaggtaatttcagatagtgaaaaatgccatgaagacaagaatgacaagaataacaagaataacaagaaggtttgtgctatggtctgaacatttatgtccctccaaaattcgtgttgaaacctaatccagactatggtggggcctttagtaggtaattaggttataggggttctaccctcatgaatgggattattgcccttataaaagtggtatgagggatggtgtttcctccttctgtcacatgaggaaacagaagtcactatctctgaagcagagctagccctcacctatcatcaaatacgctggcaccttgatcttggacttcccagcctccagaactacgaacaactaatttctgctgtttataaattacccagtctaacgtattctgttatgccagctcaaagggactaggacagtgtgtaagagtaggtgacttctgagttggggaagtaaggatcagtcaattgttctcagcaggggaacagcagtagaaaggcccttggcagaaatgagcctggtatgtgtgacaaatgcataaaaacagagtaggatgaaatgtggataacaagaagacaggggtcagatcatctacagtctgagaaacctgggaaaggagtatgggctttcatctaaatgcaaaattaagccattaaattcaagggtttaaaacaagaaagaaataagatctgattttatcagtagtttatcagtaggataaatttctggaaaagaactgctaggtcagtggggcgtggtggctcacacctgtaatcccagcacgttgggaagccgaggtgggtggatcacgaggtcaggaaatcaagatcatcctggctaacacagtgaaacccgcctctactaaaaaaaaatacaaaaaattagctgggcgtgatggtagtcccagctactcaggaggctgaggcaggagaactgctcgaacccagaaggtggaggttgcagtgagccgaggtagtgccactacactccagcctgggcaacaaagtgagattccgtctcggggggcggggaagaactgctaggtgaaagggtatgtgcaatttaagttttgatagatattgctaaaatgactccaaagagctgtacctatttatattcctatcaaaaacatgtacttctgtttctccaaatcttagcaacactggatgataccaaacctcaaaatcttagccaatgtgtaaaacatgattcaaatttaactccaattttatttttagtttctctgttatttctctctattatatattttaatttctctatattaagtatatgccatggctactggggacagggcaggtaacagtataaacagaacagatctatgacagaatgagataacctaaaacataactcactctcagcatagaaaaactctatcaaaaatgatagtagtttaatattcatgaaatctcacttcttgttactcttctcctagtgcaacaaagtaccactatctctctctcactatgcaggaggatttaaggggaggtggtaaatacatatatctttgtacacttgggtgaatatatttgtaggattctgaattcttagatttgctgggacaaagattttttgcagttaaaagactgagaggtatagccaaactggcctccaaaggctttgtaacccatttccattcctactgaaattgtgccaagtggaagatggtgatgtcctttccatttttatttacattccttaatcctctacctccttaagttacatgtgtcaatccccataatccacatttcacaatgtagaagttataaggtatggatgactatttagcaaacaagtataaattactaaagcaaaagattttaaaatgaattttgtgtacttgtatttggccatctatatttgttcatgtgataatgaagtgatatgctgaatagatgaaagaaacaaataccactgatttccaaaactttcttgccttattcatctataagtctttcacaataaatattgatatattttgggacatgtaaatgaaaggtactataaaaataaaaaatactcttactaaacacagaagaaatattttaaattacaatacttacaatcatccagatctagaagtgaaacatctttggtaagaggagttctatcttgctttgttttcttttctttctcctataaaataacaaatatttcatttatcacacgttctgttttaaaaatctgtggagtagtccttaatattccaaaacaaacttttttttcctctgcttagtggtaccaacaaattaaacttctgtatggttatataaaatgttttcctgaatcaacatttgtctcaattagcatatagtatttcttacccactatgcaaactcttaaactattttgtgtttaaaaattataaatgtcagaacaaaatttaaaggtatgtaattattctacaatcggacaacttcttgctaacataaaaacgtaaagtggctctttggtagaaagtccacaaatattcttgaaaataacttttaaacaggtttacttaagaaaaagaaataacatatgcatagctcagatatttttgatgggcttgtgataggtcagccttttctgatatagtttgtgacaggcattgtactagatattttatgtttctatactgggttgtatcaaacttctttgccaaagatattcattaaaatctataaatgacattcccaggctctttctttttagagttgaaaggactcactcacttgatctactgttttgttgagaaaataaatatttcaaaaacatatctgcatataactagggcttcccccagcagagatttgcttattcggtctactgtacttacaaaatgtatatatccatgaactagaatacagtgcccctaagcctgaactgttcacagtttggttagatattcagaaaaaatttgtaaatcttttaaaaagaaaacagtattaagtgcattacaaacaactaaaggccaacaaagagtagggcgttaaatataattgagtcaaagtttatctttctaatctatactattttttacattaaattttctcaatcacagaccaaaactaaagtttctactaaaatgtttttgtttatttaatcattcattcattcaataggtatgtatagaattttaaatatatattagattctgtgccaagcaatggaaataacagccaagatagatatagtcctgccttcaaataacttataatttaccaaaagtctatagcttattgctaatgtgctaataaatatttttgaagtattcctctagccacgagacggtaccactaaagcaaaatatattttatcactatttaaagtttacacagtgttagagctcctacaacagtgcacatacatgaacaaaagcattacgtaaaattatacataggtaacattttaaaataatttaaatttcacttgttttttcccttgtcctgatactcagaaacttcaaggaccacataataatatacattattaatacacttaaaaaggcactaattttattcttcaaagtaattatttttatcactgaacactccacatcatctagttgttttaattttcattccttatttaaaaatgaacgaaacagtatttgtccctctctccatttctcaaatgagtaaacaatgtctaagatggtgaaaaaaatagaagaaacattagttttgaagctaaaatttaaaagttgcaagtaaatgaaaacaagtgcagaatgaaaatgctgtctcaactagaatatcattcctgtgaagaaagaacatataacaaaaagagcataccatcatgtgacttatcaaaatgctatgctgagcacaatgggtgtagcttcctataagctacaatggtgcatgactgtctttatggaactgtaacctccccacctgaaaaattagaaacctatcaaatcaagataaagttaaagctgaaggcaagtctataccttaatttctacttcacagccaagagtgtgtaacaatatctattaaatacatatcaggtcacatataacacagaacagagctgcatgtgaaattggcataatctcttattagaagcctagaacagagagaaaaaaggctttcaaaaggacagaatttcattgactttctgagaacagcaaataaccagtgactgaaatataacattagcaatagataatggtcatttctactgaattggaaaacccttgcattctgaatcaacgctataaaatgcttcatgatgtgtttggtattcctcttatatttcatttttcattttaaaaaatccatagtaagttcaaaacattttcatacttaaaggatctactataaaaataaaattctgaattctaaacgaagaagttaagagctctattccatcaaacatttctccatttgcaattcatcttggtaatagagacagaacctgggtaaatgcatataggacttgaggcaggagatttttcttgctcaatgcataattcatgtgctccgcctgcaaagtgtgtaaaatgagaatttcacaccgcagcatgagccatggagctgcagagaaaaggcagatgaaatcatattttactgtgcgattttatttcttaccctcccaatatttatacaaaaccatcatcgacaaaccaaacacattgacagatcacccactgtttccattgtgttagtacttgagaagagatcaggcagaaagatagacaatttgtttttgtatatttttttaaatagaggattaggcttttaacagctgagtgactgtattagacttttataaggacaacagtaactgatcttagaatctcaccacaaaaaatacctagttatcaattcatcatcctcaaatctccattttgtttctatggtattcaattatacacctcaacacatcaacattttcaaaatgcaatacaaagtcacagggtcaaaaaaactgatttctatttaatgtatttcacttcaaataataaataaaagatcctggaaatacttattaacctccaaataatacaaacaaaaatatgttacaatacacctgaaaagatttgttaatgtattatgcatgttcattttcatgctgattaaaaaaaaggcaaatagcaaaaaagatctgacatgacaagcatcaaatatgcattctaagaggaaaccattgtaaagaggtttgaaatttgaaactataaaataggataagcagtatgtaaagtctgtcaaagccatactgtgctttgaaatcaacaagaagtcaaagctaatttctagcctcacaggacaagatatttgcatgaaatattttcaattagaattatcaaccaaagataatttaatgacttttttccttcaagttaactgacaaatatgattttaaaaatctgaggctaacacttaaacttgtgctttaaaacaaaagtacactgctagtaaattgagacttctttataagttaaaaagaagtctaacccactaaaacagatcttttcctattagagtacgcctacttcaataagaaagcctgcttaatggcattcacttcctttcaaaggtctcaactgcaattgaataatatttttattttagagaacttaaaatataaatgaaatcaggaaagacataaactgagaggcaaggctttgcattataacagtaaaacccaatattcttcaatatttataaaagttatataattgcaacatacaaaaatagttgtaaaaacataactaaaacttgcttacttttcaaatagaacataaaaccaatcaaaaaattgttcctttcactcttatccatgatttatttcacaccacatgccaaatttactttatccccaagaatctttcaaataaaagatctttattgccaaaatcttttattaaggcaaatcttaacatttactgacattcagacaccagtcaaatcctagtgactgatcgttagagcacctaagagattcactcagtttctttgcacctcccaaaaggaattagcaaagttttgagacacaaatataacctgagataaaaacaactgacaagagcaactcaaacactgctacgtatatacagttggtactattttcttcatagctagtatgtaccttaatcttagttttaattcaaatactgaaatgcttttaatattaagtattattaagtgcaagtacattaaatacttaatatttatttcacattggtagattattatgctttatatagtttatgtaattaaaatgttcatataaggaaaatacataaaatttactcacaataaattacaatcataatttaaagtttttatcattttaatcatagagtatctaaatcttcagccattagtacacagacactacagatataactagaatattgcatcatgaataaggtgcgaatagtggactaacaacgtagctgaaataactatggtgtggaggagcactctaatatactgggtagttgtaagaacactgaagcctaggtttcatgaaggataaaaatcctggaaactttaaaagcattattttaaataaattttttcaccatctgttcacataattttaactacaagcagaatataacttaattatattggtcaaaaacaggataaagtgatataaatgtgaatctcttcctgacacaatgtggtctacatcactgaattttctctccactgtttcatataaaaaaaaatttcccctttacattgtgtaaagtatgtgaaatcacttaaaataaggaattactaaaagtaattttgttataggtgttatttggaacaaaagaattacttcattgaaaggactatactaaaaatatttctcaattaaatatatctcagaaaataacacctacacataaaatacgcttatcaatcaacataattataactaaaacaaggaaattttctatggtcattactaacaacatctgacctcaaatgaggacatattccaatcaataacacaaacaaacaaacatggcacctgaatgtgtgactatagttttgtgcctcgtgaatatgctggggcattttaagaacataaataatccacctgtggttctcacccttttgactatcccattcacatgagtgataccccatcatcagtaacatttttcattccctgcagccattcccaactaggagaagtggagggtcacagtgatatgaggccactttctccctagcttttattttgtgtagtaaatgatgcaaaaagaaagaacaaaggcatagaaataggaaagaatacagagtgttaatagaaccacaaatattccactgggattagaatttagtgtgtgtggctgggcacggttgcccatgcctgtaatcccagcactttgggaggctgaggtgggtggatcgcttgagcccaggaggtcgagaccagcctgggcaacatggagaaacccctctctattaaaaatacaaaaaattagccaagcatggtagtgcatgcctatagtcccagctacccaggaggctgaggtgggaggatcacctgagacttggaggtcgaagctgcagagagctgggatcatgccactgcattccagcttgggtgacagagcaagactctgtctcaaaaaaaagaaagaaagaaagaaagaaagaacacaaggtgggtagggttaagacaaggtaggtttgggcaagctagcctgagtttactgaactcaaatggcagtgggccatcaggacaggtgaatttaatatccatctggcagttgtatagaaggacttggggttgggaaagcattggtcagaggatgaccaatggcaatggtctatgcaggtaatgaagagctaatctagaatagtggcagtagggaaagaagaaacagacatgagaaataacgcacagaacatataggagttggtaactatctaaacatacagaatgacagagtagtcagagataattctggggcttcagatctgggagaatgaaaagaatgctggtgacaaatggtagagcatgtcttttgattgtattaggtttggaaaaccagtagcctcagagaggtctaaaaatttggtatgaatttgggaagaaaagctgaaacttaatgtaaagactgaaagatgttaccatggaagtaattaatataaatgttttagctgaagctataggagtgaatgaggtctcacaacaggaaaaatttagagggaaaaaagaagattaaagaaaaattcattcacatcaattaatatctcaaaagactaatgtgtactaagtactaatttggggtcaacattcacacttgggtgtcagaggcgtgtaaaaagtgaagcaaccaaaagaatgaaaggtcaaaaaagtaagaacaaaagggatgcagagacttttaagtagtaggggaatagtcataaaaaaagatcaagattaagagaaggctactgggtttggggaaggatcatagctgccttttcagagagcagtatgtgtaggatagagttggaaataactgggttaagaagtacaagatggaggatatgtagaatatttttctaaactcactctcactcatgtacacacactctgtttttttcactccatgctccctctctctctctttaaatgctgaaaaaacctgaatgccacagttggcagaaaaggaatgaatggagaaagagattaaaggtgcaaaggagacagatgattattaacaaaacaagaccaaaaggaagtaggagttacccttggggaagtggatgcgagtcttacacagagctgcgttcaaaggaaaagtagggtaaatggagattgtgagttagagagcagaaacactgaccgtggatggcagctgtcttctaaggaaagtggctaagctcagaggctgtaggtaagggaacagaattaaatgttgccttacaacttgaatagtgtaaaaagagtgaaaaaaaaagagcaggatacttaagagttaccaaaaaatttaggttacttttagcatttgatgttctccaatactgttgatcttttatggaatttttaaaaatgttaaaactgttgttttatagttacatagtgtgttacattgatctttcatattttatttttaacataacacttgaaagaagtaaggtaggtactagcatgtctgctttacagatgaggaaactgaaacaaagatattctctcccaacaagtagaacactatgcttatctcataggactaccataaaaattaactgttttgaaagccatatattcaaggtaactcctaggtcgcattttcatgctcagtgccctcaaaacacattgtctggatgaaaaaaaagaaaagaaagagtaaaaatatagatttagttaggctgcagatataaggcatatgaattttcagcactaacatattgtcatgctaaattaaagtaaagtacccaccatctgccttcattactcataatttagggcagaagccacaacacttggtgcaaggaggacttttccacaattatagtcacctattattagaaaataggtatattctgtaattgcatggtatacaccaaatcattcagaaagaaacagaaataaataagtagttatggtagctccaaggtggagagtacttattccagttgctaaactaaagcaaaaaactccacagtcctgtatgcctattatagatgggaaaaggcattctaatataaagaaaataagccacctaagggaaacacatgaacacaaaactatcaacaatgtgagcgaaacccgaatttctcaaaggccttggttcactgcaatagtttgaggttttttatactgacgttctataggaaaatatttttaactatcaagagatttaatctgatcactgaaagtctttgacaaagaagaaacaaacagaatcactgacctggagtgcccctgtggtttttatcttcttttgtttttttcagggggaggaaggggtacaacacaacatgatgttcaaccactgtggctttttaatgggatcctaaagctctgcttctaatactacagaggcactgaagtctataatttttcaactgttacaaaatttcctaagaataacttctaccacttgacactcactgatttcttgttctgtcatttttaaaaaatacttcttactctgggttgtatttactgtcgatttgtaactctctttattttcaataacattttaaactttctggtaatttgatgtaagtatgaaatgagagtacatcagactcactaagtgataagtttttatatgaggccagattaataaaccataaaatctcttaagattttatgtgaattttttaaaaataaaaatctcaggttattttatatacagacacaagttttaaatataaattcaagtttaagataggttttaatatatgcaagaaaatgtgaaataaggcaagacaaatactagccaatttttaaaacattctttaacaataaatctctggatgggggagggcaattgtctacttcaataaattaattttcatccttgcctactcagataacatattgaagagattccagttaacagaacaaataaacgaaaacaatattggattaagaagaaattgaactgaatcaaaggcagagtttggccatattttcaacaaacagaataacacagttgtatataaaaatactatacttgaagtctagcatgaacatggtccagttataggaagggggtgattattaaagaccaaaaagataattatcgttaggtctgaattctatatttttattcttttaactagacttgaaatcagatagaatacattttatattaataactatatttttgcaatttatactttatttttttcctgctaagcaggcaaaattcagtgttaaaaatgttattaccaaaaagcattattattttattatataagtggttccatttgtttttaaataaatggctacgcaaattcttactaactaaagaatgtatactctttaattgaagccttaaaacacactctattatgcaaaatgcccaatatttttaaaaagtgaatagtctcaatttcttatgatgtatgtacacttataattctttgctcaatactatttttgtgacttcctttcacttccccttcagcaaaaccccccccttgtcacaacctagccaagaacaaaaaaggtcatatgcgtaagagttccttgatttcagtggcaagggatgagattttttaaagtttctagcatttctgcagagttgggttataagggaaaggcttatctagaaaaaataaaatcacaggagtagatgaggatggtgttgtctattttagttgctataagaatatttaccttcaattacaacaaatgtataatctcttaccttagtgactcttctggattcagattcactttcaggttctgactctgattcagaatcggaagaactgtcttctattgaactagattcgtcatttgaagaatctgaagttttagatttttcattttccttctccccatcttcagaatcactacacataatagtaaattttgaaatatgaactttaactcctttatataagcagtttataaaaaaattgtttttaaattccagaatacattaatgaggtaataaaaaaggtattacccataaccaaataaattagaacccattcaaattcaattctatcctgtcatacaaatttcaaatgcaaaaagtcataaaatgacactaaacaatataatcaaaagcaatgtagaaaacattaaatgtttgatttaccaagaattaagtactaccagtaacaacgttaaagatatttaggctgattttttaaaacgctatctcaaaatactgtgcctgtgtgtgtgtgtgtgtgtgtgtgtgtgtgtatgtatgtatacatacatgtatatatatacgtatatacatatatattcatgtatatatacgtatatatatacgtatatgagacagggtctcattgtacagtggtgcaatcacggctcactgcagccttgacctcccgggctcaagcgatgctcccatttcagcctcccaagtagttgggactacaggcatgcaccaccacatccagctaattttatattttttgtagagacagggtctcactaggttgcctaggctggtctggaacttctgggctcgagtagtcctcccaacttgacctcccaaaatattgggattataggcttgagccaccacacctggtttagtaatatatttaaatatttatatatctacttctgctaaaatagacttgtattttatacattttctacccaagaaaattacttacacaagttcccaaatgtgaccttaaacacattctatgagaaaatgttaaccagttcaaaggaaattcttctaaagtactatcttgctaaaaatttaagctaatcaaatataaacttttaaaatatcaaatgatcatacctaagtgcttaacaccattcatttgttcacctgctcaacaaatatttattaattattgactacatgttggcattatgctaggtgctaaggataacgatggttagtaagacacagaggatctctgtgtgtctaccctacagggtctacggtccactggaggatacagataaggttgcagtgataatacagtataataagtaataagtaataaattatagcgtgtcaggagaacatgtggagagacacctaaaaaaacttgatccaattaggaatgcttcctggagaaagagacatataagccaagatataggagtaaggctggcagatgggcagggaaacagttctccaaggagaaggaataacatgtgagatgaccaaacacccttctctcaggggatgacaaatgccttgtggtgctttatattttcctggaaactaaaggtctagttctctctaccacatgtgtgtgtatttttttaagaatctactgtgggccagaaagggctaggcacttcataccaatcatactaattatctaatttaaatgcactcttcctgggtacattattatcccatttacaataatgaaattaatatttagaaaggttaaataacctgctcaagggcacataacaagaggggcagaactagaatctgaactcaagcctgtctcattccaaagtccgtattttttccactatgtcatactatctcccttcaaatgaaaataccttggagtgtaaaatttaaatttggtcataaatatttatgattactaaagggtggtttttgaagatgtttaaagcttattaggagctttaaaaaattatcatactggcaaagttaaaaaaaattctgagacagaaaaatacagggggagggagaggagtgagacaaggaaagaatcaatatttcctagaattgatttttgtggaggaaatatgattgctatttattaaaaatggagccatggtaacatctcagagcacatgtaattatatttgaagactgaaaaatatgttgttgtttttccctggcaaaaaaatggcaatttattatccccaattcactggttaaaatgtgtacttaaaaatataaggtttagaatgtatttgtggttctctttgtaataaacaattcttttaaattcaaacatgggtaaagagaaaaatccatttctgaagaaaagaataataaacctaatacatgactacaaattttgagtatactgacttttgccatctgaaaggacatttcatgcactgaacaaaactttccctttctagaaacaggacatgttttataactcgtatcatcatagacatgctgatattaaagcagaagtacaggatttctctcaaagacaaggctattataaaccaagtagctcctttgctgcaacaagtgaatgattctaaatatattcaacttctagcttttaagataagattttaaaagtaaaagtgttattttattatgcatcactcaattttgatggtaattattgtttaccttactgcttagagtttcagatgttaatctaatgaaaagaatttactggtaactaggtttttaactttgcaatgatgaaaagcctgtattaatttaacctacagatttcatttgttctgaacaggaaaaacaatataaatcacttttaaaatcattaaatcctgacttaaattaataaagtcataattagggcattatgctgtgtttgttatggaagtggcagggagagctgctttaattactgtctgtaataaaaggagcagagagcgtactgcgccccaatcagtgctgtcagccacgactgagccgggctgcaagctcatcaagtgagcgggcagcaggctcccggggaaaggaccatcatgtcggcagaggccactcgctgacagcagcggggaaaacagagttgcacaatccaagatattagacccaattactcaaaattttaatgacactttaatacatgataatgttattgataatgggagatcttaaaaagtgctaacacttaaagatcttatgaccgtcttccttcacagcccttgactctaatatttggatcataatctttttaatataacattatttagaaaaatcaattgtcttggttacataatggcaaagtgttgaaggatttaattttagccctcagcaaaatcgctacaaaaggtaattaagtgtttcatacctattgcttgatcacttaactcagccttccaaggttataccaattttcaaaatgtaaccccaagatatgttcaagttcaaaatgaaagctaagcattacaagtaggaaaataatgtgaacaactagcactttaattttaaaaagatttaatatctggaaaaaaatacacactttttttctctcaccattttttgattaataagaaacatctctgcctggggcaaactttcacagaatattttttgaaggaaattctgacaaaataagttacctttttcctttggcttttgagttcctcttggctgttcttttgttttctaggcctgactcccgtccactctcactgtcctgctcactggaggagtcctcactgctgtcctcattgctgtctccttcctccccactttcgccttgttctccactttcacttccagattcactctctgaaaaacagaaccagatgttcttagatttatagtcatttaattagacacacggacacctgtaactgtcaatattcatcacaaatgaaaccagatgttgaattttagttcagtggacaccacttgtttaacattttattcccacaccccattctttcagctctatggattcctttagcactgtgagcttggagggaggcagacagaggatgctctgacaacgaggagagaaaagctaagcaaaggtgaaccaagtaaaccaaatttgagggaatctcacttcaaaccccaaagtatatagctatgtcaaaaactttcttttaaagaattacgtaaggattgatgtaaggctaaagaaataattttgaattcttctgcttgtaatgggaaattctatttagagtaaaagaaggcaacagttgaatcttcttaggaacaaattttgagaggaaaatgagccattcaaatcacttggaaagacctccaaattcaaagacaataggcaaaatgactaattaaagagttattacttattcgagctagtaaacgagttttccataggtcaaagagatgatcaagttacactgaggaattatacttttaaatgttttatgtgtaaattatggtatgctaggactgttcgcagaagagaatacatgaagaatatatgtgtattttttaagtgaagcataatttttactatttaaaatgactataactacagagttgtgtcccagacaaaaggacaaactgttgccctgcctgtgatctatgtaacgaagccctcttaggcaggaacataacctttaattaaacattctaatggttaaataataccaacatcaggaaggtccatcacagtgaaaacctaggactgcctgtattgttttaagacggcttacaaggggtacaagcatgggttctcaagttagtgttcggattcagatcctggctcttctacttgccagttgtaaaactgaacaagttattcaacttctctgggttttggtttccttttcagcaaatggggataacactagttacttttcagagctgttgtgaagattaaatgatttgaaacatacaaaggagattagaacacaacagggtctgccacagggtaaggcactcatcattatcatcatttacaaacaggaaagtttattttactaaaataaagctactaaataaggacattttagatttgtggtaatatccaagttacacgcacatacatattaagtcagataactggcttatgctataaacaatgaaagaaattacaggtaatgtatcacagattaatttatcagatactaaaaacaaagatttttgataaggaagacagagaaaagaagagtgaattaccttacagtagggtagcagataaccatgtaagagtgacaggccctggttctccaaggaataaagattttagagaaagttgggtgtcgtttggtcttgggtcagatttgcctattagcttaagtgttaataagagcatcagaaagtgactacaatctatttttcattatgcaaatcactcacagaattttagcaatgaagggactttaagaaatatttaactgtaccccttcatttatctgatatagagaaaagtaggtgccttattcaatttgcataggtaaaagccagggcctctaaatccttcctattaagcattcttttcactgcatatagttaccctcaacctttagtttgatttttttatagtatatagagacttaataattttagctttatctctatagaggttcacagaaagagataagtataaaatgaaagagaaaaagactcttcaaggtataaaataaactttacgtttttgtaaaagaaagttacttttaaagaccccactaaaagttcatcaagtgtaaaattatgtttttcaatagatatattaggcattgtggtttagaattcagaaaagtatgagttcctgtttcagctataccaatgtatcagctactatccaagagatattgtaaagtaaaaagagaatttagtaattaaaaattactttgaaaactaaagagtgatatataaatgaaagggattattttgataatacaaacttcacttaaaactacctgctgaatattatggattaggccttgtttctgagatatagaatgtaatctactatgtaaataatatatgccaataaattataaaacccaccactgtcactgctactatcagaagagtcctcctcttcctcagattcagaataaaacttcttagcagaattctcttgctttgcttttcctgctggggtccattcttttgcctgtttaaacaaataaagtaaatataaatgaattctcattcagagatttagagttctggcaaacttaatcattaacaacataactgaattcaaaagcaagcttaaggcctccacagggaatgcaactgttagaagtcctggcattaaggctgattcactttactcctaaatacaacaacacaaactctcactcagaggccctatgttaaaccaacaatcttattttaaatatacaatttttaaaacttttgtgttttttggcccacagaagatttaaacaaaagtaatatatcctaaaataggtgagcgaaactagaagcagatacaataacagcaataacaaacacaagttgatagcttgacactgagggaaaagagagaaaaaaaaaaagaaagaaaagaaaatatttagtgtaggcaataaattgccctaaccatctcaacagcctaaatcctggagtaatccttgacttctctttttttctcatatcctaaacatctaagccatcaagaaatcctgtagctaccctggtctgacccacccttctctcctggactactcgttaccttgcttctactgcccctccaccctgcccccagcaaacaaactttgcaaaacacagcatctagaatgattatattaaaacctaaatgagagcaagctcctttttggcctgaaaccctgcagtggctccccattttactcagagaaaaagccgaagtccctacaacagtctgcacagcccaatacaaccatcctttcatgactgcccctccacaactgtccccgtcgcctgcctctctcacctcttgctgctcaccctcttgcctgatctgctctggccatgccttactgttcctccaaacgtcccaggcatgctcccagtttagggccttcaccctagctcttggcacttccaacaccattccccaccaccttttttttttttttttttttaatcacagcatgtattacttgttaacatactatacaatctacttgtttttttaactgttggtctatccctggtagaatgtaagtttctggagagcagggaatttaaaatattttgtgcaatttttttttttttttgagacggagtctcgctccgtcgcccaggctggagtatggtgacaggatctcggctcactgcaaactctgcctcctaggttcaagcgattgtcctgcctcatcctcccaagtagctgggatcacaggcacccaccaccacgcccagctaatttttgtatttttagtagagacaggatttcactatgttgcccaggctggtctctaactcctgacctcaggtgatccacctgcctcgacctcccaaagtgctgggattacaggtgtgagccaccacgtccagcctattttgttcaattttaagtgtggctgacacaataaatactaattatatttattagcctcttaaagacttcaatattaaattcagaaacatgcttaagaaaaatactgactttagtgtttactaaatattgtattagtaacagcatttactaatatgagcccctttaaccactttaatacagagtattagtttgcttttatagtcatggccttgatttgtcaagaagaaattaaatcatgcttcatatatgattttttaaaaagcagggaaatgtatacttctgaaaagataaaatagttgagactcatttattgattgtacctttgagtttttcctatgtgcaagtctttgctagagtacctattttattgtaaaggagtctacagcatgacagaatttcttattcaagaatgtttctcagcactgaatgtacaatagaatcacctgagaatagtttttaaacgctaatataaacaatacaaatattaatactaaaaaaacaaatacctagattcacctcctaaaattctgatttaattagtctggtgcacatttgacctagttttgttttatttaaaaaatctccaggagggtggagccaagatggccgaataggaacagctccggtctacagctcccagcgtgagcgacgcagaagacgggtgatttctgcatttccatctgaggtaccaccaggttcatctcactagagagtgccagacagtgggtgcagcgcactgtgcgcaagccggagcaggatgaggcattgcctcactcaggaagcgcaaggggtcagggagttccctttcctagtcaaagaaaggggtgacagacggcacctggaaaatcgggtcactcccaccctaatactgcgcttttccaacgggcttcaaaaacggcacaccaggagattatatcccacacctggctcagagggtcctacacccacggagtcttgctgattgctagcacagcagtctgagaccaaactgcaaggcggcagtgaggctgggggaggggcgcctgccattgcccaggcttgattaggtaaacaaagcagccaggaagctcgaactggatggagcccaccacagctcaaggaggcctgcctgcctctgtaggctccacctctggggccagggcacagacaaacaaaaagacagcagtaacctctgcagacttaaatgtccctgtctgacagctttgaagagaggagtggttttcccagcacgcagctggagatctgagaacgggcagactgcctcctcaagtgggtccctgacccccaagcagcctaactgggaggcaccccccagtaggggtagactgacacctcacacggccgggtactcccctgagacaaaacttccagaggaacgatcaggcagcagcatttgcagttcaccaatatccgctgttctatagccactgctgttctgcacccaccgctgctgatacccaggcaacagggtctggagttgacctctagcaaactccaacagaccttcagctgagggtcctgtctgttagaaggaaaactaacaaacagaaaggacatccacaccaaaaacccatctgtacatcaccatcatcaaagatcaaaagtagataaaaccacaaagatggggaaaaaacagagcagagaaactggaaactctaaaaagcagagtgcctctcctcctccaaaggaacgcagctcctcaccagcaacagaacaaagctggacggagaatgacgttgacgagctgagagaagaaggcttcagatgatcaaactactccaagctacaggaggaaatacaaaccaatggcaaataagttaaaaactttaaaaaaaaattagacgaatggatacctagaataaccaatgcagagaagtccttaaaggagctgatggagctgaaagccaaggctcgagaactatgtgaagaacgcagaagcctcaggagccgacgcgatcaactggaagaaagggtatcagtgatggaagacgaaatgaatgaaatgaagtgagaagggaagtttagagaaaaaagaacaaaaagaaacgaacaaagcctccaagaaatgtgggactatgtgaaaagaccaaatctacgtctcattggtgtacctgaaagtgacgggtagaatggaaccaagtgggaaaacactctgcaggatattatccaggagaacttccccaatctagcaagaaaggccaacattcggattcaggaaatacagagaacgccacaaagatactccttgagaagagcaactccaagacacataattgtcagattcaccaaacttgaaatgaaggaaaaaacgttaagggcagccagagagaaaggtcgggttacctacaaagggaagcccatcagactaacagctgatctcttggcagaaactctacaagccagaggagagtgggggccaatattccacatgcttaaagaaaagaattttcaacccagaatttcatatccagccaaactaagcttcctaagtgaaggagaaataaaatactttacagacaagcaaatgctgagagagttttgtcaccacccggcctgccctaaaagagctcctaaaggaagcactaaatatggaaaagaacaaccagtaccagccactgcaaaaaacatgccaaaatgtaaagaccatcaaggctaggaagaaactgcatcaactaacgagcaaaataaccagctaacatcataatgacaggaccaaattcacacataacaatattaactttaaatgtaaatgggctaaatgctccaattaaaagacacagactggcaaattggataaagagtcaagacccatcagtgtgttgtattcaggaaacccatctcacgtggagagtcacacataaactcaaaataaagggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccctactgtcaacattaaacagatcaacgagacagaaatttaacaaggatacccagtaattgaactcagctctgcaccaagcagacctaatagacatctacagaactctccaccccaaatcaacagaatatacattcttctcagcaccacaccacacctattccaaaattgaccacatagttggaagtaaagcactcctcagcaaatgtaatagaacagaaattataacgaactgtctctcagaccacagtgcaatcaaactagaactcaggattaagaaactcactcaaaaccgctcaactgcatggaaactgaacaacctgctcctgaatgactactgggtacataacaaaatgagggcagaaataaagatgttctttgaaaccaacgagaacaaagacaccacataccagaatctctgggacacattcaaagcagtgtgtagagggaaatttatagcactgaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacagaaaaaacccttcaaaaaaatcaatgaatccaggagctgcttttttgaaaagatcaacaaaattgatagactgctagcaagactaataaagaagaaaagagagaagaatcaaatagatgcaataaaaaatgataaaagggatatcaccactgatcccacagaaatacaaactaccatcagagaacactacaaacatctctacgcaaataaactagaaaatctagaagaaatggataaattccttgatacatacaccctcccaagactaaaccaggaagaagttgaatctctgaatagaccgataacaggctctgaaattgtgacaataatcagtagcttaccaaccaaaaaaagtccaggaccagatggattcacagccgaattctaccagaggtacaaggaggagctggtaccattccttctgaaactattccaatcaatagaaaaagagggaagcctccctaactcattttaggaggccagcatcatcctgataccaaagcctggcagagacacaaaccaaaaaagagaattttagaccaatatccttgatgaacattgatgcaaaaatactcaataaaatactggcaaaccgaatccagcagcacatcaaaaagcttatccaccatgatcaagtgggcttcatccctgggatgcaaggctggttcaacatacacaaatcaataaatgtaatccagcatataaacagaaccaaagacaaaaaccacatgattatctcaatagatgcagaaacggcctttgacaaaattcaacaacccttcatgctaaaaactctcaataaattaggtattgatgggatgtatctcaaaataataagagctatctatgacaaacccacagccaatatcatacagcatgggcaaaaactggaagcattccctttgaaaactggcacaagacagggatgccctctctcaccactcctattcaacatagggttggaagttctggccagggcagttaggcaggagaaggaaataaagggcattcaattaggaaaagatgaagtcaaattgtccctgtttgcacatgacatgattgtttatctagaaaacccatcgtctcagcccaaaatctccttaagctgataagcaacttcagcaaagtctcaggatacaaaatcaatgtgcaaaaatcacaagcattcttatacaccaataacggacaaacagagagccaaatcatgagtgaactcccattcacaattgcttcaaagagaataaaatacctaggaatccaacttacaagggatgggaaggacctcttcaaggagaactacaaaccactgctcaatgaaataaaagaggatacaaacaaatggaggaacattccatgctcatgggtaggaagaatcaataccgtgaaaatggccatactgcccaaggtaatttatagattcaatgccatccccatcaagctaccaatgactttcttcacagaattggaaaaaactactttaaagttcatatggaaccaagaaagagtccgcatcgccaagtcaatcctaagccaaaagaacaaagctggaggcatcatgccatctgacttcaaactatactacaagtctacagtaaccaaaacagcatggtactggtaccaaaacagagatatagatcaatggaacagaacagagccctcagaaataatgccgcatatctacaaccatctgatctttgacaaacctgagaaaaacaagcaacggggaaaggattccctatttaataaatggtgctgggaaaactggctagccagatgtagaaagctgaaactggatcccttccttacaccttatacaaaaattaattcaagatggattaaagacttaaatgttagatctaaaaccataaaaaccctagaagaaaacctaggcaataccattcaggacagaggcatgggcaaggacttcatgtctaaaacaccaaaagcaatggtaacaaaagccaaaattgacaaatgggacgtaattaaactaaagagcttctgcacagcaaaagaaactaccatcagagtgaacaggcaatctacagaatgggagaaaatttttgcaacctactcatctgacaaagggctaatatccagaatctacaatgaactcaaacaaatttacaagaaaaaaacaaacaaccccatcaaaaagtgggcgaaggatgtgaacagacacttctcaaaagaagacatttatgcagccaaaaaacacatgaaaaaatgctcgtcatcactgaccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacaggcacatgtatgtttattgcggcactattcacaatagcaaagacttggaaccaacacaaatgtccaacaacgacagactggattaagaaaatgtggtacatatacaccatagaatactatgcagccataaaaaatgatgagttcatgtcctttgtagggacatggatgaaactggaaaccatcattctcagcaaactatcacaaggacaaaaaaccaaacaccacatgttctcactcataggtgggaaatgaacaatgagaacacatggacacaggaaggggaacatcacactccagggactgttgtggggtggggcgagtggggagggatagcatttggagatatacctaatgctaaatgacgagttaatgggtgcagcacaccaacatggcacatgtatacatatgtaacaaacctgcacattgtgcacatgtaccctaaaagtataataataaaataaaaattaaacacacacacacacacaaaatctccatatgattataatgcgcagctacatttaaaaaccactagtctaaggctgggtgatgtagctcatacctgtactctcagcactttgggagctgaggcaggaggatggcttgagcccaggagtttgaggctgcagtgagctatgatcgcaccactgcactccagcctgggtgacagagcaaaatcatgtctcaaaaaaataaataaaagcaaataaaaataaaaccactgatctagagggtttaaggtatgttgcttaaaaagagaagcttgaatatatttgaataagatgcttatataagatcagcagtatggctttcttttatatttatttaaaatgcttctgtctacaaagatagtattctataaacaaagctctcttatatttggtaaactctgaagtccatatttttcttaaatccaaacatatttctctgaggtctgataaaacgtttgttggattaatttaataacactaaatcaacaatttcggaaaaccagacttctatgctcaaacgtgcattttttcttgacatggccatgaattctatggagtttcaggttttaaaaggccaaagacgaacaataaaagtatcttaatttgtattgtggtcctttatgactaaaagaccacattatcattgtaaggaaaaggaataatagggaaaagaaaagaaaagaaaagaagagaacatagacgctaatttgaaagtttctgtaaaggataaaatattgacagatgtgtttatgaagcaaaatacccttcatatgcagaaggcggtctttctgtcagtagagaagaaaggactttctagaactaagcaaataaattattaactaaggatcttcaaaacttactgggatcataatataaatatatattatatcctatatcctagaaatggtggtgtgtaattcaaagtgacttctactgtcaatctgactaggttcccagtcattttgattaaaatatcagattatctaaacctaggtcatttttcttactaagttatatttcacagttacaggacttgaccatgtaagatcactttacaggaaaactagaataacatagtatattatatgcatgaaatacagtgacatgacttggaagggagatgaagtagagtgagagacaagaaagataatacggacattattttttgtattgtagctgcatttaaaaagaaaactatctacgttatttttatatttaattgtgtccctcatagtataattttaagccaattgtctcagagtccaatagactgaagctgttttctgcatggcatcaacagacagtgacagttttatcaaaccatgttcaatcagttataatgattctctctaagttaccaattattaatttcataaatataatcagcaaaatgaaaaagaaattaatttgtctctgttgaattggacaggtgaaacgaacataatatgttatatttaagtactgtccctataaggtagttaatgcttagaagagcacatgaaaatggaagaagccagccaacaaaccaatctatcagccaataaagaatactgctgagaccaaattaaattgcatagcattgctatcaactctgagaagataatgctttttggtgggtgggggcagcaaggagggagagataaggcggaagcaggggaaggttaaaaggatggttctacttgggctaaaacatcatgtaccccataatgaaaaaaaaaaacgaaccataaaaacaacaaacaagcataataagaaattaggagagaaagtatgtccgtaggaggaaccataacaaagaacactctctttatattctagtatctgatcaaaagttgcacaaataggctgggcacggtgactcacacctgtaatcccagcactttggtaggctgaggcgggcagatcacttgaggtcacgagtttgagaccagcctggccaacatggcgaaaccccatctctactaaaaatacaaaaattagccaagcatggtggcatgtggctgtaatcccagctacttgggaagctaacgcaggagaatcgcttgaacctgggaggcagagcttgcaatgagccaagatcatgcccctgcactgcagcctgggtgacagagcaagactctgtctcaaaaaaaaaaaaaaaaaaaaaaaaaaaaattgcacaaataaggcaactcttttgaagagtacttaagagtatgcagatttgagtaaaaatcaacaaactcagctgcaaggagggatagacatgtaattgcttctcatatttttacatattactactgttacaaatttttggctgtctctaagtacagatcatttgtcaaaacataaagataatggtgctaagtactaaggataatacagatttgtgaacaagctcaaggttcctcttctcatattacataataaaatacagtaacagcatggacagtgaactcagacctgggttggaatatggttctatcacttacttgccatgtgaacttaggcgatttactttaagttatctaagacttggcttcctcatctgcaatgtgggaataacaataaccatcccttacaatcattattaggtttaaacaagatagtttttataaaacattatcatcgtacactgtcaggggttcctaaatagtgctattattaattccggccatgcttcaaagccaggataagttggagtggttaagagaaacatttaataatttctcagaggaatcaaattacatggccatgatcattatagaaattctatttattaaagtaataaaggttttcttccactgtatacagaaaaattgagagcaaggaggttaactcactttcccacaggaattagtaaagaaccccagttatctgaatcctaattcaatgtatcttttccaccagaaaagtatccagaatacaattcttaactgctttttttgttaactccacattttaaagtattaaatatattttgcataattgctaaatacaattagaaggcctctctcactttttcttgtatatatgagaaagaaacagataatattagaaaagaatgttaattcttttatctcaatggccagcattttttttaaagattgagaaaaagagtatttatatagcaaatttgtttttgatgagaaagcaccatattattcactttgtgaccttgtcaaaggacatttttggtacacaatgctccctatttatgttcaggcttcacttaaaaatggttcatcaaaaaatctagaacactttgtgtggtttttctgaaagagaacagcagaaattattcagaaggatattgtcaggaagcttacaaatctctaaacaaagtagaaaaaacttcatccaatgaaactaaataccttagaaattgaatctacgcggctacaaatgcaatagcacaaatgtgggtggcactgatgcagagaattcagttctctatttccttgaagaaaaggaacagtacatgtacaatggcataggaatactataatatttagttgctataaaggcaaggtatatctaacacattacatttagaaatactagaacaattttcaattttcaactctccaaaaaagcttttatataaaacaatagctatcctagagtcttccactgctttggcaaaattaatttcagaaaggtcaacttaccaactctattacttctacatttcgaactgatgggtcgggcgccacctctggccaattagataattccaggtacccagtagctttaatgttgagagtatgagataaggtgccaagctggaaatgatctctatctattaaaaatagggaaaaatataaaataaacaatatgagctgtatataacagagaacaatcataatcagagctcaaggtaattggcatattacctcaaatgtcaaggaataaatatagactaggaagctcttcataggtcaaaaaactgatttcagtccatagattacaataatctcccccataatggtcaataaaaaagctaatcagtcagtgtgtttagaggtgttgctctgaaatgtagcttctctaaaaattactttactgtgaatattaagaatgacagcacagttaaacaatccatatacatgtcttggcacaaacacatccagaattttaatagtttttctacaaaactgaattgctttttatcgctttaaaataagaacattaaataagaaacaatatgaaaaccaaggtatgtaactatttgattccaactggaatggctacttgtaaggtggtaaaatacttaattactccttttaaaaagctgggacacgtaagtcaacttccctctttgaaaaaccagtttaaatatagagggatactttttataaaataattcctcctagaaaaactgatattagtgtacacagaatatttacttaataactcactattaaaaggaattatatttcttataaaactatttaaaagagaaatgaagtcattatttataagaataagacagttttcatctattgcccagtttaaatgttagaataaagtcagaacgcttaaaattatttagtaaataaggtctacaaaaatataaactttaatataaaacttgcttttgagagcagatgaatgagtagaaagcatgctgttcttatatatttatatatgcgaatcatttatatttcctaagagataaattttaagcacattagaaatggcaacatcttgtcataattttttagataacatatattttggagttatattctgataatacctttaaaaggagactcaagcagtggtgcaggcttttgtgctaggaatatttttttggcatatttacttaaagctccactctttacattcggaacaataagctgcctaataaatcttgtacggtctctgatgtcgtagttttgatcatacttgccgagatttaatatgtactgggtaagcaattttgtctgttggaaaaaaacagatcaagatgagaatacagttatttatgattatcgataactctggataaacatatttaaagaggtaataaaaatgaatggttatgtcaaacaaatgttgttccatagggaatacacatttctaatgctgcaaatggaattttgaagccaaagcacatgtcctcttctgtactgggtaggtgaatgctgagtattgagaagcagccatgtgctagattattaaactgctgaagtggaaagaaaggcatcattaaaaaaataatcatatatggcaaacccgctgaaggggtctacgtgagaataatgaatgtggaaatacaactaaaaacatggcactcaaaacttaatcggaaaaatatgcaggacatcaaaacatcagaaagtattagggggctggcaaactgcttctcctgaggtgtgttttatgaagagatactgtccctggcataagcagtgtctgcactctgactgcactcagttactttaccctgaattatgacccattaaagcagacacatgaatcactgaactggattactgcaaattatttgcagtgcatttagctgttactttttcataaaagcaagctgctgatgccctctgaaaactaggataaaagacttcttccatttttcccccaagctgcttatagcctctagtaatattggtcatttatttatttatgtaagggaacaacttattatagtagcttttacaccataataagacttcctaagtcaatttttgaatgtactacattaacatatattgaaataattttaataattaaaccaaaattgaaatgttaacaaaacaggtttgtattttaaactacagttattttattgaaaaagcatagttttaacaagaaggctacatgtgtacaattttaactataagccaaatagaattcataatatatgggaaaaataaaccgagaaacactaaatcatttactttagattagaagattttatgcacattagaagcagataaaaaataaaatcaatcaagttaggcagagctaaagacaattctagaacaataagtcaaagtacagaaatggtgtggtaaactcttttacaataattgcttaagataattgatttgatagaaagcaaccttatttcagtagcagagtagttaaaaaggattaacccagttttattaaagtagaattataaaaaatacaagtgaaaatgttaatagagctattctgaatttggttaccaacaattgctattcactaattgctagaccatgctggttcaagtacaggtaagaaaatttctatgattcattttttaagacaatttgcaaagtattcaccaaatgaggaatacaattcaaaaccaacttaaaagaaaatgtggtacactaaaccatgtaattaatttgctggaaaaacctgggaaatccacttaatcattagttttctcaaatgtggagttagaatttacaacttggttaactctaaagtccatttgagtgctgagattttaaatctgcaactaaaataaagaaagagtctcttaattgcaatgatttttttgagctagcagaatgatacatttggcttatatttcttagcccaaaattaatttttaggaaattaaacattttcaatatgttaacaattttgaaagttaggtagggcatttaaagtaattaaaattatataatttaaaaatttttattgactgtaaaatgtattatattataagcttataaataagttttattaaaatgtattttcaaaaataacattctttctaaaagataaaaacaaatttgtgtacaatgatgcactaaaaccataagcagaatagttattcaccacacatttacatacattaatcagtttcttcagtgtatgtatctagtaacaaggcattagtatttctctggagaatacatttttatatggcctaagtttttttaaaaaaataaaattgcaatctttttccaaattaaattctgcagtgagtaattataaaattgttgacattttcaactttcttctctgtagaccatatttgggtataatggagaaaataccctctttacagtatttctggacaatcatgtaatctcagagaaaatcctactgaatgaagaatagtaccaatccttgcttttatgttaaaaactgtcaatatttcaaacccaaatatttagcttttcccccatgtagtcaataaaaagtttttacaatattgacaacattttcaaataattattttatttatccttttaaaaatatgtcatcaatttagatactacaaaaccaactgccttctcaatttcatttcattctacacaatataaatttttctaattaaaaacaggtgctccatcaaaagagtcttcacgataggtgagatagtgcaaatgacaacctcttgattaaatcttgagctctcaccatttaacctgttcagttcttcccttgcctgtacagggaaaactttcaaagtctttctgtttgcaagacttgtttctaatgattgctatttgctaaaatttttcaaaaggtaaaattttttggcatttactagtgacactttaaataatccaaacaatttgtgaaccaaaacttaaccaatatacagaagactcaattatcaataaaaaatgtttaagccaatataagaaacttaatttacaaagcagttcttcacaaaatcatgtatctaaaattctgttgctaatatgcattaaagacagtgtgtactgttatgctatagaatggtttttcaacatcagtttcatcacaagaattttatagttcggtcaaactgtgtatactaatatcagtaaatgtgacaactacggttttatttcaactggctgaataagcagtttgttcgcatgcacaacaaccaattcctaaaacatttctcttccatagttttcttaattaaataagaacattgatttttaccatgacaacgtcctttcatcaaaaacagttttatcttcaaagttgagctttttaatttacaacagcatttgcaatatttttgacagaataaacttccaaaagctttactttgttcccatttgcagccctgaccaaacaaatatacaaatacattgaatgaaaaaagtctatttttggaattaactgattttctgtttgaaaaccagcagtgttgggccttttttctactaatggagccaccacattaacagctattgtttcatttttcatatgtgcataagaaaacatagaataaaagtaaaaaactaattttcaaaaagttatttgatctaaatgaggtcatgtttcacacagaattatataaacatcttctgcacctgtacgtattaaattaccttaatgcataatcttaaaataactactagctttttaaatggatgttgatctttttgtagcagattgttgtgtcttctggttgttgtgtggtcaatgagatcaccagcactctcatgatggttggtaaatgtcgacaaatattttatgcatgttaagtactaagtggaaatttagcactttattgtttgttaaatgtacacttccactttaaaaaatatattgctgatgattttataacaagataaaaaaagaactgccaaataataaaacaaactttagacttacactatacaataaatgacaaaactactgtagcaagagtgctttcaccactctctttaatgacctaggacaggactattcagtctttactcctgcacatatttcacctataaccaacctctaacttcccatgttttcctttaattccacccactggcagcctggagcttcatgcatctcataggccatggcaacacttgctggtatatcaagttgctggcaaatgaagcattgttaaatactcatctctccacctccagcaaagcaaaagacagcttttcccacctgctttgtcagagtatacttcatttatcagcacaaatcctgcctgctgttctaaaaggaagaagttagttatgttacatctagaaagggtgggaaaaagatacagtctttcagatttaaatggctcacatattaaaatgaaatctctgttcactgcacttgtgtcttaacatgccactagacaaaattatggcagaagatagaagacctcaaagcggaggtctacaaattaactgtgctattttaaggcaaatattagtgatattacttcattaaaaatttgggacaaatcctaaactagatggcatggagacaacaggcataaattagatctgtccagggaagctgttaggaagaaaacagacaacatttaagtacaatcatgacattttaatatcaccagaggctcaatccaaaaccagatgggatattaattaaatagtacttttaaatttgttttattcacaaattacacaagataagcaatgacagtataatgtattatcattaacaaaaatattcaatatcatatatacagctatttattaaattttgttttcagactaattttcctgcttagatttaaggaaccattattggtaccaactaatggctaatgctatccagacactaattatatcaattacattttcttcagattgactctaagtcactgtgacacaggaaaaatgaatttgaagaactgttacataaaaattaagaaattcattattacacagtgaaaccccatctctactaaaaatacaaaaaattagccgggcatggtggcgggcacccgtagtcccagctactcaggaggctcaggcaggagaatggcgtgaacctgggaggcggagcttgcagtgagccgagatcgcgccactgcactgcagcccgggcgacacagcaagactcgcctcaaaaaaaaaaaaaaaaagaaatacattatttaaaagacttctcaaaatactctgacaataaactgggaaatatttattcaaacaatagctttcttctaatagattataagtcagtacaaataactaaaaaggtctcttaaaatatagtcctaatatatattttactattaatactatagttctaataatatctttactattacataaaaaggacacagaagtctgcattcggcatagtaaagatttatattggttctacattgctgttattttttaacaggatgatacaaacaaatatgtttggtaaatgaagtaaactctacatagaattcttaacttacaccagaggcaaacctaagcagtaccgttgttccatctaattagtttctttctttctttctttcttttgagatggagtttcgctctggttgcccaggctggagtgcaatggcgcgatctcagctcactgcaacctctgccaaccaggttcaagtgattctcctgcctcagcctcccaagtagctaggattacaggcatgtgccaccacacccggctaatttttttgtatttttagtagagacggggtttaaccacgttggtcaggctggtctcaaactcctgacctcaggtgatctgcccgtctcggcctcccaaagtgctgggattacaggcgtgagccactgtgcccagccctaattagtttcttaatttcatgactaaacaggattctttatgtgacttagatgtaatttctgaatttaatagtatctacctttttgtcaacttgaaaagttttctgtaaggtcttcctttctgtattatatttacttgagtttttcaatgccaggaaaacatatcaaagaaaggatagagatgtcacttcagagtgtccaagtctccttttgttaaatcacattaaagaggctttgggggaaggagatttctccaaagacctgaatcacgggcaagagagaatctgcttttaactttaggaggaatccctaaaacatcagtgtgatttacaaaatctctcactaagagtaaaaaagaactcaaggaagcactttcttttttaatagcagaaaagtagaaacttaaatgtctgacagagatagtaattaaattatatctacacatatccatatttcaaaaacatgatattaagcaaaaaaagttgcaaacatatacataaagtagaatatctacttatgtaaaatttgaaaactcacaaaaacaaccatacattgcttatggatgcatattcatataataaaaatataaaacagggatgattgaatgaaacacaccaacaaggtggcagtggttaccaatggggaagaaacgaacgtgtgaacagaagcttgaggttctagttctatacatcttacattaaataaataaataaataaataaataaaggcaaatgtgaatatcaacttaatcctagtggtagatatacacatatgtatttatgctattatgtacttttccataggtttgcaatatttcataactaaaaatcaaaatgagctaagaaaaacattaacttatagcacttatcactacatttaaaagatgacatactattagagtttaaaatcaaaagcatcttttattcattaacttttaaattgttattaatttgtttaattaaatcctttcttcctcaaacttcagtagactatttcaacgaactcatgctaaatctttatactgccttaacagttctagatttcagcaacttcaactggtttcagtctttcaactttttccccacataaaagtgaaattactcctgtgtgagagtattctaagagtgttttctactcttgatacttatttctaaccatttttttcttcacagactgaaaaaaaagaggggcggggagatttcagcatcctacttagaaaatctcagtaggataaacccaaatcagtagttttttttcctaataagaatacactttttgtcagtaactagactagtttctttactgtaaatcatcatattccctaagaagaatacagcagttgctcgctagggttacaaaagaaggataactaaaatgaactaggcactattatgtgcaaggaaatctaagcattttacatgaactgtttcatgttatcctcataataactttgtgaggtaggtacagtcagttctgctctaatgcttgttttgaaaatgtgcatttgttccaactcagttggcatattagggaacaatttgggcataacatgaattttgtggtgatttcttctgcaagaaatactaggtgaaggcataaaaatgcacccagctaaacagagatgtgtaggaatacacaaaacatacatacctcaaacatgtacttcagaggttaacatctacatgtgttatgcgccatattcatgctcattaggaggcacaactttccatccaatttcagattaaccctctttctaccgctgaacaagtatagcctttcttccataagcaaacctcaagtctttttcaatataaagagcagtatcattgtagtatttatttgttaaccatttaacacgtgtaaaattgtacttctggtttttttttttaggttcctttttaaaaaatatgtcaccaatatagtttttgagtgttgccactctaactgcatttttctaataatccctatggtttttattgtgtgattttgtatagcacaatgattttagaagcatacatgttgcaatatagcaaaattgactatattataataattcccattttacagatgagaaaatgaaatcttggataggttatatgatttgtccaaaatcatgtaagtggcacaacatgatttgaagccaggcagtctatttaccatattatgcaaccactaccaccatccatctctagaatttttcatcttcccaaatagaaactctgtactcattaaacaataactccccatcctggttcttcttatgttgagtaattttggatatacaagatacatttggacattaagaatgccatgtattttagagactctggacatagttaaactctttgaatgagtacaggattttcatttgttttagcaggtaattaactttgttggggttcaaggtacaaactcagtctcttgggtacacctcaaatttcagcttggttctttaattcctagctgtgtttctctgaatccaccctgcataagtatggttcagatgccagccaaaaacttaggtacaattactcccagattttgagattctcccacactgactctctcctttctactatttttccttaactttccaatgtctgtagctttcctgaactctcttctctacttcctcaagccagaaggactttgaatttccttttggaggtctagccactgtgcacagtgccaactgcaaactgtcctcaggataaaagccataaaaacagggaaaataactctgtgccatttccttcttctaagtatgaatttccctccagattctcttgcttttctttactattctgtgtcttcagaaagtcgtttgtttcttgtatttttctggagtttacagctgttttctatggtagggtcagtctaggatatactcaaaacagactgctaactaatttttaaattattttttatattaggtcaaaaatagtttgaggcagataaagaaatttactatttgattattcttcaaacatacaaataaatacaatatgctaaatcttataaaaatcaatttagacattctctataaccctaaataattcaataaaaattatagaaatgctcactgaggtatttaggccaccgggaattcagatctacaaataaatatcaagacttcacggcaaaccagctactcatcactgtaatcgactctccctagcttagttttaaagatggctaaaataaataagtagagaaaacaattcttagtatttcagtcaaaacaattattttagtctgtcttatatctaatggattacacaaattttaaaaattctatcaagttgatagtgcttaaaaccattctttaaaactaattttcaggctgggtgcagtggctcacgcctgtaatcccagcactttgggaggctgaggcaagcggatcacttgaggtcatgagttcaagaccagcctggccaacatggtgaaaccccatctctactaaaatacaaaaaaaaattagccaggtgtggtggcagacacccataataagctactcagggggctgaggcaggagaattgcttgaacacgggaggcagaggttgcagtgagtcgagatcacgccactgtactccagcctgggcgatagagggagactctgctccaaaacaaaacaaaaaacaactaattttcagttgctaattctctcaatctcctcttcttgagaaatattcaaaaacagagaacaactcttcaagacactattaatctattttcatatttaatcacttaaaaacaatgagctacataaaaatttgtgattaaaaaaaatcactgtgttttcaccattaggtggtgaggcctattgtagtttcctagaagtatcattctaaaatataaaatatcacgtctgtaatcccagcactttgggaggccgaggtgagcagatcacttgaggtcagaagttcgagatcagcctggccaacacggtgaaacctgtctctactaaaaatacagaattagccaggcatggtggcacatgcctgtaatcccagctactcagtgggctgaggcatgagaattgcttgaacctgggaggtagaggttgcagtgagccaagatcatgccactgaactctagactgtgtgacagagggaaactctgtctcaaaaaaaaaaaaaaaaaaaaacacttcagaaactgagctccaaaactgccattaataatagagatcaagaaaaaaaaaaaaaaaacctgagtgcaaactagttgtcttcaaattcactgggtaaaaagacatgaaacatgctctacaataaacagtactacatttcattattggttattcacagctacaaagaaaagagccaaagaaagaagctttacttagtttgattaagtcttgattgacatttgattttggtattactttaacaataatccataagctagatatatttagagtggccaaaccagacagaaaaaaatcctaagagtctaggtatcatattgacttttgccataccacagggatttagtgaacaccatggagtttcaggctaaaactccctctattttatcaagaaacatgaaactcaacagcaaacataggtctttctttactcagtttttagaaagcatctcaatgtatgaagaaatctacagacacttggaaaggattaactgattccttttaaagatgacttaaaatgtaaagacaaaatctaaataatggaaatatgctccattatttgcaattatctggttacaaatcttgtagatgaatcagcaaaagctataataagataactcatatcacgattagggatgaagataatcccaaagcatatagaaatgaatttgaggaatcgacctaaggattctgaaaggcaaacattagtttactagaaaataagtgtggtctatggggaagcaggaaaggcagacagagagggagacacatatagagagatacacagcaaatacaaaaagagagaaacaaacagggatggaagagaaaggagacaatgacaaacacactggactgtagtacgggggcggggcacgaagggatgaaggatgtcagagagatatctaggcagaaagagttttggggaaggggacaaaaacaaagagaggggaggtggagaaaaaaaatcacaaaggcaaaagtaagagtcagaggaaaagtgaaaattagagaaaaatagataggacacagagcataaagcttcccaagaagcctagctgcaaatgagcaagaatctttttccaatttactaaacaggtaagtccactcacagagaatagcaattcagatataggaaaagtccctatttcgtacatggaagcaaaaatgattcctcttattaacagctgctcaaaaagtcaatggacttaaaaaatgaatattctaaactgcaaatctggtaaattatactactattaaaagtggtttccctttcctctgcaggacaaggtccatactacttagcagagcatacaagccactccatgcgttcaaactgcaaaatgtcttagtccatttgggctactgttagaaaataccataaactgggaagcctattaataatataattaataataaaaatttatttctcacagttctggaggctgggaaatccaagatcaaggtacccacagttctggtgtctagtgagcacccattttctaatttacagatagcaccttctcactgtgtcctcacatggcagaagcagcaagctagctctcagggatctcttttctaagagcataaagttcatttataaaggctccacccttatgacctaatcacctcccaaaggtcctacctcctaataccatcacatgggtgatcaggtttcaccacatgaactttgggggatataaactttcagaccattgtacctgccattctggactcaccttcaaaaagtttcccagaaacaccaagctgtttcttgactctgaccctgtgctttcctctttctgtacagtaaaccactcttacaagcccttagtcaagagtttcatcctttataaaattttctctgacctcacatcgacttcagactttataattcgtctagaattccactgtatgtcaatacttctgctacagcattaacacacactatttcattttttaatctgttttctctcttactagactagaatgtcatctgtttgcactagtatcatctaacatagaacctgaaacaaacaggcacctagaaattgttgaatggtcagactaatgaaggcacagacccccgctgtttgatcagagtgaagaggaaagtacgtattagataggttgactaacatttgcctctcacctgtttggagttggttaaatacaattttgctcccagatttaatatctgcagttttaccagatcatcttcactagtgaagcttttagccatcttcctcaaaacatcaggggcaattttaggaactcgttcacagttttctccaattagccaaagaatacttgctctagcaacaggaacctaatatgagaagcagattacatagttagaagtaagttaatcatactctaatattaacatagaaaaggttttaactattacaaaagttttacagctattaattaatttaatgtatatctaggaattaatcctgtatttatgaattttcgtcagttatcaaaaaataaacacataggaaatctcattaaaattgatttcgaagagaatatcttagaaaatattcatacagcaaaaaccgatggtctagaatctagattctatcagagacgaacaaattctagaagccagtctagctgcccatacctatttgtttctccattatctgttgctgcttttgtgctataatggcagaaatagttacagtgaagaccatatggtcctcaaagccaaaaatattgactgtctagcaatttatagaaatggtttgctgacccctgctctagaacagcagttcccaaacctcaatgcccacaaaaatcatccagggttcttactaaaaagacaggtcctgggatcagctccaaaatagtatttctgtggtggggcccagaaatctatgttttaatttaaaaagcatcacagatgactcctgagacaggtggtccacaaagcccatttgagaacccacagataatacagaaaaagaaacagatcaattaggtactatgattccaaatcaaaactgtttttgctctttatgtattagcatctacaacactggaaatatatcaaactgataagatcatcaaggtctgcttataaaatcatgaatcccagtctattatttggtcaacaaaagaaacagggataaatttgtccaatattgcattttggcactatatttttaaataaactgcatttcaatataatttatgttcttaaaagtcactgctttgtgacaaattggaaaccttccatcagtaccattaagaccaacaatttagagtatgcaaattagttttattactatttgcttatttgcatcctcccctattccaaaaggaatttgagagggtgtgtaaattcatttcagtgaacattttcacctcgcacagaaaatttgttttttataataagtgaaaaggctgacagctatcattaaaaggtggcatcacgaggaaagataatgttctttttatgaagtccttttacaatttctcaaagtcctaatattttctgtagtttcatggctatacatagtaggattgttaaagaaaaaagtgagaataaggacctttccatagctaaaattttatcacaatatctaccattgcaaaatctttcaaaacacccacattatgaaattatataaaaatattaagttacaatattgagtccttcactagaatcagaatgagatgatcaaaaaagcttttaaataaaaaggtatatattttaaaacagtgtaacagcatgtctttaaattattatttagcatgtttggtgagacacaagaaatccatatacttgtgcaattagaaaaaggtctaagtgctattaaaaatctattcatgcagtgtgataaaactgatgcccttactgcatactgatttctggaaagaaaagaggttatttctaacgttccaaaggttacactgcattaagaccttactcccaatctattattttaaattgggctaaagaatagtaattgagtggtacattaaattttccagtatagaggaattcaagttgcctgccataatgaaaggtagttctaaataagaatatatgtgcaacttcaaatttcagttatgctagatttatttttcttaaatattttattatatattgctagtataaaaatcagaattctatgacataccataatctattatcccattttaagtaattttcttctggtaacaatcttttgcaattaaaaagacgatcccaaaaacaagtaatgtttaaagagattgtttatattcatgaatatactaaaattaaaattaaaatattggaatactgtaaacactcacgatacatatatttaaaatacaactctttgaaaaaattaaaaatcaataaatcacaatgctcacaataaaaatctcaagatggtggtgagaataagatttgtagttttctagaactgagctaataaaatccccaagaatttttaaaacttagaaaacttcaccacaagaaataatatcaatataaatataccaaacttttggtgatggcattgtattacaaagcttaggaaactgacaaagacaacatttttgagcaggtggatgggatcagaatactaagatttttggattccagctttccctttctcttcccattaagcaacaggactctcatttatacaccattgacactatgaattcacagccactactttcaaagatttgaagcacctgaaaaaaaggcaagtaagaaaattagtcactttttagaggccaggcacagtggctcatgcctaaaatcccagcactttgggaggctgaggcgggtggatcacttgaggacaggagtttgagaccagcctggccaacatggtgataccctgtctctactaaatatacaaaattagcctggcacactcctgtaattccagctacttgggaggctaaggtaaaagaatcacttgaactcaggaggcagaggttgcagtgagctaagattgtgccactgcactccagcctgggtgacagagcgagactctgtctcaaaaaaaaaagaaaagtaaattagtcactttttgttccccatggtctttttaaccacaaaataaataggaacactgaaataaaaccaaactaataatacacacacagacacagacacaggtacagacacacacacagagtcatacatatgatataatactttcattatgaagctctgcttttcaatattctcaaagacaaattggattgtaaatgactttgcctgattctttattctaaatgccctgagaaagtgattaaatgcacttttcaaaccttgtactagaaggcagtttccacggccaccacaacccattaatttgccagcaaaaacaaataatgattcctagctcaccacagcagctatagaaagacatctagaaagattttgcagatcactctgtaagcagttcaatttaaaagctattgtgtttcaacaccagcccactgcacagtgcaacagtccaaagtaaaccctacaaaaacatcaatttcatttatttaaatttgtcaaaggcaaaatcagtagacatctaagcaaactgcataccaacagcaaatcagatctaatactctgtatctggactcaatatgcattaaagcctaagcctgaattacaatggggtgccagagaaagggtgggtaacttgtgaaatggcaggcatcctgtgaggcatctgggcaacaaggatacaaagtgctatttcaatattactcagtttttacagaataacatctttcagttgttaagatatgaaatcccatctgtcccattaaacattatgtgaaatcctgtcagagcaatccacaggtagtatgggttgttttgttgttgttgttgttttttaaagacagggtcttactctgtcatccaggctggagtgcggtggtgcaatcattgctcactacaacctcaaactcctgggctcaagcaatcctcccgcctcagcctcccaaagttctgggattacaggcatgagccaccatgccagctgatagtatgcattttattctagaagaactccaaaaccagtatttatcataaatgaaggatacgccaaaggacagaatactcacaatcagaacatgtaagttgactgtattacagacataaatctatttgatttgaccgaattcaaaatgtaaaatacatttaaactttagtttttatattttcaattattactaaataaccaattaaaacaaagccctcaatatgataaaatctatgttctctttttaaaacaaattacatagctaatatctattgagctcttaccatgtgccatgcactgtttttgagagctttacgtattttctcagtcattcatcgccaaagccctatgaagtatgctctactatgatctgcactagacatatgaggaaactaggtaacaaatgagttaagaaacttgcccacatctcacagctggttagtggtggaactaggatcagaactccaaatctgaatccaaaattcatactggatcactgggtagcgacaaaatgagtgtggtaaactaggaagaatactggtcagcaagctgttgagaccggttctgatcccacactgatggtgttacatcaaggaggcaattaacttcacctcactggggtcatatttacttattaatcagatgaaggattattccttcatcctctgtttgtctgccacattgtgcaatggctcccttagtgcctcctgccatttccccaagagccagattttcagggcagacccaggccatcctcttgcctgttcccacacccgtgtatagtgggacattttcccacttctttcacctcttcttttaaggataggtaaggtggccaggtgggaagaggtcttgctatcacttctgttctctctccttccagaagaaagatggacccaggattctgccctaataaagtggctcaggcactgaaggaaaacatgctcaatattgacccattgtccttagatattggacagactggcttttcctaaaattgcagtgttttagaatgacactcctgggtttgatggtgaaataggtagagattcaggaggacagaagtctcatttaaggctcttattttaaggctcacattttaaaatcacttgcctacgtttaggagttatcaggtacttggtcggattaataaaacactgcttttatttccacatggccattgttcttgtataaacagctctcctgactggaacagagagattctggggattcaatcattcttctttcctgactttgaagttatgtctgctacatccctcatcaccttctcctggggtaacttgtggttgaccattttgagggttctgcacaacaaattgttttgattcttccttgcttgtcccaccttcaagcacttcagtttcctcagatacgttagatgagcagtaacaactaattatcagcttttcattctccttaagttcaaatgtgtgctgtagaattccatacagctttcttgtattttaatttcttttattatcatattccagatttgtctacttttgttacctctctctgcttcataataattagaagggaattttgttttattttctttccaaaagaccagatttaacatgtacttttcaactcatatatattttttgtattctattttacaaaatcagcattgatccctcttctgttttgattcgtttttcttttattttatatccctatactttaaaaatggtgatctttataactttagccatgtcctacatgttttgaaataaagcattttatttcctgggttttagaaaaaagtttgcatttcttctttaaatgcattctttaatctgaaagtacatttcttactttacaactggtctggtacccttttaaattatttaagtctcatttcattgcttaaggtcaaagaatgcaaaatctttaagcttcctttatgcctaaatacattcttgattttttgaaaatattcactggatatactcctaaaagtgggtattatctgttcaagagatataaggttttagctatatttactaaataagtttttgattacttaattttcttacttatatctgtctactagaaatatctaatatgagagaaatacattacagtcacacattgtaactattttatcaatttctcctcacattttgaatagatttttcctttacatatttatttggttgccatattttttgtgcaaataggtttgtgcttattactttctttacaaattacccttttttcattttataatgttcctttttatcttgttaaatgcttttaattaactgtaaatctcactttcttgttcatatttgcttaatatctctttccttaccttcttattttcaacttttatcacttgattaaggtgctttaactataaatggcctgtagctagtttttgtttttattccaatttgtaagtctgtcttttgatgagaaaattcagtccattcatattcaagatgagaaatatttgattttatttcttccatctttattacttttaaatacttattatttattttacatttgttttctttctttcttattttttttctggctttgtaaaactgctatttgttcctttattttcctttgtgaatactgaattctcaccatatttttgtatctattaatggttatcttctgagaaaaacaaaagctgaaaaaaataagctttgctatatagagctgtaagactgtacttatttggcttatagtccagcaactgttgagaaagttgatgcatcagccaggtgccatggctcacgcctgtaatcccagcacttcgggaggctggggtgagatcacctgaggtcaggagtttgagaccagcgtggtcaacatggggaaaccccatctctactaaaaacacaaaaattatccaggcacggtggcgcatgcctgtaatcccaactactcagaggctgaggcaggagaatcacttgaacctgggaggtggaggttgcagtgagatgagattgcgccactgcactccagccagggtgacagagcaagactccattaaaaaaaaaaagggaaagagagagaatgagcgagaaaaagaaagtttacacatcaaaagtatcttctgtatccctggacatgaatatactcaaatagaagaaagttttcttccaagaaagcctagggtttgccagatacaggcctcatacactgttacaggttttatgtatagcagctgcactctcctgaagccctagtacttataattgcctcttcctttctaaacaggaccagaacgagtttactagcacaagttttaactaaattttgcacaagaagtctggggagatacagaactcctagttccttctcataatcagatacatacttctctaccattacctgtaaacaaggtattaactatttccctcactaaaacccatggttttcacctcaagataattatttttaccttactactttttgaacaccagatgagactaccataataatttcacttctctccactctcttcctcccacaaaacctttaacattcttttattctgacctccatttaatctcattcctcagttttcctgaatattcaatgtttttagttctaggttaatagaattttccttatattatgcccccttctttatcaagagttcaaatttagcactttggttagacattcctagtctattgctatacatttattaggttggtgcaaaggaattgaggtttttgccattgtggtaaaaaccacaattatttttgcaccaacctcataatcatgtgtaaatatacagtcacctatatatctctcttctttgtcttcttccatctagagttctctgtgctagttcattagctattggttagacaagtggttcttcctgggggctgtatcacttcgtaggaagtaactaaatatgagcagtgttacaatgactagagacacgactgaattttgatgcttggtggataggaatgctagatgtccatttcggcggctttgagaaaaaaagcttaacctctcatttcccatcaaagtaatgtcaaacatctgttctacactgcggtagacattgatcatgtcactctaattcccaatttgtcaatgacttgagggaagcaaaaggaaataataaaaaaaaccttggctaggtcactgagtaggtatgtgaactgaatacagaaaaaggaccggtgacaatttaaatatttgttaaataaagtgaaatttttaaacagatagattataaatggaagtgagatacaacataatgcactggttaagaaagcagacctgctgctatgtgaccttgggcaagttacataacctctttgtgcctcagttttctcaaatataaaataggaatattaagagaactttccttgaagtgttgctattaaaaattaataatttatatttttaaggtacttagaatagtgcctggcaaatgatatgctctataggagttattttaaataagtaaaatataaaagaggcaataagaaagcttacaaaattaaaaccttaccatagtctgtcttcttcaaaaaacactcaatattcccttaataacagcttacaccgagcactgttctaagtgcttcacatgcattgactcattcattccacccaacagagctctaaggttgtcagtactatgatccccattgtacagatgagaaaactggagcatagtgaagtcaagtaacttgcttaagttcatgaagctagtaaaaggtacagaccaactgtgaatccaagtcatccggttttcaaattactctcttaacccctacatctctcatacacaatctctatgagaagtcttggctttgatcattagaatcaacagtaagaacagatatgaatacaaagtaactctccgctgagagatggggtggaagttcagatgctaaatgactcctgtaagccatacttttttttttttttagctttaagataaatgtgtaactgccttgcaagctttactaacaccctaagggaaagacaattttgccaccagagatatttaaaattggtcttgactggcaggttctaaatcttgtgatccattacccttgactacacaaaaatgatccctctgaagagaatgagaatacagattaacccatcttcaaaaaaggaaataatatactcctccctaaactacatctgcatttattatagaacatcacttggcaaaacattaaccagcactcaagaaaaaggcatagtaaaaagcaaacacaatggagaagaaatagctgaagagtttgaagaaaaaccagaagagaaaaatcacagaagccatgaggagactatttcaaaaaggacgaagtagttagcgtagtccaatgctaagaaaagatcaaggaagatagggacagaaaagtatccactggatttagaaaggagatagtaaccttggaaaaggcatagttaatgaagtgctggagaaccaaaatccaactgtgacggggagggagtttgacgtaaaggaataaaacttgttgcagatagttctttcaaaaactttggttttaaagggaagaagagcatgaagatagaatgacaaacacataatgcagcactactatgtgccagccagcgttccaagggcattaccatattaactaagctaatacctataataatactatattgtaggtccttttacgatcatcatttgacacatgggaaaagtgaggcataaagactttaacataaggacggagctggtaagtgatggagttggaactaatatttattgctttatttatttattttttttttacataatttcagacttacaagaagagtaaaaaaaattctggataccctgcacttagattccccaaatgttaacattttactgcatttgtgttagctatctctccaggtaaacatataattttattttttatttttatttatttatttttttgagacagagtctcgctctgtcacccagactggagtgcagtggcacaatctcagttcactgtagcctccacctcccatgttccaccgattctcctgcttcagcctcccaggtagctgggattacaggcacacaccaccacgcccagctaatttttgtatttttagaagaaacgaggttttaccatgttggccaggctggtctcaaactcctgacctcaggtgatccacccgccttggcctcccaaagtgttagttaggattacaggcgtgagccaccacacctggtcacattttgttttcttaaccaataaaggtaagttgtaggaatgctcttataccccaaaatacctccaaatataagataatatcatctgcaaacaaggataatttgacttcttcctttccaatgtggatgcctttataactttctcttgtctgaacgcttgaggtaggacttccagtactgtgttgaataacagtggacatccttgttatgtttcagagcttggatgaaaggctaagattttccccattcagtatgatactaactgtgggtctgtcacatatggcttttattatattgaggtatgttccttctatccccagttttgagggtttttatcaggaaaggacgctgaattttatcaaatgctatttcagcatcaattgaaatcatcatatgttttttgtccctcattctgttgatatgatgaatcacactgattgatttatgaatgttgaaccatcctggtaaccctgggataaatcccattggtcatgacgaatgattttttaaatgttgttgaattcagtttagcagtattttgttgaggatttttacattgatattcaacagatgctagactctagttttatttccttccttccttccttccctcccctcccccttcccctcccccttcccctccccctcctctccccatccctcctctcccccttcccctccccctcccgtccccatccctcctctcccccttcccctccccctcccctccccatcccttccctccccctccccctcccatcccctcccccttccctcccttctcctgccccttccctcccctcccccttctcttccctcccccttccccttcccttcccttttccttcccttccctctcccttcctttcccttccctctcctttcccttccctctccttctccctctcccttcccttcctttctttttgatgtgtctttgtttggtttcggtatcagggtaacaatgaccttgtagaatgaatttggaagtattccttcttctgttttttggaatagtttcagtagacttggtattagttcttctttaaatgtttggtagaattcagcagtgaagccatcggatcctgggcttttcttcactgggagaacttttattatggtttcaatcttgttacttgtttttggtctgttcagatactggatttcttcacagttcaatcttgggaggttgtgtgtgtctaggaagttttccatttcctctagattatccaacttactggcatatagttgcttatagtagccactaatgatcctttgaatttctgcagtatcagttataatatctcctttttcatctctgatttcatttctgctctgatttttatttcttctactaattatgggtttggtttgttcttgcttttctagttaagatacatcattaagttatttattatttatttgaagtttttcttcttttttgatgtaggctcttaaagctataaacctccccttgagtactgcttttgttatatcccttaggttttagtatgttgtgtttccatcatcacatgtttcaagaaatttttcaatgtccttcttaatttcttcattgacccattggtcattcaggagcatattgtttaatttccatatgtttatattgtttgaaaattcctcttgttttagatttctagttttattccactctggtcagagaagatacttggtattatttttttcaatgttttaagacttgttttgtgacctaacatatgctctatccttaagaatgatccatgtgctgataaaaagaatgtgtattctgcagctcttggatgacattttctgtatatatctattagatccatttggtgcatagcacaaattaagtccaatgtttctttgttggtattctgtctggaagatctgtccaatgctgaaagtggagtgttgaaatctccagctattattgtattgaggtctacctttgtctttagctctagtaacatttgctttatatatctgggtgctccagtgttgagtgcatatatatttaaagtcattatatcctcttgctgaattgactctttatcattaaataatgaccttgtctcttcctacactttttgtcttttataagtgtaggaagagacagacattttgtctgatgtaagtatagcaacacctgctcttttttggtttctaccagcatggaatgtctttttccatcccttttttttttcagtctatgtctatcattataggtgaagtgtgcttcttgtaggcaccagatcattaggtcttgattttttatacatgcagtaactctgtcttttgattggagagtttagtccatttacattcaatgttattattgataagtaaggactcactcctgccattttgttatttgttttctggttgtttcacattcttctcttccttccatcctttcttcctgttttccttttaatgcaggtggttttctctagtggtaggatttaatttcttgttttttatattttgtgtatccactttacgtttttagattagaggttacaatgaagcttgcaaatactatcttattaatataatccattattttaaactgatgacaacactgattgcatacacaatcaagcaaaaaggaaactaataaaagttctaccctgctttttcactttttgttgtttctacttatatcatattgtactgtccatgtcttgaaaagttgtcatagttatgtttaatcagttcacgttttagtctttctattcaagacatgagtacttcatacaccacaattctagtgttacaatattctgcttttctgtgtacatactattaccagtgaattttgtgcctttgaatgatttcttcctgcttactaccatccttttctttcagattgaagagctccttttagcatttcttacaagaaaagacaggtctgttgctgacaaaatccctccctcagcttttgtttgtctgggaaagtctttatttctccttcatatttgaaggatattttcactggatatactattctagggtaaaagttgttttcttttggcactttatgtcatgccactctcccctggcctgtaaagtttccactgaaaagtctgctgccacaggtatcagacttcaattgcatgttgtttcttttctcttgccgcttttaggatcctttcccatccttgacctttgggagtctgattattaaatgtctcgaggtaggcttctttgggttaaatctgcttgaagttctataaccttcttgtacttcaatgctgacatctttctctaggtttgggagttctctgatattatttctctgaataaactttccatccctgcccctttctctacttcctctgtaacaccaatatctcttagatttgcccttttgagactattttctagatcttatagctgtgcttcattcttttatattcttttttcttttgtctcctctgactgtgtattttcaaagagcctgtcttcaagctcactaattcttcttcttgatcaattctgccactaagagactctgatgcaatcttcagtatatcaattgcatttttcaactctagaatttctgcttgattcttttttactatttcaatatctgttaaatttatcagatagaattctaaattccttctctgtgttatcttgaatttctttgagttttctcaagacagctattttgaattctctgtctgaagggtcacgtatctctctgtttctctagtattggcccctgacgccttatgtagtttgtttggtgaggccatattttcctggatggtcttgatgcttacagatgttcatcagtctctgggcattgaagttaggtatttattgtagtcttcacagtctgggcttgtttgtgcttattgtatttgggaaggctttccaggttattcaaagggacttgggcctcaagcccaataatgatgtggttcttgcagactggtagaggtactgccttggataaatctgggagaactctctagattaccaggcagagactcttgttctcttgttctcttcccaatccctgtgctctccctccccctagtgcagagattctccatgccacactgctgctgccaggggatgagaaagcggtgacaccggcaattcaagactgtctttcctaccctcttcagtgcctctttcagcaatatgaagttaaaaccagatactgtgagtgcccacctgatttttggttatgatggtgcttttttgtgtgtaattagttgctaaaatttcgtgttcttgcaggggtgacaatcattgcagccctctatttggccatcttgctccactcttcaagatttgtgtttaaaaactaagatctaccatataaaggaatgaagtactatattcgaaaacatacacaaaccttgaaaacatgctaagtgaaagatgccagaaacaaaaggctacatattgtccagaaaaggcaaatccataaagataaaaaaaagtagattagtagtggccagggtatagagtgaagggagactgggcagtctcagttatggatttttttttaaggggtgatgaaaatgtcctgcaattacatactggtgattgcacaacttataagtgatcaaaaaccaatgatacacttcaaaagagtaaattttatagtataaaataatatctcaattaaaaaaacaaaatctgtgcacaaagtgtgctcaatggtattgtttctaactcctctcaaaggacagctctgggaaacagatgtttgtatattcatttcatgtatgacacatgaacatgcatatatactcacccaacatctagctgttgatatataaaactcacactgctatctccaattccaatctaataccacgaggctcattctatcctttcccctattcagatttgtaattccctcctataacagcaagaaatcttagaatctcagaattggaatccagacacttcagctctcctaaccattaccctttaggctgaccatttattttaacaaaattacaacttactgaataaaattcagcaaacatctcttaattgatactcacagtgatactgtccaggagtttggccatatgtttaataatttcaccatgttgtgcaggttgcatttgcagtaatttctttataacaaccacactttcagcaacaactatttctgaaaaagatagaaattattcatactaaatatgtataattcaattcaaatgcaatatgcttcgtaaaatgtaaacttaaattagaaaaacattctatttaatacaagccttaaaagactatgtgaaagcataaccatgagtgcgcttccaaatttgaggtgtgaacaactgtcttaactaggagagttaactttaatttctaacctctgttgctgtctcctagcttctgtagttcctttcttatctctgcatctttagattaagaaagcaaaagacgttggattatgctgctcaccatagtgttctatgtctttggcttttaaccagagtcctcaaatattgctctttgattcctataaattatatagtggaaatcaattatctacaatctaaacaacattttccctattctgcagaaaacagcaaactaaaaaaaaaatttttccttaagtgaaatgcccagaaaagtgagtagtaaagatgagtggtagtagtaaagaagtcactgtagaaatagcatggagtgcaaagccggaaagaatgggattgtgagagtgagatggattttctctatttgttctataaagtccactctacctttctctccccagcactgtgccctaagaggcccacctgtagtctgcctcaaccagactcccttggtcctggcttatagctgtgtttagtcaatagaaagcttcagcaggagatggtggggggagggcggggatatttgttatcctggatccctactctgccagcctcctctccctggtattacatgcaatcccctactgaaggtactgcaagtggctcactcctgcagggtctggtaactgctcctgctcctcacaccccttcccttcaatctgaggcatggtaaaggcctcccactgttgatagcctgttagctccagggtgttacatcatatcttgttggtttcccttaatcctgaccacagtttacaaacagttcattcacttaattcacttcaatcatcccttttaagtgtgccatctgtttcttgccagagccttaactaatacagtaactactactggaggtggataggaagtagatcctcaaactgggattacgggatttagttatcatactaaactggccaatcactggtccagtctctttttggtggtactggtaaagaaacgtaacataactcacctgagaacctgaccttatgaaatgaatcttatataatgtgttattaatgctaatgatgccaaagaaataaatcaacattgcctttacttattattttgatatttttattaatagggcttcatggctattaggaattcccctggcatacactacaaaggtttattttaatattatattagaaataccataatttgtgtcctattactctttttttttgagacagagtcttgttctgtggcccaggctggagtaccatggcgcaatctcagctcactgcaacttccacctcccagattcaagcagttctcctgccacagcctcctgagtagctgggatttacaggcgcgcgccaccacgcctggctaatttttgtatttttagtagagacggggtttgaccatattggtcaggctggtctcaaactcctaacctcatgatccacccgccttggcctcccaaagtgctgggattaccggtgtgagccaccatgcccggcctactctttttcactgaaatgtattttttataaagctccgtttaagaatataaacaaaattcatcattctaatcattagtaaatatatgtatttcaaactgtttacctgcttatccataagaataagaaattaactaatattgactgggcacagtggctcagcactttcggaggccgaggcaggaggatggcttgatcccaggagtttgagaccagcctgggcaacatggaaaaccccaggtctacaaaaaatccaaaaattagccaggagttgtggcacgtgcctatagtaccagctattcaggaggctgaagcaggagaatcacctgggccaaggaaggttgaggcttcagtgagccgtgatcacaacactatactccagcctgggtgacagagtgagaaaagaaaaaacaaaaaaaaacctagtatgatttaactaaaagctaactaatattaatgcttcagtttacaaaacaacatcacatttcatttccttctcacaataatgtaaagtaggtaccttattattattattttaaagatgaagaaagggagatgcactggaattgtataactttacccagaattcaaactcagaactaggatgtacattctatctatatacgttctatgttacgataggcaggtattacttctttttttttttttgagatgttttgctcttgtcgctgaggctggagtgcagtggcgcaatctcggctcactgcaacctccacttccggggttcaagcgattctcctgcctcagcctcccaagcagctgggattacaggtgcccgccaccacgcccagctaattttttgtatttttagtagagatggggtttcgccatgttgggcaggctggtcttgaactcctgacctcaggtgatccacccgccttggcctcccaaatgctgggactacaggcgtgagccaccgcgcccacccataggcaagtattacttctataaagactacctcttggtgctatgaggaaagcaaaggtaaatcagaatgagattctgccctcatcaaacttacactctagcagaaaaataaatggttatgtgattactatgcaaagcaaaatttggtaagtgtggttttaaagaatgcatagtataacaaatttatatttttaaaatacattattgcaaaactagcctaagtaagagaaaaaaatgttgcataatttaattatctacaagcagacgcaggattggctacagttgaaatatgcgtttggcatcatttatctttaggaactacattagtttcctattgttgctgtcacagattactaaaaacatagtggcttaaaacaatgcaaatttatcattgtacagttctaaagtcagaagtctaacataggtcttatgggactaacatcaagctctcaacagggctgcgttccctctggaagttctaggggaaatcttttccttccccctcccaacttctcaagcatgcccacattccttggttcaaagacctcttccaacaatcacatcaccctgaccttctgacatcttctgactgacctgcgtctctctttcccttataaagacccacatgataacattaggtctaaccacataatctccccatctatagaaacttgacttaatcaatctgcgaagtctctttttccacgtaaggtaacatattcacaggttctgggcatctttggaacgcaataattctgcctaccacaagtgccttctcattcccctcaggtaattccactctacttctcctttatggtacctcttggtttccaaagacctcagcactttggtgctactctatcagaagcacaaaatgatcctatgttctagatatttcctaacttcctccttgtcctcaacaaatcttaatggacctaactttaaaaagtacagtctactatcatactcattttacaaatgaagaatctggtgcacaggtagactgggtaatttactcaggatagctgtaacattctacataggtggtatagtcctacatgtaagcaaatagctggcaagagagtaagtggtcactatatgggaagactataatatatttgtcttatattactatctccctccaatggactattagctctataaagataggaaccttttataagttaaataaatatcctattaatatattcaacatttattaaacatctcaactgatttaagtcttcaataaatgcttactgaattgtttaaaactaaacaaaacaaagtcttctgccccaatccttttagtttagagtagatggcaataaggttattcaaaaaagtaaatttcgctaatatgttacctaaaataaattacctaagtcaactgaaatgtagatttctcttactaaaggtctataagaaattggcttatcaaattaatcttagagagtaataataggctgttttagggcaagcttcaagtctgcttagaaaggctcttaacaacacacacacaaaactagaggtccaagagaaatatattaaacatatttaaaaacaattgagcctaaatgtccctgaggtttaaagattcattatttgaacagatgatgaggtattcatttcaatataaaatcaaataattacagattcctagagccttaaaagatcttaacagattttaaagaaactgagtcttcattcacagtatttattcctaaaagtagatcttttaatacaaagaggaaggggctctattgtcagggtggctatgttaaagttaaaaatactatgactttcttttatgttactaattttgatataaatattctccttatttgttttacctctcacttttactgagccagacttccaaactacaaaaaatagtgtagcatatgtgatacagacataattaatcaggtattatgggctaatgatgattatgcaaatataatctgacaatacaatttaagtttgttaatattcacactgcaggaaaaaaaaaaccatgattaagagttgtatcaaaaaacaaaagcctaaccattaaaatatcaaaatttaaagtagttaaactaaatccttctacttttagagaggaagtatgtattagtctttcattttctaattgtaaaacaatctagtcttcccttaaaagtgatgtaggggtagaatatttatcttttaaagtcaataaaaatattttttgagaaattaaatctgaagcagaaataactgctttaaaatccaaagcttgaaattttccattagaaaaaaaaagtcaaaaaataaaattgagaaaatttgaatatattttgtatttgaatgaactaatcagtgttctaactaatttccggtgctttctgtatgtaactaaaatgtaaaagaacaattgccctggtaagccttggttcataatctttaatggtacaaagttattttcccaaggtgtgtattttatttggttgaatagaaagtcattattaaaggcacaggaaaatttctttaaaacacatttttaatgtcacattttaaaatgtgacatagaaacagagataaaaggattagttattattaaaagtagaaagagatagaatggatgacgtttatcatcctatctccactagctactttgtagagataaaaaaaaattttaaacctatcgtcttgataattttggttggcatttatttggagttttaatactacatgtagaaaaatcttcagtcatagtatcttgagtttacaggtacaagtttaaaattttatgctcacaacaaaaatcaatgttatctgggaataaattttgttccaatttttttcatcagaaatactctcaacaatgttacagttttctaaagatatctacatgtgggaaaaaataattagagattataggattcttgtactaaaaagttatttttcaaataaaatgtaatcaattttgttgttttacctcatgggctgctatatcatatatgcccatatctagacatgacatagacattagtatattttaaattccacaaaataatttcaatgattttacaaagaaaattatgcttttcttaaaaaagtctcattttaatacataattataataaaagttctttaaacaaaattattttaaaggtaaagttggcttttctttctttctctaaatggctccatttatttcaaagccttacccatagaaataactgacgctttgccacagaacaatatgggatctagcttacatattttactggatattacctatccagttttaccgaacacttagatattgtttggcttaaaaacacaaagctgctccaagtttatggcttttaaatctagttaattttgaatataattaggtgaatttctgaggaaaaagaatgttgaaggtatacagttaacatattttttgatctagccacttctccatgttatagtcatttgcctgcttttagcaccctctgcaggtgaaccaatattatgcatgacttacatgccattaaaatgcagtaaaaaggtggaaaagatacaatcaaggtgattaaattgtaaagaagtaaaacaaattttcttagatctgttgcggtaaaacaaatactacctgctagttaatggcctattttactaaaaaaaaaagaacccagaatatgcatatttatgtgcattcaaggataaaatgctacttattgtgaccatactactgatataactggaaaagctaaaatgcaaagttagaaaaggttacaacttggaaataataccaagaatattcaaatttaaatcacctgaaaataaaatgaaactgtaaacttaccatccctgttggacagcagacagaccaagccattgaggcacgtgtcagtgacttccaagatgttggttgcacatctgcctatagtctgaatagtggctgctgcaaattgtttatcctggcttttcacataggtctaaaagatattatttcaattagtttacacactggtattattgagttaaccaaaactccgattatattaaactttgtcaatatataagaattccagaatacataaacttctcataagcacaatatgaggaccaagtgatgatgtagattaatttcattttgttttgatttttttacttaaagaatgtgcctatggacgaagcacattttcaagccaggctcattcacctgtggccatagtggcttgagactccaaaacagatagtaggagcagtcacccaaagacagcaattagtttaagtgcaaggttgaaagagatgatgagagctctctctttggaggtttcagttcatttaccagcagcatctgtgaatctatgaaaaaaagggtcactttttcagagacactaaatctaaaaactgggagaaaaggaagaaagggaccagtaggctatttacaaacattttaatttcaaaatctatcacaatggttgtaaaagaataatagttacggtgaacagtatttcaataaatacttcaaatactcagtttataataaaataaaataccatacttttgaaatagattttctttaaaagtatgctttaaaaatatactgtaaagggtatatgtgtgtgtgtgtatatatatatatgtgtgtgtgtgtatatatagtatatatatagtatacatatatatatatacacacacacacatatatatatacacacacacaaatttaaaaataaagaaataaatcactgatttaacaacaggaagttaaaatatctttataaattttataatggccctagagaatttcactttgcttagaaccttcctaatttttaaatgaggaaagcttctattgtttacagaaatatacacactttgtatcatatacatgaaatttgaaaggtcatttacaatcgaaatttttaagaaagattcccaacctcaaataagaagtatacaatgtagacttaacactatgaaaaatgcaatacatttaagtggtgtctaaatgacaaatggaggagaaaacctaaagatgtctaaaaaaatacaaatttgctaaaaatggtaccaaccaggtgattaaacattgaacaaataaattaaattaattaaactctcctagttccatgaaggcaagaccaattatatttaaaagtgttcccaaataaattatttaatttccttaaagaaaaatatgaacttatgagtctttagaaacattccctattttacccaaaaagttactaaaagcgtaactatgagcataacacaaacatagacagaaggtacaaatttagacagtgataaaaatgaatacatgaaaaaaatacttaaaagtttgactgaaaaatggaccttattaaacatcctgatattaaatgaaaagactagatgaccaatattttgaaacaggtctagtatgtgccctctatacaacccattccataacattacctaagtctcctttcctacaatcccaggagacttgatataagcaaaaactggacagtgagaggacacccaaagagactagataggacaacaggaaaggaacaagaaaaaacacaaagaccaatactttaaataaataaaattataggaatgaagtgaaaatcagattcaagcaatgatctgcagctataagattactgaataataacataaaatagtatattttctagaacatcttaattttttaagaaatttgtctagaaagatacacaacataaaagtggagtaatccaggtatgaaaatataaattatggacatgccatattattctactattcctgtaaaaagtttaaaaatcacatagctaaaaagaaatcgtgtatacagtgtcttataaccaagaagaaatttaatattggcatataggagaactatggcaaaaaatacatctctaaaagttggaagctgataaaagaaaaactctgtgattagtgcatagtatgtggtatatttttgttaagaaaacagatagtggaatataaaagtcataatactgatgtaaagttttctattgctgtgctctacaactaaggcttcagagatgacctttccatcataaagggtatcatgtccatgaagtaatttttgaataatattttggggggaaatgcagctaggaagagtctcataaggcataaaaatacaactaaacaaatcaaaataaaaaacagcaatttaaaaaatcgtagtggggcaattatgaaacaaatttttttgagctatatatgaggctaagggggcagtgtcaaaaatagtcataggtcaataaaatgggaacaaccaggtaagaaatgaaaccgttttcatgaccacagaatatagaaaggactattgatgctggcagcacaaaaagatgaaattcttaccagaaatacaatttcaaacaaagacagagttataaaccaaagtccttcaaagtctatgaaaatatgaaagagaatactatgttttccttaaattataaattgtaattagtttattcttgcaaatttatgaatttcttagttgtcagtcttgtcccaatcactattttatgtacataattacatatttctagatagaaaaagatgcatatttaagactgaacatatgttttagaagttttttataattagcactgtacacaaacctgaaattctcgaagaagagttgatatgttggcttcatttgccaagtttgtcaaaatttcaagctatagtagagaaaagagaaagtaaacattttaaaacaaaggtagcaagatgaatttaatagagtacagacatttaattgaaagtttatttctacttttaaaaatcacattgtcagccgggcacagtggctcatgcctgtaatcccagcactttgggaagccgaggcgggcggatcacctgaggctgggagtgcaagaccagcctgaccaacatggagaaaccctgtctctactaaaaatacaaaattagccgggcatggtggtgcatggtggtgcatgcctgtaattccagctacttgggaggctgaggcaggagaattgctggaacccaggaggcagaggttgcagtgagcaggagaattgctggaacccaggaggcagaggttgcagtgagccgagatcgcgccattgcactccagcctgggaaacaagactgaaactctgtcacacacacacacacacacacacacacacacacacacacacacacacacacacacaaatcatattgtcgccaatgtggtaaggcattatacccttcaggtcaacttagtctaccttcttatgtccacaaacagatattagacaattactagttctttgaaaacaattcggaaaaggagaattctacatcttcactaattgtctgcccaatacaaacttataatttatatctaattaacctaaacaattctgctagtttggctttttgtcttttagtaaagttagaaaacaatttgccctccatgttaatacatctgctttccagataccaattaattcttttgatttgttctcctatagtctaccatcccaaatactcagacattttaattctctcttctggatttatagatataaacaatgtgtaatctccaatgggcttgtgaaaaaaaatttttactaataaaaaatatttagtcttaagaaaatcacaaaaaaatagaagagacaaacagaagcaaatcaagatgtgaacataaatacattcatatcaataaactacattaaataaagccaaatacttagagccaactgatctttgacaaggcaaacagaaacacaaaatagggaaaggataccctattcaacaaatggtgccaggataattggcaagccacatgtagtagaatgaaactggatcctcatctctcatcttacacaaaattcaactcaagatggatcaaagacttaaatctaagacctgaaaccataaagattctagaagataacatcggaaaaacccttctagacgctggcttaggcaaagacttcatgacccaaacccaataacaaatgcaacaaaaacaaagataaatagatgggacttaattaaactagaaagcttctgcacagcataagaaataatcagcagagttaacagacaacccacagagtgggagaaaatcttcacagtctatacatctgacaaaggactaatatccagaatctacaaagaacacaaacaaatcagcaagaaaaaaacaatcccaccaaaaagtgggcaaaggatatgaatagacaattctcaaagatacacaaacggccaagaagcacatggaaaaatgctcaacatcactacttattagggaaatgcaaatcaaaaccacagtgtgaaaccacctcactccaccaagaatggtcataatcaaaaaatcaaaaaataatagatgttagcatggatgtggtgaaagggaacacttttacactgttggtgggaacgtaaactagtacaaccactaaagaaaacagtgtggagattccttaaaaaagtaaaagtagaactactgtttgatccagcaatcccaccagtaggtatctacccagaggaaaagaagacattatacaaaaaagatacttgcacacacgtttatagcagcacaatttgcaatggcaaaaatatggaaccagcccaaatgcccatcaatcaacatgtggataaagaacatgttatatatatacacacacacacacacacacacacacatacacaccatggaatactgctcagctataaaaaaggaacaaaataatggcattcacagaaactagatagaattggagactattattctaagtgaagtaactcaggaatggaaaaccaaacatcgtatgttctcactcataagtgggagctaagctatgaggatgcacagacataagaataatacactggactttgggggctcaggggaaagggtggggggtggtgaggaataaaagactacacattgggtacagtgtacactgcttgggtgacgggtgcaccgaaatctcagaaatcaccactaaagaacttatgcatgtaaccaaacaccacctgttcaccaaaaacctactgaaaaaaaaaaaaaaacaaaaaaaataaaacagcaaatgatctaaacgctccaattagaaggcaaagactgtaggaggagttctttacatattctgagtacaaatcatttattcagacacatgtattagaaatatttttcccagataatcttttaatttttaattttattttgataactatattttaacttttagacaacttttttcttttttctttttttttttttttgagacaaggtcttactctgtcaccgagggtggagtgcagtggtatgatcatggctcactgcagcctcaacctctggggctcaaacaatcctcccacctcagcctcccaagtagctgggactacaggtgcataccaccaagctcagcttattttaaatttttttgtagggacggagtctcgttgtgttgctcaggctggtctcaaactcctaggctcaagcgatcctcctgcctcagcctcccaaagtcctaggattataggcatgaaccactgcatccagctggacaacttctaaaaaacaatctcaaacataggaaaaagctacacgtatagtacaaagaactgttgctgttgtttttctgaacgatttgagacgatagatgccaatctgatgctacattatccccaaaaacttctatgtatatttcctataaacaaggacatgttccacagactacagtacaacgaagaaaatcaggtcattaaactgatgcattactttcacacaattgtcactatgcacgtaagtttcaataactgtctcaatgatgtataataaaaggatccagttcaatatcacatactgtattaagttgtctcctttggtctgaaacagtttcttagtctttcttttaacttatatgaccttgacattttcgctaattataaaccaggtttttttgataaaatatccttgaatttgggtataatttagattttattattaaactcagttttcatatgaataatacatcattctaatattgaacagtcttgaatagtccatagtccatcctttcctcattggtttgtaatatctcctctactatatggtacatttttgcgtgtatgggcacatttctaggctttctactctttccacttacttttctgtctaaatatcacactattttaatcactatagatttatattcctaactgcactctatgccatacttattacttcctgaaaacaatgctctttcataatcccttgtgttagcatgaattatgtttttcacctactctaacccttcgacctcccaatcaacctgccaaccaagaaaaaaattcacaatattattcttttaagatccacccaaacatcatcttttctaaacctctcatagaattagctccacctttctgttcttcacaacactcaattcaaatatctgtattacttaaaacacacagtactaaaataagttagttagagacagggtctcaggctggagtgcagtggcatgatcaatggctcactgcagcctcaactttctgggatcaagcaatctgcccacctcagcctcccaagtagctaagattacagacatcggccaccacgcctggctaattttgatttttttaaagagacagagtctcactatgttgccgaagctggtgtcgaactcctggcctcaagcaatcctcccaccttagcctcccaaagtgctagcaatacaggcatgagccactgtgccaagccctgaagtttatttatttatttatttatttatttatttatattattatacattaagttttagggtatatgtgcacaacgtgcaggtttgatacataggtatacatgtgccatgttggtttgctgcacccaacaactcgtcatttactttagatatttctcctcatgttatccctcccacagcccacaaacccctgacaggccccggtgtgtgatgttcccggccctgtgtccaagtgttctcattgttcacttcccacctatgagtgaaaacatgcaatatttggttttctgtccttgtgacagtttgctgagaatgacggttgccagcttcatccatgtccctgcaaaagacatgaactcatcctttctaatggctgcatagtattccatggtgtatatgtgccacattttcttaattcagtctatcattgatggacatctgggttgcttccaagtctttgctattgtgaatagtgccgcaataaacatacgtgtgcatgtgtctttatagtagcatgatttataatcctttgggtatatactcagtaatgggatcactgggtcaaatgatatttttagttctagattcttgaggaatcaccacactgtcttccacaatggttgaactagtttacagtcccaccaacagtgtaaaagtgtttctatttctccacatcctctccagcatctgttgtttcctgactttttaatgatcgccatactaactggtgtgagatggtatttcattgtggttttgatttgcatttctctgatgaccaatgaggatgagcattttttcatgtgtctgttgactgcacagatgtcttcttttgagaagtgtctgttcatatactttgcccattttctgatggggttgctcttttcttgttttttctggatattagccctttgtcagatgggtagattgcaaaatttttctcccattctgtaggtggcctgttcactctgaaggaagtttcttttgccatgcagaagctctttagtttaattagatcccatttgtctattttggcttttgttaccattgcttttggtgttttagtcatgaagtccttgcccatgcctatgtcctcaatggtattctctagattttcttctagggtttttatggttttagctctaacatttaagtctttaatccatcttgaattaattttttgtataaagtgtaaggaagggatccagtttcagctttttatatatggctagccagttttcccagcaccatttattaaatagggaatcctttccctattgcttgcttttatcaggtttgtcaaagatcagatagttgtagatatgtggtgttatttctgagacttctgttctgttccattggtctatatatctgttttggtaccagtaccatgctgttttggttactgtagcctcgtagtatagtttgaagtcaggcagcgtgatgcctccagctttgttctttttgcttaggattgtcttggcaatgtgagcttttttttggttccatatgaactttaaagtagttttttccaattctgtgaaggaagtcattggtagcttgatggggagggcattgaatatataaattaccttgggcagtatggccattaccactatactaattcttcctatccatgagcgtgaaatgttcttccacttgtttgtgtcctttttttatttcactgagcagtggtttgtagttctccttgaagaggtcctttacatcccttgtaagttggattcctaggtattttattctcttcatagcaattgtgaatgggagttcactcattaatttggctttctgtttgtctgttcttggtctataggaatgcttctgatttttgcacattgagtttttatcctgagacactttgctgaagttgtttatcaacttaaggagattttgggctgagacgatggggttttctaaatgtacaatcatgtcatctgcaaacagggacaatttgacttcctcttttcctaattgaatacccgttatttctttctcttgcctgattgccctggccagaactgccaacaccacgttgagtaggagtggtgagagagggcataattgtcttgtgccagttttcaaagggaatgtttccagtttttgcccattcagtatgatattggcagtgggtttgtcataaatagctcttattattttgagatacattccatcaatacctagtttattgcgtgtttttagcatgaagggctgttgaattttgccaaaggccttttctgcatctattgagataatcatgtggtttttgtcgttggttctgtttatgtgatagattacatttattgatttgcatatgttgaaccagccttgcatcccagggaagaatccatcttgactgtggtggataagctgtttgatgtgctgctgaattcggtttgccattattttattgaggattttcgcatctatgttcatcaaggatactggtctaaaatcctctttttttgtgtgtgtctctgccaggctttagtatcaggatgatgctggcctcataaaatgagttagggaggattctctctttttctattgattggaatagtttcagaaggaatggcaccagctcctctttgtacctctggtagaattcggcagtgaatccgtctggtcctggactttattggttggtaggctattattatctcaatttcagagcctgttattggtctcttcagagattcaacttcttcctcgtttagtcttgggagtgtgtacgtgtccaggaatttatccatttcttctagattttctagttgatttgcatagaggtatttatagtattctctgatggtagtttatatttctgtgggattggtggtgatatctcctttatcattttttaatgcatctatttgattcttctctcttttctccattagtcttgctagcagtctatcaattctgttgatcttttcaaaaaaccagctcctggattcattgatttttcgaagggtttttcgttattgggtatttcgtttttgaagggtatttcgttattattgaagggtatttcgttatcttaattatttcttgccttctgctagctgttgaatgtgtttgctctcatttctctagttcttttaactgtgatgttagggtgtcgattttagatctttactgctttctcttgtgagcatttagtgctataaatttccctctacacactgctttaaatgtgtcccagagattctggtatgttgtgtctttgttctcattggtttcaaagaacagctttatttctgccttcatttcgttatttacccagtagtcattcaggaacaggttgttcagtttccacgcagttgtgcagttttgagtgagtttcttagcctgagttctaaatttgattgcactgtgctgtgagagtttgttgtgatttctgttcttttacatttgctgaggagtgctttacttccaactatgtggtcaattttagaataagtgtgatgtggtcctgagaagaatgtatattctgttgatttgggatggagggttctgtagatgtctattaggtctgcttggtgcagagctgagttcaaggcctggatatccttgttaaccttctgtctcgttgatttgtctaatattgacagtggggtgttaaagtctcccattatttttgtgtgggagtctaagtctctttgtaggtctctaagggcttgctttatgaatctgggtgctcctggattgggtgcatatatatttaggatagttagctcttcttgttgaattgatccctttaccattatgtaatggccttctgatctttgttggtttgaagtctattttatcagagactaggattgcaactcctgctttttttttgctttgcatttgtttggtacatcttcctccatccctttattttgagcctatgtgtgtccctgcaggtgagatgtgtcttggggttgctcttctcgaggagtatctttggggtgttctctgtatttcttgaatttgaatgttggcctgccttggtaggttggggaagttctcctggatgatatcctgcagagtgttttccaacttggttccattctccccgtcactttcaggtacaccaatcaaatgcagatttggtcttttcccacagtctgttatttcttggaggctttgttcatttcttttaagtcttttttctataacctcgtcttctcacttttttcattaatttgatcttcaatcatggatacactttcttccacttgatcgaatcggctattgaagcttgtgcatgtgtcacaaagctctcgtgccacagttttcagttccaacaggtcatttaaggtgttctctacactgtttattctagttagccatttgtctaaccttttttcaaggtttttaccttccttgagatgggtttgaacatgctcctttcgctcggagaagtttgttactaccgaccttctgaagcctacttccgtcaactcatcaaagtcattctccatccagcgttgttctgttgctggtgaggagctgcaatcctttgtaggagaagaggtcctctggtctttagaattttcagcttttctgctctggtttctccctatctttgtggttttatactacctttggtctttgatgttggtgacctagagatggggttttggtgtggatatccttttagttgatgttgatgctattcctttctgtttgttagttttccttgtaacagtcaggttcgtcagctgcaggtctgttggagtttgctggaggtccactccagaccctgtttgcctggttatcaccagcggaggctgcagcacagcaaatgctgcagcacagcaaatactgtagaacagcaaatattgctgcctggtccttcctctggaagcttcgtcccagaggggcaaccacctatatgaggtgtctgtcggcccctagtgggaggtgtctcccagttaggctacacgggggtcagggactcacttgaggaggccatctgtctgttctcagagctcaaacaccaagctgggagaaccactgctctcttcagagctgtcagacaggtacactgatgtctgcagttgtctgctgccttgtgttcagctatgccttgcccagagtggagtctatagaggcagtaggccttgctgagctgtggtgggctccgcccaattcaagcttcccagccgctttgtttacctactcaagcctcagcaatggtggatgcccctccccaagccaggctgctgcctcgcaattcaatctaaggctgctgcgctagcagtgagcaaggctctgtgggcgttggacctgctgagccaggcatgggagagaatccccttgtctgccggttgctaagaccttgggaaagcgcagtttttgggtgagagtgtcccgtttttccaggtacagtctgtcccggcttcccgtggctaggaaagggaaatcacccgacctcttgtgcttcctgggtgaggcaacgccccactctgctttagctcaccctctggggctgcacccactgtccaaccagtcccagtgagatgaaccaggtatctcagttggaaatgcagaaatcacccatcttctgtgtcaatcatggtgggagctgcagactggagctgttcctatttggccatcttggaacaaatctccaaagttatttatttaaatgcctgtctccttcagtaatctgtgagttattcaagttgtaggtagcatggcttaactttacattatcagaatgtagtacagtaattagtatataataatatagattgaaaagtataaagaaaaaccattaactttatcaatgtgttttgaaaagcaggactgcatcccacaggtgctaaaagctatagaaatatctcttcaaaacaaatgtgttaaaagcctctgaaaaatgaaagcatacataccttcagtgtcttgatcatagttggatcagttgacctaacatagaaactcttcagataaggttcaaacatcccctggattacaaaaataaatacaaaaatacattatggtactaatgtgttcatgtgtctcttaaattacgtgttcagaacatacatacctttctttgaattgacatagttgctatattttgtaggacaatatactgcacctccctagaaatcaaaagataatttttactgggtatatgttccaatgaaacatctttgagtaagcactacaataatgacaaagaattagcaataatttcaagtgaatgagactcttaaatgtaataatgaaaagtttttagtaaatcttagatgtgtgtctttttaacgcacttttcctataaaataccaataaattagacgtgattcatcatgaagaatagttaaaacaaattttataataaagtgctcctaaaatatgaagttaacattgtacctgctttgaacacatccaaggaaggtattcttagggttaataggggtagataggaccacactgttattataaactcattaaataactcattcttcccagggcaaaggccagattttaaaagtagtcatgttatttttagacccaaatatctaataaatgaactgaatctggtataaggcttcatgtgaaagaccaattccaggtctttctgatatcttttgaactagccataggaaaaaaaaaaaaagtattgaactagcaaaagagaaaaataatagctggatatacagatagggagaataggaacacaaaggaaatggcatctcatttgttactaagccagtcaagagctacaattgtggactaagttccagttaagggcaaaaataaatacatagttttttccttccaacgcaattagtggaaacaagcactcaatgaaaaacattgtttcaaattaaaacaactaattactgaaaaatagctaaggtatgtcaaatagctgaaatgaaggtattcttaaacacagaaacaaatgtctgaattaaacctgaaatcatgattctcatgttatatgtcatggaaactcaataaattgttttgaatcgttaacctaaaccactaaattataaagaggtaaaatcaaagaaggtggcatgctctttctgtctgtctatctgaaactaagagtatgcaatctttaaaatgagtagctattaaaaacacagctctctttttagagtggagcaaagcatagtaattaaatattccagctttataggaagcacaattctggcataaactacattacttagcatacacattgctctatataaaaccatgtattaatacattgagtaagtcaatctgatagtacttcagtatagtttttcagtgattccagatttaccaaaactcccaaacatcattattgccatacctaaaaatttcaaacactaatactaggctactagtgacactctagtgttatgccacaaaatattttcaatatctttgggcttgaggttaaaaagtttcagtatttatcattaagtttgagataaatgcataaagacttttataataatccccttaagtatgaaatcttactgatcgattgattaaaatatagtcagagttatatattaaatgcctgaaagattacatttgttcaaacattacttttgaaggaatacaaaagaaaaaatatatataaaatcatgacctacctattgctacgaagtaaacgcactagtgatttagaaattatgccagcttcagattttggtgatatgtgccaatacagctgagcaactgccataaccacctacaagataaagcataaaaataacagaactatgaacactagagcactctacaacctcaaaatccattcctacacattatttcctctaagtcctacaaattcctgtgacgtaaaatggaatgttactcttcgtagtgagttgaagaagtgtcccccactcccagtgcccaatactatcctcagaatctgatcttatttggaagtgggatctctgcagaaattattaatataagaattgaaatgacatcatgctggttaagagccctaaatcgaatgaacgtgtccttataagagaaaaaaaaaggacaaaaagagacaccgtgaaggccatgtgaagatggagataattagtgtgatacacccataagccaagcaatgccacggattgctggcaatcaccagaagccaggaaagagaaggtttctccctcagagcgtacagaagtaaccaatactgattataccttgatttcagacttctggcttcctgaaatgtgacagaataaatttctgttgttttaatccactcagtttgtggcaatatgtatggcagtgctatgaaaagaatacatcctcagaaaaaaaaagagacactgaatgaactgctcaaggtgtaacagctagtacgtggcaaagctcaagacactcgaaattccatgctcctcagctgctgctctgagactggggctttttaagaattataagcatgcctttctaaatgaagccaggataacagtaactagtaggctgaaataaagaaaactcagcacatttaagttacaattaaagaaactccattaaaacaaatacatctacagcagtagcatttaaaataatcttgtttttaaaaacacagaaccttaaaaatggcttctggttcaaagccattataagggtgattcaaagactgggcacagtggctcacgcctgtactcccacccctttgggaggccgaggcaggtgggtcacttgcagtcaggtgtgagagcatcctggccaacatggtaaaaccccatctctactaaaaatacaaaaattaggttaagcgtggtggtgcacacctgtaatctcagctacttgggaggttgggacacgagaatcattgaacccaggaggtagaggttgcagtgagccgagatcatgccactgcactccagcctgtgcaatggagtgagactctgtctcaacaaaacaaaacaaacaaagggtgactggaatttctttgtctcaaaacagaagagtactgtttcccctaagtgcctctacactcagattcagagtgacaactgcagagacatagctacagatgttaccaatgctgcctttggctcaaaggacacactaatattaatttaattctgcctggtctatgaagtttgaacaaatatatagcaaaaattctattaatatatatgcctaaatagtatacagcacagaagaatgtttgaggttaaaaaaaaaagtttcttctgaaactaaagaaccgtttttaaaaatacagtatacagggtcctaaatttactgtttgccatttcttgtactttcttacaagtttgatttatagctttaagatattagttgagaatttaaaaaatgcaagaatatctcatttcttcacttgtgaactgcaaatataagttggttacaaaataaactctcctgaattttaaatcttataaaataaaagaatctcaattaatgattgacctaatccaagatcagtcatttaaaaaaatattaacgcatatacctggctaataagtattagtaaatgatagaaaagaaagctgaatcttaattttaatctatcttacagatagtaaatccttttcccttacaaataaaagtccaatcctactggcaagaaagcaaactgtacttcctatacatgtcaatgtctttaaaattctagctgccatttggcatgccatctgttctaatatattagggtactccaaaatccaaaaggactaaatgagcctctttttcctcggtatttagaaatccaacagttgaaagtcgctttgatacccagatttgaaatgtataggctaatttgtaaacgccatgaaaaaagttcccaaaacttcaaaatccaaaaagactaaaaatatacaaccttatagaccttctacagttacatcatgcctgttcataataaagcgcatcctataaacacttttctactcttaaccattcatgccgctgtcaccttatttagactgttagaatagcctcctaacattccgctttcagtatctatctccagtacaaactacatagcaatgatgtattatgtttcctgaaagaaattctcaaagtctctccataaacttaagtacgaggttaaaaaaaaatctatccacaattcttcaaaagttagcctttactcatatttagcagcatcccaaaacaaggtaccaaaatacactgacacaaaaagtaaaccacctctattacagcatcaagtaagcagggaacccaaacaaaatgggaccagaagtacaaactgccactatttgtttcactatttgaaaacgtttttgatccataagtatttgaactataaaatcaatttctaagacctagttaaatgaacagtgagtcactcataaagtacagcttaagatggcaaattacagctacctaactagcatctggctaagctgagtacattaaaatataagcatattttacaacagccatgaaataatattttcattatgactaggcatgattactgaataatgatttggaaactaaaccattaggtattagacaaaaattgttgttgataacttggatatacaaagctgtaagctctaaattctcaagaatcaattcattaagaattgttctgaacagaacaattcattaagaatactttctcaattaaaatctttaagaacatgtttaacctaaatccgtcaagcctttggatataactgccagttaacaggaaacacagaatataaaagaattaaatgacactataaaagatgcaaccatcccattccagtaggtatagcaaacaaaataacaaaataaaaagaagcagcagcaatcagacaaacccagaaggacattctgcaagacttgacaggctttaaaagatgcaatgcattagataatggtttggataaatcatccaaaaagaataatttaagatcaattggtattaaatgaaatgaaattttattaaaataaaaagtagagaggactgactagagaaaaaaaggttagaaaatgctatgtacagtatgatttttatcttggttaaaaaatatatatatatgtatgtgtaaccatgaatatatgtacacttatgcagattagaaagatctggaagaaaatacactaagacataagtgatttctgagtgttgagaatgtgatgttttaattttctttttagttttgctagcctgtaatttctaattttgtattgtgcacatgtattcttctaaaatataaatggttatataaacaaaaaggtgtcgaacaaacaaaaaaaaccttatgacccaaataaagatgatttttaattactattactgccaatttacatttataatatgtgaggcattacctttgttagtctcttaaaaattctatcagacagatacaaacagtatggactaataccagatcaagtacccccaatcacaatggaataactgataaatatacatagttcttatataagagctaatataatccaaccaattgagaaacaacttagaaatatcttaagaaaagccaattaacaaaaccattaaaacgtaaatgaagtccaataggccaaaccaggtattgtcatcaaaacctaactctgtatacctggaaacatggaaggctgaaatatatttaggtattacttctcagacattaggtctctaaatctatagcttacattccacactgtacttccaactatccattacatgtcatttggtgtgtaaacaaacaaatgctccattagcacacacagactcacttactaaattgagatatttttaattgctgttttttaaaaaccagtgaattatttcttataaggattttaacataccgcagcattcctgctctgaagcaaaggctttgtatttctaattaagagtctatgatctggatccatagtatacggcttcttctttttgtcagtcttttccttctgatcatcatcagattcgtagaaattctttccattgtcttctaattcatcaccctacaatgaaagaaatccaacccaagattactttagaccttgagcaatctgcatattatatagtcaaagaaaactttcctttaaacatctataacaacattttaccgtagaatacttctgtttgggcaatttaaaaatattacacaacctatatcgaataaaggtctattgatttttctcatattttataacaagttactgtgctatagatgatgtgcttctattgtattacaaagtaaatttttgactattaaatccccatagaaatacctatagtccttcaaaaggaacacatgaccgttagattttaacaaggcctataatactacctaaaacctgaaaactatttccataaattgtcagccactctgtaactagatcaaagagtcaaaaaaagaggagcattgtttgaatagtaacataaaagaaatcacagtaaagtgtgacacgaaaaaactagtgttgttaagtaggtccctgagttgtcaagaaaacgtctcagtttgagatttataaatatccagaggagctgattctaggtttttgttttgaattctttatctctgccaataaaatatgcctacaggcatttagtgctcaaaacaaacaaacaaaaaaccaaacaaacacagtaatagccacatacatccaattcaacttctgtttagaggtaacttccgttaccaagtatctgaaacatactttctgcttccaggaagatggagtagatgtacttttccccatctctctcactaagtagagatctagaaaagcagaacactacatgtaaaacatatataaaacaaacataagaagactttgaaaggcaaaaaggaggagcactggataggaacctcaagatccaaagaaagacagaccagtgagttccctgggttttctttttatttcatatatccacaactcggtgcagaagctggcaacaaatgcagatgaaagaaaccaccagaaccgctctctctagccaaaggaccaggaaaggggcagtctagcaagatataaaacttttagaagtaactactcaagtgcagcccaacaccagataaaaaattatggccctacccccatccccaccagtagaggctgagatggtgatcctagacttctacccttattaggctgtaatgagatgccccaaccacctcactaggtggtttcagaaaaggccaagatgggattgagagtttcatctctaccaagaggtaacaaggcattctgatattgtcagtgaagaccaagtgaggagcttggacttctaagcccatccattagtgtcaaggtgaccttattcctcctcactgtgatgatgtcagaggaggcctagtgcatagtcaggacttgcagcaccacacctagtagtaaccaaagtcagccccgcccacaccctggtggttgtcagggaaggacacacatagaacagtaccttgtatccctcctagcagacagctatcagagaaagacggttggggagccagaaatcccacattcacctatggtaacaatgagtaaaatccctctgaagtgtcagtggaggataagcagggaatccggactcctgctatgacctggcagtgatgagacagcacccctctctctttccaccacccttccctgctagagtggtatcaaacaaagccagttaacctgaaggtttaaaaatatccagtctcaaagtatccaaaatgtccaagtttcaattaaaaaatcactcatcattccaagagaaaggaagatctcaaactgaataaaaatagataactagcagatgccaataccaagataatagagatattggaatgatctgattattttttaaaaatcattaaaaaatgcttcgatgagcaattgagaacatcctggtaaaaaatacagaaatagaaggttttagcaaagaattataaagtctagactgggtgcagtgacccatgcctgtcatcccagcactctgggaggccgaggtgggcagatcacctgaggtcaggagttcaagaccagcctggccaacatggcgaaaccctgtctcactaaaaatacaaaattagcctggctggtggggcacacctgtaatcccagctactcgagaggctgaggcaggagaattgcttgagctcatgaggcggaggttgcagtgagccaagatcgcgccattgccctccagcctgggcaacaagagcaaaattccatcttaaaaaaaaaaaaaaaaaaaaggccaggcacagtggctcacgcctgtaatcccagcattttgggaagccgaggtgggtggatcacgagatcaggagttagagaccagcctggccaacatggtgaaactccatctctactaaaaatacaaaaattagccaggcatggtggtggacgcctgtaatcccagctactcaggaagctgaggcaggagactcacttgaaccctgggaggcggaggttgcagtgagtggagattgcgccactgcactccagcctgggtgacagagtgagactccatctcaaaaaaaaaaaaattataaagtttaaagaaagaaatagaagatataaagaccaaataaaaactgttaacgactggcaaatacaagaaccaaaactaaaaacctaatgaatgggatcaaaagcagaggagggggacaaaagaaataatcagtaaactggaacacagaacaacaagatttacccaatctgaacaaagataaaatagactagggacaaaaaaaatcaaaactaaaaaacaggccgggtgcggtggctcatgcctgtaatcccagcactttgggaggcgaggcgggtggatcacgaggtcaggagattgagaccatcctggctaacacggtgaaaccccgcctctactaaaaaaatacaaaaaagtagccaggcatggtggtgggtgcctgtagtcccagctactcgggaggctgaggcaggagaatggcgtgaacctgggaggcagagattgcagtaagccgagattggccactgcactccagcctgggtgacacagcgagacactgtctcaaaaaaaaaaaaacagagtctcagggaccagtgaaaatgcaacaaaagacctaacattcctttcatctattaatcaatcctggaaggagaagagacagaggcaagagttgaaagagaactcaaagaaataatgactgcaaactttttaaatttggcaaataaaactacaaattgaggaagctgagtaaaccctaaacaggattaaacccaaagaaatccaaaacagcacacattatagtaaaacctctgaaaactaaagacaaagaaaaacaaatcttgaaagcaggaaaggagaaatgacactttaccaataacagaaaaacaagtctaatgacagcagatttctcatcaaaaaccatggaggacagaacacagtagaccaactgatggagaggaactatcaaaagagaatcttatatctagcaaaaatatatttcaggaatgaagggggagaaaatcaagacattttcagataaaggggaactagagtatttgttataagcagacctatcctgaaagaatggctaaaggaagctctttagacagaaaggaaatgataaaagatggaatcttcaaacatctggaaggaagaaagaatatggcaaggaaaaatatgagtacatataatagtttttccttctcctctgagtcttttaaattatattagatggttgaagaaaagttataacattgatacggttctaaatgcatgtaaaggacatacctaagaaaactatttataaagtggagagaaaaaagagatcaaagggagctaagtggttaaaaagtttgccccttgaagtgtaacatgaggacatcagtagactgtgatggtaagatgataagttatgcatgtaaaatgtaatacctacagcatccactaaagaagctgcacaaagagatatattcgtgctttggtagaaagattacttaaggccaaggtagaaagattacttaaggccaggagttctagaccagcctgggcaacagagcaaaaccttgcctctactacaagtaaaaaaataaaacaaaactcagccattcatgggggtatgtacccatagtcttagctgctcaggaggctgaggtgggaggatcactggagcccaatactttgaggcttcaatgagctatgatcaagccactgtgctccagcctgggtgacagagtgagaccctatctctaaaaaatttcaaaaaaataggttttaattaataaaaaaagagatatattcaaattaactgcagataagcaaagatggaattctaaaaaatgttgaaataacccacagttaagagaaatgaagactagagagaacaaacaaaaaacaaaaaactaaatgggacgcttaagccttaaaaataaataattagattaaatgtaaatcagtatgctgattaaaagacaaaggctggcaaagtagattaaaacccatgactcaactatgtgctgcctataagaaattcaccataaacataaagataaaggcaggttaaaagtaaaaagatggaaaaatacatagcatgctaatattaatcaagggaaagcacaataactatattaatatgagataaagtacacttcagagcaaagaaaattacaacagagaaggacattatagaatgacaaaatggataatctacaatgaaggttatataccatataattccatttatataacattcttgaaataacaaaactatggaaacagaaagattagcagttgccaggggttaagggttgggagtaaggttaaacatgtggaataaagtcggtttggctatgaaacggcaacatgaagattccctgtgatggaaatgttctcagttttgactgtatcaatgtcaatatcctggttgtaatactgtattagagttttgcaagacattaccattggggaaaattgagtaaaggttatgccagatctctctcaattatttcttaaaatttcatgtgaatctaaattatcttttaaaaaccatttaattgaataaaactaaggagataaaaatcagtaagtcacttaaaagcaatttgttgtatttatgcattgttatacataacaataaagaaaattatctaaaatgttttaggttaatatcacttaagtatttttcccttgctaggtgcctacagattttacacaatctttccttaaatcttgacataaatatcactggaaaacacctttcatcaaaagtacaacttttaggtctctcagaataggaataatattagctcagtgctttttaaatccacaggcaaaaaaatcttataaaattattcagagaaaactcacaaaatttatactctttgaaaacaaaagtatttctactaatactcatcttcaaaattaaactagaaatcataacattatcaccttcctttgaatacagaattcaaaacaaacacactacttgtcttttagtgcttaataaaaagactataagtgagatatacttttatatcaaagctggacttgagtgactattcctttatggagctccaggctaaagtagttctgttaagtacattaataaaccaataaaacacaaataattaaatgctctaagcataagcactcacttacaatcttaagtcatggttaattaaacaaatgttcaaactctacctgaaagtgatacataatgaaagtgctgtattaacagacatagcactattactaacaaaatcatcaaaatgtacataaaaaactgctttttataaccatctactcattccatttcttcctcattgttaattaacatactgagttcaattacattattttaatgaaagacacatatgtattgcttattttgctgtacaaatgtttaagattatggcagtatattataacagtaaaactacaaaccactgctcaaggaaatcaaagaggacaaaagcagatggaaaaatattccatgctcatggataggaagtatcaatatcatgaaaatggccatcctgcccaaagcaatttatagattcaatgctattcccattaaactaccattgacattcttcacagaactagaaaaaactattttaaaattcatatgaaaccaaaagcagctcatgtagccaagacaatgctaagcaaaaagaacaaagctggaggcatcatgctacctgacttcagactatactacaaggccacagtaaccaaaacagcatggtactggtacaaaaacagtcacatagaccaatggaacagaataaagaactcagaaataaaaccacacatctacaaccatctgatcttcaacaaatctgacaaaaacaagcaatggggaaaggattccctatttaacaagtggtgctgggagaactggctagccatatgtgaaaaactgaaactggatcccttccttacatcttatacaaaaattaactcaagatgcattaaagacttaaatgtaaaacccaaaactataaaaaccctagaagaaaatctaggcaataccgttcaggacatcagcatggacaaagactttatgatgaaattgccaaaagcaactgcaacaaaagcaaaaattgacaaatgggatctaattaaactaaagagcttctgcaccgcaaacaaaactatcatcagagcaaacagacaacctacagaatgggagaacatttttgtaatctgtccatctgacaaagggctaatatccagaacctacaagaaacttaagcaaatttacaagaaactaacaaccccattaaaaagtgggcaaatggtatgaacagacacttctcaaaaaaagatatacatgcagccaagaaacatatgaaaaatagctcaacatctctgatcattagagaaatgcaaatcaaaaccacaattagatatcatttcataccactcagaatggcaattattaaacactcaaaaaacagacgctggccaggctgcggagaaataggaatgcttttacactgttggtgggtacataaattagtacaatcattgttgaagacaatgtgctgattcctcaaagatttagaaccagaaataccatgtgacccagcaatcccattactgggtatatacccaaaagagtataaatcattccattataaagatatatgcacgcaaatgttcactgcagcactattcacaatagcaaagacacagaatctacccaaatgcccatcaatgacagactacataaagaaaatgtggtgcatatacaccatggaatactatgcagccataaaaaggaacgagataatgtcctttgcagggacatggatgaagctggaagccatcattctcagcaaactaatgcaggaacaaaaaaccaaacaccacgttctcacttataagtgagaactgaacaatgtgaacacatggacacagcgagggaacaacacttactggggcctgtcagggcagggttagtggggagagcattagggaaaagagctaatggatgctgggcttaatacctgggtgatggattgataggtgcagcaaaccaccatggcacacgtttacctatgtaacaaacctgcacatcctgcacatgtaccctggaacttaaaaaataataataaaattatttaaaaaaaaatttttaaacttatgtaaatgtttctatagtgtcctctatgaacataccatcatataggtttttgagttcacttccataagaaacatttttatatggtttgattttaatatgcatttacaaaaatatgaacactttacagaggattacttgcactactgtatttcttcaatatgtatttaattgaaaggatggcatttttaatgactataattaaaggtcgatgaatcactatcttattaaaatttagtaatatttcataacatacatggttcacaattgatgcaactgcttcctattgatgaatttttttacagttttaaaaaattatgcggccaggcatggtggctcacacctataatcccagcactctgggaggccaaggcaggcggatcacctgaggtcacgagttcaagaccaacctgcccaacatggtgaaaccccatctctactgaaaatacaaaaattagccaggcatagtggcacatgcctatagtccaagctacttgggaggctgaggcaggagaatcgcttgaacctgggacacagaggttgcagtgagccaagatcacgccactgcactccagactggatgacagagcaagactccatctcaaataaaataaaataaaataaaataaaataaaataaaataaaataaaataaaataaaataaaataaaataaaaattatgcaaactaataaaatattaataataaaaagatttcaaaagagtaattttctttcattagtatcttttccacatgattcaatgatcttatattgctactaataaaacttctacaaattaacatataatattacagaaattgtaatttcctaaaataaaagggattatttgaaataacaaagtttttataatgggattatgagctaacaaacatgaagaacatgttgcttatagctaaaatagttcatgttaattatcatttaaaaacattcccctcagaagaaattctcttatactttttatgaaatttcagtttggttctactgccatgagaacatcatgacacagcttcttagatccggctctcccagttactagctataggcatgtaccaactgcataattctctaagttggaaccaagcagagaaaaaattgacaagtgaagggtggacgtttttatgaggttaatgaaatgaaggagatgaggctttcttggaggacaagaatgaatctccaacaacatatttgaatctgtactactgtggactatgtttctcaggtttttaatgaatcagaacaggcattagtccaaacagaatggatacgtacacagcatatgggtgtatctggacacaccagttcaatataagtgctggctctatgaccatgacaaatcactcaacctttccttgtcttgatttttttccttgtcttggtttactcatctataaaagcagtaactatatcattatagtgtttataaagattgaatcagtttattgaacattatacaagcacttagtgcctgatacaaattaaagtacacaaacagtagctattgccactgcttctattattaagaaactttctttctagaagccatgtaattgaaactattactatgcctcaaattcaatatccctagatgccaaatatgaaaaaaagtttcccccctaaaattatccctcagaaagaagttgcctcatacttgaggatttataaatgtattatgaggctcttacacaactgcttcattttgaaccataatgtattgtttggggaactcattacactgaaacaacttcaatcaatgctagttatggatgcttaaaaggagtcacaaatcacagtgataaaagatgtcatttttaactaagcctttagagaacactttttaaaaacacataatataagattatatagttctatttctaagaatggctaaacagacaacttagaacaaccgcctgtcagtgagaactagaaaagctggggaaaagttaagaaacctgttagaaggcactggagggctaaaaaaacagtgatgaattatgcagacaagacccagaagaagtagtaaatctagaaacctagaattctgattggcttttggaattgcttttccccaaaaaaaaaaaaaaaaaaaaaaaggatgtgttaattagacaagaggaagctgagaggcctaaaagctcagtagagctttcagcaggttaacaaaaatgcagtaacaaaaggtgaggccaggatccgccaaaaattacaatcctgctaactctcctagtctttggtttaaaatataaaatctatgtcttggggagtaacgatggtcagataaaagcccagcttaaatcatctcaatccataattgaggtgataagtgaactcaagattgttgaatccattccctagaaccacaagtagaacaaaatccatcatccaaagcttcaaactagtccaacaacttatcagaaaggaaatgctggtatcactaagggtaaggatactgtttccttctgtaaggaaaagcagattattaagtgaagggtatcaagaagggggcttatgaagtatactgataattactgtttctcaatctaggtatttgatacataggtgtattcagtttgtgaaaatatatagtcatttgcagtatatgtttcgctcttattgcccaggctggagtgcaatggcgcgatctcggctcactgcaacctccgcctcctgggttcaagcaattctcctgcctcagcctcctgagtagctagggttacaggcatgcaccaccacacccggctaattttgtatttttagtagagacagggtttctccacgttggtcaggctggtctcgaactcccaacctcaggtgatccgcccgcctcggcttcccaaagtgctgggattacaggtgtgagccactgcacccagtctgcagtatatatttctacttcaacaaaatgtctttaaaataagcatacaagaaaaaaagacaaaaatgtaaatataaaccaagagaaaaaaaagcaaaaatagggaatctagaaaatgaatttggcagatgtaattttaagtgaactatattatgaactgaatgattctgccctcccacaaattcatataatgaaatcctaggccaggcgcagtggctcacacctgtaatcccagcactttgggagccaaggcgagtggatcacccgaggtcaggagttcgagacaagcctggccaacatggtgaaaccctgtctctactaaaaatacaaaaattagccacacatggtggcacacacctgtaatcccagctactccagaggctgaggtagaagaatcacttgaacctgggaggcggaggttgcagtgagccaaaattgcgccactgcactccagcctgggcggcagagcaagacactatctccaaaaaaagaaagaaagaaagaaatcctaatccccagtgtgatggtattaggataggagatggggcctttgaaaggtgattaggtcatgaagacggaactctcataaatggaattagtggcattacaaaatgaacctcagagagctttctggccttttttccatcatgtgaagaagacagtcatctatctatgaaccaagaagtagaccctcaccagataccaaatctgtcagagccttgatcccgtactcccagtctccagaactgtgagaaataaatgtttgttgtttaactcatccaatctaggacatttttgttacagtagcccaaactaagacagactataaaacaactatgattaatatgttcaaggaattaagtggtaggatcgagctttacggcagataatgcaacataacacaatttttcagaaaactcagatatatttttatattgtgtttaaataaagtgctagactttcagtgaccacttacagagttctttaaattcagtaatattttaaaaatttcaatttaactgattttacctttgtgatacttttgacatatcagataaagatttgtggtctgttagagataatagcctagatacttaagtaagttaagtagaggaatcaaagtttatatctgagaggactctgaatggttttaaaagtaatcattcttatttaacatgttaactatatgatgaaatgaattttactttctccttgtccagaaacagaatagttaaataagacaaacaagatatattaaggaaaatgtttagtctgcttaagagtaaaaataaatgaatttgaaagactttgaaatctactttatagtaagtttccacttattccacttggtatactaaccatacttcatatacacaaaagagaattctaatatctaattttaatattccctccatttgtatttgaaagtttttagaaatattctgtttttagtagaactgcttaatcttctgagcttattctatatcctcaaatatatacatatttatatatatttatatatttacatatatatttttaaatatttatatatttacatatttttaaatatttgtatatatttttttatatatatatatatatatatatatattttttttttagacagagtctcgctctgtcaccctggctggagtgcagtggcgtgatctcgctcactgcaagctcccgggttcacgccattctcctgcctcagcctcccgagtagctgggactacaggcacctgccaccacacccggctaattttttcagctaattttttgtatttttagtagagacggggtttcaccgtgttagccaggatggtctcaatctcctgacctcataatccgcccacctcagcctcccaaagtgcctggattacaggcgtgagccaccactcctggcccaaatatatttcttaactagacattgatattaggcagtctcaattaatacatctatgaatttgaaacaaagtagaaaaaccccttatgtagctagcatggctgttatgaagcctttaaatattattttatgtatgaagcccttatttttagtatattatgcatatcatttcaaccatcttgatattctgatttcttgttatacagataataaaagacacaattttaaaagaaaacagtaaaaattatattttccattgccaagggacaagaaaaatgtgttttacaaatgcatgaaaaggtttaaaaaaatcaattattatacatgttgtttctattgagcctacagaaatgaggcattatcatacatgggatttctaattcgtactaattaaaatgttttatattgtggtttcagtttttctatacaaccattaagtaatgccaactttgctccaatataatactattactattacaaaaagacagaaccatctgactgaaatctaagacagaaaacattacttctaaggccataaaacctgctcttttacatggaaacatgactggttctagagctaaggcagttaaaacaactaataaataaataaatgagggagaaatgacagatcttccttacaaaataattctaagtgactatgctaaatcatgtgaatgagtactcaaagtctgaaacatatttctatgacagcattgtatccatattccaaggtaatgtgtatctccaaaaatccagacagaagtaaagatgctttccaatggaaaactattaaatgaaaatgactcaaaaaggagtcctcaaaatgtctctaaaatatatgtgataaaactatttcataaaatgagtataaaatgttctatttataaatgaatgttttatttttccatgtttaaaatatgtacatgtatgaaatgaaatactaccatagaatactttttttagtttctttaaaaatatacatttaagctggaccaaaccaaaaaaaaaaaaaatttaaaaaaatggggaccaatttatactggagaaggctttgcagtttctttaaagcaaagataatgttttataaatacactctcaatagaaatgaaattatatgatatctaaaattttacatgaaatcttggaatggggtaaggtagcaaaacgagagcagccatgagctgatgaacagtgcagctacgtgatgtatacatagggattcgttgaactgtcagccatacttttatgtatgtttaaagtttcccataatcaagacttactgtaaagctacacatatcaagacagtgtggtatttgtgaaataacagagaaaaacatcagtggaacagaagagaaagcctagaaacagactctcataaatacagccaactgctttcacaaaagagccaagacaatacgatggagaaaagatagtcgttcaacaaatgatgctggaacaaacgaagagtcacaggccaggcgcagcggctcacgcctgtaatcccagaactttgggaagctgaggagggcagatcacgaggtcaggaattagagaccagcctgaccaacatggtaaaaccctgtctctaataaaaatacaaaaaaattagctgggtgtggtgatgcacacctgttatcccagctactcaggaggctgaggcaggagaattgcttgaacccgggaggtggaggctgcactgagctgagatcatgccactgcactccagcctgggcgacaaagcaagactccatctcaaaaaataaaaataaaaataaaaataaatctagacacagaccttacaatcttcacaaaaattaactcaaaatgggtcacagacctaaatgtaaaacacaaaactataaaacttttagaggttaacataggaatctagatgaccttgggtatggcaacttttagatacaatacaaaagacatggatctgtggaagaaataattgataggctggacttcattaaaatttaaaacttttgctatgcaaaagacaaggtcaaaagaatttgaagacaagccacagactgggagaaaatatttgccaaagacatatctgataaaggactgttatccaaaatatacaaagagttcctaaaattcaacaataacagcccaattttttaaaaatgggctgaagacctgaagagatacctcaccaaaaaacatacacaaatggcaaataaacatataaaaacatgttcaaaaccatgtcattagggaattgctaactaaaaccaatgatatactataacacatttattagaatggacaaaatccagaaacttgataactccgtatacagacaaggatataaagtgacaggaactctcattcattgccgatgggaatgcaaaatggtacagccactctgaaaggcaactttgcagtttcttaccaaagtaaacatactcttaccaaacaatccagcaatcacactccttgatatctacccaaaaaagctgaaaagatgtccacacaaaagcctgcacatggatacagcagctttattcctcattgccaaaactagaaagtgctcaaaatgtctttcagtaggtgagtggataaataaactgtggtatatccagacaaaggactagtattcagtgctaaaaataaatgagctaacaagctatgaaaagacatggagacaacttaaatgcatattacaatataagtgagagaatccaatctgaataggttacatattgtatgattccagctatatgatattttggaaaaggcaaactatgtagacattaaaaagactagtgactgccaggagctggtggggagggagggatgaacaagtagagcatagagaatttttagggcagcaaaactattgtgtatgataaaacacaatggtgtattcatgttatcatatatcagacaaaatccgaagaatgtacaacaccaaggatgaaccctaatgtaaactgtggactttgggtgacaacaatattaatgtaaattcattgatcgtaatgtaaaatgttgatggtgggggatgttttgcatgtgtggaggtagaggatatataagaaatccctgcaccttcaactaagttttaccgtaaacttataactgctccaaaaaataaagcttatttttatttttaagaaagcagtgagtttaatatatctgaacctatcttatataaaaataggtctctctctgctatgtttaccaaccaccctaatgctagtgaaaaaaaaaatcagaataaaatatagcttttcactttgctctaaaacattcactttcagaagagacaaacgttgttacattacatataagctttatgaaggcaaaaaataactccatgaagtatattttggaaaaggcatggtttatatactcttaaggtactattccacaggctcatggaataaagaaaagtgtgaaattatacttaagtagtagtactttctacatattttgtatctgaagctctaaacataaatgttcacaaaaatagtaataagtcagtaactgaacccacaattttgggtgctgagggtaatatttacttttcaaagagatcttaagatacagggagacttattttatctgaatggatttcctaagaaataaacacaaactatgatcttttgtcagttcataaggaataatagaaaaataaaaaatgaaattaatgacagttaaaactgcctacagcaaaatatttttatgtataaaaattgataaaggaatcaaacattcctgaaaaatatctacttttgtatcatgtgagcagtaacaatggacttagtagaaataaaaaacaacttcagcttaagaaacttctagtattaataaaacacttgcacaaatacctctttgaaacctgagaaccaccccatgtggtaaacaaagcaggtatttactatctttttcacagatgaaagaactgaggtgcacacaatttacataaattatcaatagtcacagagattaaaaatggtagagccaggatttgaactcgggaattattattctttatcctgtcacctctcacctttattaccttggcatttagagtagtcacataaaagacactgaatatacccacttgccttctgaattccaaggcagcctgaagggtgctagtgccatctcaagatttacaccaggatgaaacaatctctgcaacctgctgtggcctgagactcttgcaaaatgtttaaaagtgactttaacacatcatgacattcccacataatctaagacactgcactagtcaactcaggctgttataacaaaataccacagggtaggtgcctgaaacaagagacatttatttctcacagttctcggggctgaaaagtccaagatcaaggggcaggtgattcaattcatggtgaaggccctcctcctggtgtgtggacagctacctcatatggtggaagagaggaagcaagcttcttagaagggcactaatcccattatgaggtccccactctcatgacttcctctaaacttcattacctcccaaaagctaaagtaacctgaggcattgcctttaagaataccaacttttatccatctctaaatatcatcaccctggggctaagtcttcaaatatgcactcagaggggatgcaaacattcagtccatagcacataccacagcagtatattgtgttacatctctctgacattaggttagatgtacctgacaagaccagggtgggtaggtggtaactaatataataatcactcagtcaaattagttactaagcaggaagagaatacattattagagataattcactggaaaaaaattcacgtttaataaaacttttaatttagtatttttcacaaagaagaaaaagtctccttccccaaaatttgtgtctatgtaaaacaacaaaggatatgcatactggtttgagattttttttccttctgtgaagaaactgctatgctatacactttacatgttttatatcacagcccagtgaccactatactacacaggtggaagtgtgggtttgaggaccattgaacactgaatctcccccaatacatcacaattatagaaacacctgtgcacagtaactttgtgttgagccactatgaaacttcagtgttcaattgcccacaacacatctcatttcttatgactagattcagctctagtatgtaagaaacaagctttctgaatgcagcagtttccaaactttgtactgagaaatctagaggatctataataaagcatttttcaaattttctgaaataaaatatgctcatgaaacatgttgaacttaggtctaagggtttcaagacatgagaaataagggtcctacttatttaaaaactaaataatgtagatccagtgatggggaagaaaatagaaacattttttgttaagcaaaattcattttagagtagttttcatttgatcataaattatgaaacaaaattacaatgatcctaagtagaactaatcatgattcctcatgtattcattctctccataccttaatctctaaaataaaaagtttatattagagacaggaaagtaaatgtgtgttgaattgaaactgatgtttaattctcctctagggcataaaaacaaatgggttaaagcagaggttttacaatatttgtggacaacctaagaaggagggcgattaattaaaagttccttttgtttaatactatgaagaactcttaatacataaaacaggaaaaaaacttatattctaggtaaagggagggtagaaaactagatctccacaaaacaccaacttaacattttaaaaaagaaaaaacagaaataattggaatataaaaggtttttatataaagtttcaaaaagggactatttattcttcattatttccaaaatattcttgtatctaaattataggatacactgagtcactggggaaaaaaatcatataaacaagttattttttaaaatatgaagataaccagtagaagacaaagccaaaagagatctgtttgcctttggagagtaaccactggaggtaagacggggaagggaacatgcttactatagaaccctacagaaatgaaaacatatgcttacacaaacacctgtggcactggaggcaaagatgacagctccatgggtgtacaggagtcatcattcaaacataaatgggtgcaatctgtgactgccaagcagggggaggggggacaaggggaatgggtgtgtaacagaagggttcaaggaggctccaaccttgatttttgatttttttctaacccttcaattatctagttatggtttttgaggataaaaggactaagttttctaacctcaaaccatctcagaattaaatagttattctgtaatcccagcactttgggaggctgaggcaggcgaatcacttgagctctggagttcaagaccagcctgagcaacatggtgaaaccccatctctactaaaaagacaaaaaattagccaggcatggcagtgtgtgcctgtagtcctagctacttgggagactgagataggaggatcacttggtcctgggaggttgaggcagcagtgagatggcattactgcaccccaacctgggcaacagagaccctgcctcattaaaaacaacaacaaaaaagtattgaataattctttattagaataccactaagagaactcattttaaaatatcagaaaacccaacagaatggccaaaatgaataacattaacgttaccaaatgttggtgaggatgtggagcaaacaaaatctccatatgtcactgtaaggtttacagcttggttgttatgggccaaactgtgccccccaaccctaaattcttatgttgaagccttaacctccaaatatgactatatttggagacagggcctttaaagaggtgtttacattaaaatgaggccattagggtgggccctaatacaatgtgactagtgtcctaataaaagaaggaaatctggatactcaggaaaaccctaggaatatgcggacacagtgagaagatggccacctgtaagcaaaggacagaggcctcaagagaaaccaaacctgccaacaccttgagatcttgcacttctagatatcagaactgtgagaaaataaatttctgttgtttaagccacccaatctgtggtattttgtcatggcaactgtagcaaactaaaacaataatacaactactttgggaaaaagactgacaggttcttgcggaaccaaaatatatccaccttatgatccaataattctatatctaggtattgacccaacatatacaaaaacataaaaagatttgtgcaagaatgttcctaacagatttattacaataggcaaaacactggaaatagcccagtatttattaatatgagaatggataaactatggaatattcatacaatagactattattcagcaaaataacactgaaaatattattttgaagatgctaaaaatgaactactaatacaatgtggatcaatctccaaaatattatgctgagtaaaggaagatgtaccaaaaagaatacaatatgactctaattatattaagctctacaacaagttaaattaatctttgttatcagtaaacaatgttccatgattatattcatgtttttgcatgatcaggacttcctgagcaaagagtgctggcaacctggattaacagacgagtaaatggcaaatgagtcttggaagttaaagacagacagagagacatccaaggagatgtatgggtttatcttccatcatttaaattccacagggtaatggaaaaagagacgttgtcctcctctccccagaaaaaatgtgtttacattagaaagataaggtaactatccctctctctacacaggggaggaggagcgatgcaaaagcagtcctatataagctctgagatgtatacagtctgatatggtttggctgtgcccccacccaaatctcatcttcaactgttaactcccacaattgccatgtgtcgtgggaggaacccagtgggaggtaattgaatcatgggggtaagtctttcccgtgctatgttcgtgaataagtcttataagatctgatggttctaaaaaggggagtttccctgcacaagctctctcttctcttgtctgccaccatgtgagacgtgcctttcaccttccaccatgattgtaaggcctccccagccacgtagaactgtaagtccaataaacctttttcttttgtaaattgcccagtctcagggatgtctttattggcagcatgaaaatggactaatacacaatcctatataaattctgagattcatttatttaggaggagctcctctcctgtattacaactccccatcccccaagatatacagatggcactaaccctcataacatcaccctcatggggaactgaagtgcaggaaagtgacactaagataaccatgagtaaataaaaagtctcttctctgatccacacatcagtgtttctgcttttgtgtgtgtacatacactaaacatatgccatatattcagtgtgtgtgtgtgtgtgtgtgtgtgtgtgtgtgtgtgtgtataaatgcaggagtatggtaatacctcaaatcctttactttttgaatacaacactataatgaaaaaaattaaaacaatacttgcatctgagggcaaacaactaacttggaagcacaacagtaatacttcatataatgaaaagggtttgtgtgtgttactaacatacatgcaattatcaaaactctaaaatttgtgcatttcactgtgaaaattttatgtcaacaaaaggaaaataatcataaacaaatattgaattctaattaatgatatacatactgaagtgtttaggtgtaatgtgtactgatgtctgcatcttactttgaaatgcatctaaaacattggactgtttataccaatacaggcatgtaccgatttctccatttttgaaggaaagttttgccaaagaagaacttacttgttgacttttttgtttctttcaacacttcaaacatggttcttcaactaccttctggccccatggtttctaatgagaaactagctgttgatcttattgaggaaaccttgtaaataatgagtcacttctcttgctgctctcaagattctctttttgtccttagcttttgaaaatgtgatctttatgtgctgtattagtccattctcacactactattaagaaatacccaagactggataatttataaagaaaagaggtttaattgactcacggttcagcatagctggggaggcctcaggaaacttacaatcatggaggaaggcacctcttaacagggtagcaggagagagaatgagaatagagtgaaggggaaagccccttataaaaccatcagatcttgtgaaactcactcactatcatgagaacagtagggggaaaactgccccccatgattcaattatctccacctggtcccactcttgacatgtggggattattacagttcaaggtgagatatgggggggacacagacccaaaccatatcatgtgtcttggtgtgcattcagaatttctcctacttagattctgatgagcttcctgaatgtgttgattagtgtgtcatcaaattgggaagttttcagccatttttttcttcagccattctatttgcccctttctctctctcctttcctcctggaatatgtattatgtgtgttggtgcacttgatgtcatcacacaggcctcttaagtctcttgagctctgttcatcttcatgctttttgactttctactccctagactagataatctcaattgacttaagttcacccattcattttctgcctgttcaaatctgctgttgattgctacttgtgaatacttcatttaagttattatacgttttccctctagtatttctagttggtttctttgcatcatttctctatacatactgatactctctacttggagagtcattgttttcctggtttcatttagctgtttcagcatatttaacatggtgatttaaaacccttgggctagcaaatccaatgtctggacttccttgagtacagtttccattactttctttttttcttgtggatggaacaaatttatgggtttctttacattcctcatcgttttctgctaaaaactagacattttgaatattataatgtggtaactaactcagattctaactcctccccagggattattgttgctgcctatcaggtttttgtttgtttgtttacagtcgtttctaagctatttctgaaaagagtacattctttgttgcatgtggtcatggaagtgtttactgttttgttagcttgcagtttgcctaaaacttagctgggccatttaaaaatttgccttagccatcacttcctcttctgcagagcttgaaggtcagtctgacataaaagcttaggttcttatcagatcttttctgagtaggtgtctaaccctacgcatgaaatggactttctagatcccatattatccacaggagcttctcaactcccttattccccaaagcattccatcctccagccttttgttccaggcttcttggcatgtccattgtttactcccattgatatctattgccccaaggggcattagtagataatttgttctgagggagttatgatttcagcaaaataaaggcatgtcccttgcattagggatcctccaggcaggtcaaaacaaataatcacacctctttgcgaacagaatctactctgttccatccagcccctgtcactgaggcagagaagggaggatagagtgagggtaagtttaaatgccacaaatcttttctcctgagtttcaggccccattttcttaaatgtttgaatggttgctgtaaacctttgactattttctgaattcaaaaagctgattggactgtttttacagattttcttgtatctctgtggagcaacaagctcttgggagttctctactctgccatttttactgatatcactttccatttgcaaaattcttaaaataaaatgttggggaaaatatggattagaaacaacttatctgtttctcttggaactgtgacttacagtgaaaaacttgaaaatttaggaaacccaaaatgacataaaacagtaataaaagttcactaacaatatacgacataaagatacaatttttaaaattataagaaatgcaaaaataaggctagtcacacaaaaaggatgtttaggaaacagaaagtgagagaaagtgctaatataaactcactaaagagattttatattctaagtaagctcatgctctggtttctcttcagactgtataaatcttttgccttttactaagtaagctgaatgtataaaaataaaaactaaatcattaaatcaataaatacattattttaaagatggaatcatatatatatacatatatatatacacacacacacgcacacaaatatatatttttatatatataggcactaaactttactggcccctaaataaattaacaggaataacaactagctctggaagcaattatttgtaatagggaatctgtcaaggtctccactgggttgaggaaggcagtagctaaccactaaaggaaatgttaaaaaagcaaaggtcaatgtctggccctaaatttttaattccaacaacatggctagaactgttcaaattagaaaatggtcagcatgtcaaatggataactaaccagcaccattacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactatactaggaatggtttttctatgtactttatatgaaaatgtatgaagttacttatctaagaaaaattggtgtttctgaaggacatcaacccaagaaaacttatttttaactaacattttttaacagagttctttaaagcgtttcacaaaggtcagtatgagctgattttttttaatgtgaacatttccacaacaaattttaaaaattggaatgaatcagcaacttagatgacacagcctgaagtatttcctaataaatgagaatgagaaaaggtccattatttcacttataaattaattaagagcttccaacctacaatgtatcaggccttcctcacctaccagacatctattttaatgaattaaaatatactacattgtgatcaaactaaaatagaccatttcaaaatctagagggaacaggaggtgtactcctgagataaaaaaattttgtcagaacacttcattttaatctaatatttataccacatatatatacatgaatagtatatatcttaacagatgaaacaattattctttccaaatcatagtgtcttcaaaaattttttaggttattatggagaatgtggtagagactgttgattacctccaacagccagtagggcaaggaggaagaaggatctttctccctgaccacactcctcacatatataacggactatatgtaagtgtcaaaagcatatcactcaacacgttactaagaacacgaaatcaatcaaacagaagttcaaagataagatgataaactatagaataaaggaaatatgaaattcaaactgagtaagtaaacaacagatcaaagcaatggtgttactacatttacggaattaaaaataaaaactgaaaaaaaagattagaccattgaaaatcaaattactgacaatgaaacaacttgaaataatataaatgcaatcaaaaagacaaaaatgtggcctagcatagtggctcacgcctgtaatcccagcactttgggaggtcaaggcaggaggatcacatgagccccagagttcaagatcagcctagccaacatggcgaaatcctgtgtttataaaaaatacaaaaattaggccaggcacggtggctcacatgtgtaatcccagcactttgggaggctgaggcgggtggatcacatgaagtcaggagttcgaaaccaacctggccaacatggtgaaaccccgtctctaccagaaacacaaaaattaggcaggtgtggtggcaggcacctgtaatcccagctacttgggaggctgaggcaggagaatcatttgcatccgggaggcggagattgcagtgagccaagatcgtgccactgtactccaccttgggtgacagaacgagactcagtgtcaaaaaaaaaaaaaaaaaaaaattatcaagtatgatggcacacacctgtggtcccagctactcaggaggctcaggcaggaaaatcacttgagcctggaagggcgaagctgcaatgaactgtaatcacaccagtgtactcaagcctgggtgacagagtgagatcctgtctcaaaaaaaagaaaaaaggacaaacattaaagaaattttctaaaaatatgatggacatggtagacaaagattataaaacagaataacgggtattcctcaagtatataacttacaaatgaagcagaaaaaaaatgtaaacatcgaatttttaaaattacaaaaagaaaagaaaattccctaaaataaaaggaagaagtgaacctggagatcatatggaataactcacgttgagatgtaacctgattaattctcaaagactttttaaacaggtttttttagcatgcagaaaaaaaaaatcaagtcacctgcaaaggagaaaaatctttggctatcttcagatttcttcacagcaaaattcattgcagaagaaaattaagtaatgtctacagagttctcaaaagaagaaaagggtgtgtcccaacagtaccataaccagcaagatgtcaaatatacaagaaacaataaaccattttcaaatgcacaaggcctaagagaatactaatccaagagcccaggtaaaatatcaatcaagtgtgagagtgacactgaaagtctcaaaattttatctcccatctacccactcttaagaaaacattggaggatatgctccaaagccaggaaaaccaaaagaaaggagagagacagacagagacagagacagagagacagagagagaaagagagagagaagaagaaagcctaagaaataggattcaacacagaagagacatgaaattaagttctagaaaaacagattggaactgtgcaggcctagtaagcaatcagattagaacagagggtgaagactccaggaacatatctcctgggaagaaaatgaagctgttgaaatacttgatatacttgacaactgtactagtcagaactgtgttcagctatatataacagaaatatctagttaggtagctccataaaatgaaaagttgccccaaacactttgtttttcagctctgcccacccccagaatatagttttatccttatgcttgtaacatgactactgcacctctaatcatcacacatgcattctgggaaggaatcatgagaaagggcaaagggtaaaatatacatatgtcaaataagtctgtcagaaaaacaatagcttccccagaatcccaatttccagatgtggacccatttctgactctaaaggaatttagtatgttgattatttttcattaggcatataactactctgaacaaaatcaggatcctgttatttaaataagtgggaggggtagaactgacattgggtagacaagaagtatcacaacaactgcacataaaataatatttggagaatatttaatattccaatggagaacttggaatgcttcatatagtgacatgataaagtaagcaaatttaaaatgaagcaatttttgattccaaaaagaaccaaaagttccacaagagatgaaatgctattatacagctgaataatattcataaatcataggaaaatgaacacctatggattgaaaaaattctaatatatatattccaaagatgaaagaggtaagcagaagcataaggtaatagaagaatgacaaattctccatttctataataggaagtcaatacataatgcctaaaattgataaatcaagaaatagcaatatatgtctattacctagaaatggagaaaggtaaatacacacacacacacacaccaaaaataaaattcttaccccacaaccacctgaagggaccccttctcacgaccaagggcattccaaagttaacctgaaaaactagttcagaccatgataggaagggtgggtcagacatgcctcattacaccctcctcccttttggaattcaggaaaagccaaccagcattaacatcaacatagaccttaagtctgataaacatttataatctattctgtctgaagcctactacctggaggctttatctgcaagataaaactttagtcaccacaaccccttatcataatccagacatttccgttctattgattccaggtcttcagataacaacttaactttcaattaattgccaatcagaaatctttaaatccatctatgacctagaagccccgtcttcaagttgtcctgcctttccagattgaaccaatgtgcatcttacaggtattgactaatgtattatgcctccctaaaatgtataaaagcaagctatagcaaccatgggcacatgtcatcaggaccacctgaggctgcacatgtcacaggtgcatccctaactctggcaaaataaactttctaaattgattgagacctggctcagatacttttgagctcacacacagaagggaaaagaactgaggaagctaattcagacattgagaagggtcactcagaaaaatgtttctcataagccttgtagtactattcattttctttcttttaaaccatgcatatgttccttggtaaaatttaaagttttcttttttaaaaaagaaaacttcatgagttaaaaaaaattccaatcaataggaataaattataaacaacaaaaagaatacggaatctttacgataaatgcttcataaccaatgggaagagaggagacattatttcaatattagatcatggtccttagtttcaccttaaattatatgttgaaccctttgtcaacagttacttaaaacagtgcacaaaaaactgctcttattgcattgtaaagaatgtattctaccacaacttctcagtattttgtttttttaataaattccacagaatcgtggatctatagtccattggtaagacacatgacaaaatttgttttaacaaagaaaattaatcagtaaagaaaattaaaactcaataatctctaacattttggtccgttaagacaggatctggatgtggagttcatgaagtacttccctgaagtacctctgtacctacagaaaattgctcatcaaaaaactacatttataaattttggattttgataagttattttatggctaccactgaaaaacttaagaacttaccttaaaaatactttaaacaaaattctaaatttggactttgttaaacttatgtaaggttttataattgatgtacagatatacagagagagacaaaattaattactccaaattttaaactggcataaatactgccaccagaattacataacccggattcatattctaaaaaataatggtaaatatttagagttttaacttccaaatcactgaagtaaaatattttgataattcttgaaaacctctcatctcccagagaaagttcagttgtaaaaagctagattcatgcaattaaaaacattcctagcaggccccagtgtcagagtttcctttcagtttacaattgatgccactaacagatgttggtttttattttaaatcactcttaaaatttactctgtgttttataatatttatttttttaaatcgattaattttacaaaagcaactttagtcttagagatctaggtttatgcttcaagaaatctcccataataggcttgaatgacaaataaaatacttaaacaattttatatccttgaaaattatacaaacttgacctagaataaaaaacaacccacatggactgcaaagagtaaggtaaatttaagaaaataaaaatgcaaatgtgcattttagcagtctcttgaatttattaacctaaaaggtttaatttccattttcctgcatcagctttatttataaaatgtcgtgccctataaatacgccgttattttctatagtcaagcaccctcttaacaaatcttctcattaatatgtaaatttaaagtcaatcggtcttctccctgacagccccatgaattcctagtgcactgtataatcagctttgacttgacatccactatttatcatcaaagatgtcagttagaaaaattatggaaaatgcactgcaattgatatgactgcaatctactttgtcaacacttaattgttcctcaaatcatacatttacatataaacagcctaaatactgatctataatgatgcaaataaactaaattaaaaatctcttctgcccctgaagaagcttgtttgtatatgatgtgttcatttgagaacttattgacaaaagcatgtacatcagctcatctcaaaaagtgtatctacgaattttcgattcctcaacaaaaaacaattttgccacacttcaagcatattaacgtaaacaaatgtttgcaaaaattcaataggaaacatgatttttctctttgagagcaaatttaattatggttgttagctaattgcatgtctgagcactatggattgggagcctcaaagctggttttgaccggaacacaataaacaaacacagaaaacttattaaggtaactaagaaattattttaatttacaagtcacagggtaacaaaatataaaggcaataatgctggcctgggcatcagataattctgtttatatttctgctccaccttttataattaatattgtcttaagtgacttgctaaaatctgtatatatcaatttcttcatatataaaatgggtataataattctgattgccctatggcaaatggaatactatgtaagaaagtacaggccaggcatggtggctcacgcctgtaatcccagcactttgggaggctgccgagggcagatcacttgaggtcaggagttcaacaccagcctggccaacatgccgaaaccccatctctactaaaaatacaaaagttagctgggtgtggtggcacatgtctgtaattccacctacttgggaggttgaggcagacgaatcgcttcaacccaggaggcaagaggttgcagtgagccaagaacgcaccactgcaccccagcctgggtgacagagacagactctatcccaaaaaaggaaaacaaagaagaaaagaaagtacagcaaaaatgataagccattaagtataaagcatcacagtattatttttcacattttctcttagtatctgagagaaaactgctggatttaaatgaattcggtattacaggcaggtttttttaattataaatttaacttttatgtcgatacattgttttagtgacactttttcctactggcaaattctttacttcaaggtaaaatggcccttaattcatcataaaatggtgcttatatagcatttatgtaagtgacttctgcctgtaggtaaaagggaatggagggctagagtgaagacatttctacttggatgattccatgaaacaacacattcaagtgttgatggtaaaaggataaaaaagagaggtaaactctcaggaatgcctctgctagagtactgtttcaccttgtctttttattctataatcatcttaacctttctttactacatggtgttccttttacaacatcacataagaaagagcaagcaaatataaatgccaaatacttctcagtttcttctagctatggtcaaactctgctttgagatttagtctgccaacttcttttatttttatttatttatttatttatttttttgagacacccaggctggagtgcagtggtgcgatctcggctcactgcaagctctgcctcctgggttcatgccattctcctgcctcagcctcccaagtagctgggactacaggtgcccgccaccgtgcccggctaattttttttgtatttttagtagagatggggtttcaccgtgttagccaggatggtcttgatctcctgacctcgtgataagcccgcctcagcctcccaaagtgctgggattacaggcgtgagccaccgcgcccggcctcgtctgccaacttctaaagctaaaactaccatgtgtagtcgctaaaaagttggaagcaacatcaagcctagatcagaaagcactgaagactataaatggctacactgctcactccaaagtttctcagtaaaacaaaatcataattagcacagaggaagcctgagatgggttaactggaagagtgagagcacagacatggtcctagtgttgaccactcatttgaatcttaattttataaaatatatttataacaagagtctaacatattgtacaatccttgattctaatactgcaataagggctgagcctttcaaatctttcacactgcttctgaactgaacatatgtacgtatgtagacaaaagcctgttatactgattattctgggctaaacgagaccctcaaatagcacttacacaatcgatgaataatttttccttgaattgaggtcaactgatatcaacttaaattaataaataaagcaaaatgttttatccaaagtaaaatttataaccaccagagtaactgaaattaaacagttaccaataattgcctctaaggcgtcaaccaagaggttacgagaagggaacatgtacttgaattgcttctataattaaaaaacaacaacaacaataataggaatcaaattagctaaacttataaatcttctatttaaagtggttttctttctatctgtcttttaagccaatggatctttctcaaaggaaatcaaattcaacgctgcataagaaaggaaggcaaaaaaggcttctgtgtttgaaacagtggcaaaagcccaaaaagctgcacagtctagagcacccctgccctgcttggctcgttcctgtggcagtgctagcacatcctgagggctgatgtgcacactggaaaaccactaaattagtctaatgagcacagcatttcgaataattccaaggttggattgcaagtaagtggcaaagaaaagaaatgacttagcccattccagtatgccagggacaatgaccagacttcacctcatgtttgtcctaattcatgttcatggagttaacatgtgaaaacaccaagaatgaatacagtcccaatttttcaaattatctgtcaaaaaacaaatgtatatgatggtgtaaaacttaactttcctttgcaatggctttaaaaataaattttatctaaaataagataaaattcaaggaacagaaaaacaaataaacagacaaatatacaaaagcagagattttactacgggttacatatttttagcaggtatggtaagtacactatatattttaactccagtttctatataattacaagcaaaggatcatttgcatatagttactgaaaatgataggaaagtaaaatttaaaaatttaaatggtgacagtgattagctaaggcaaaattgcctataactttatacaatagaaaaaaaatctgagcagaagttttgaaaggaattggctgaaatcaaacaaataagctgtttggcaacaaaaatctctcatcaaagttatcataaaagggccaggacattttcatcatagagatgttccttaatctagcaaaagtgccatcaaaactgtactttgctcaatgataaataaaattaactttataaaattaaagttgacaaggatagtaaaatttcatcaatttaagagcattatgtaacataagacttacatattaataattcaaaacatacttcaatttttaagatggataacataatcatcattttgttaatattaaaagtgagatgaaaatcagtattactgtcttgtggataaagaagtattaaaatttctaaacagtttttaatgctaatactaaatcaatatagaaaatagtgatcaacattttataataatttgcaagcttgatgtgtcatttaaagcatgtatcatacatttttccatgttatttacatttttctaattaacaaaagcaagatgtactgagcactcaaggcctgtcataagtatgtatacagaccactttgatataacaggagctttttaaaaatcttttttttttttacacaaattggtttttaaaatctataatactgtattttaaaaagataagacatcaaaagactagaatgaatgtgctattcttacaacatttaaggatttatttaaactggtttaaaattaccttaaatcttaaatgtatacatcctaaggatcttaattacaagttatatgataaaattttctaaattgtcaatatgatgaaaagaataaggcatacttaaaaaaaagaataaggcgtacttctaatgttaatctgcacaaagaaaacaaatagcttcacttaaattattaattttactaaatgctaccagctaaagtgaagagaagaacacaaacattttataaatacaaaactaggaaaaagtagtttaaaagttcaacaatatttatctatagaggcaagaaattaattactttaggtataaattcacatgctataggagcacatcacctactttttttacaaatgagtacctggaatagctggggctcaaagacgtgaaagtaactagtaaccaaaaaaatccatggtttggcaatgtcactgtaaacactgtgtcatgctgctcctcctaacaagggcctcttgccagtatcaaactaaaagtgtatatacttacaccaataaatatgtatcaatcagtgccaaaataatggataattatgcttgcatttatattggttgcctgctttagtaaaagaacaagagacaaatgagtcttccttaaatatgcagatttctctagtttactactcctaattttttgcccaagttttaaaaagctcatccattctcttagtatacttgaaagtggaagactgttcaacacttacctctttccaagggctgacaaactgtgtccgagcatatcgagttagcatgtggattatgacaacctgcccccactcttcaacatccactagtaagttacatagcttgcggtaatttttatgaatcagatctattctgtccgggcatacttcttcaaaagccatcacaacactgccagctaccaactagaaaagaaagaaatagtaacttattaaaaaatgtttctcccctacatcaaaggtcttactcaggcattatagtaatcagtttcatgccaatcagtattaaagtattcagtcattcaattaaaatgaatgttcatgtttgaataacaaactttatggtgactattcgtcaaagaataattttaatagttctaatatgtctagaaaatactattctgaagagaagtaaattctgatgtgtttatttcaccaggttaaatttcaacacattgttcatatgtggattaaacattaatcacgcacatttttcatgtttaaagctaacctaaattctaatctaaaaattcagtactttgttcataatattcagaaaaagaatcaagacaataacaaagctcacattgtgtcagtttaaaatgagaacgacaatcattctaaaatgaacttatgttaaaaagtatatgagaaattcataaattttaatagaagaacactttcaaatcatatacatcttaatccaccggtttttacccaatataatttatttacaaagaaaacacactggctgaaattttagaacatcacctgggctcttatcactttcataacaatgtgtataagttggaataatatattactaacaaaagggggctcttccaacaccagttaatgaatcataatgttagtttctgaactgtgatgcttttacaaagtggtaacattgagattcctttactctaaagacacaaactaagcagaatatatattatacaaatacttctctatacgtacaaatgatatatgtgcagttagcccacaatataatacagttttgaaaaacaaattaataccatattctatctgaacactagggatcttcactttagtgtctaaaatttccccaatgacttaaaataagcaattaaatagaaatataacttactgaaatggtactttttgaaaaatattagatacaatgatattcatattttgagtgtttgtccctctagttggctgacatttagtttattaatatgcaaccaacaatacaattgaaagaaaacagctcagaatatagactcgctattatgctaaacaagtttcaagtcctgtggggattttatgaattaccaatcagtataaacgtgaagctgcatttattgactccagccctaaccatgtactggtgcctgctggtcccagcatgtatgcacctcaatcgaaaaagcacagaattgattatttgtgtgaactatataaaaatgtattatatatataattttctatttgttatagatatggcaaggaagttaagctcatgctttcaatcacattttgatgtcttctgcaaaagacataatttctttagaaattacattttgtgataattacatttctataaagtgacaattagtatcattttaaaatatcttacaactaagtttatgacattaaactctagaataactcattgtgagatataaacatctatatatatgtattatcaaccttatattaatatcaacatcaattggtaaagggtgttaaagtgcaaaaataaaggatagtatctaggataaaatgatccatgaaattgaacaggtaattcacagtttcaatttttaaaatactatgtaaaatcaagttattctgtcttagcaattattttcttccaaatgtgttttgatactaaacaattaaatggaaaatcagctaccatataatattaaattcattaaaccaagagctacatgtacacaataattctaaagtactaacaccttctaaggtactaacaaatatcattaattaaatagaaccaaataaagtttaagaaaacatcaaaataattaaaaagcatataaagagagtacttttacaaaataaaactgatcattttagatacttaatcatatagttttaacaatctgaccctgggctaaacactacaaggaaaattaataattttggtttattaaatgttcaatattctataaaatattcagaattaaaattaaatgatctactcagattttaaaaccaaaaatactggtttccaaaaaacagacagttaacttccatctcactgtgtcaatagtagcttttcatatcagggaaaaaataaatcactccaacaaaaccagcaatgagctcatcaaattcaaatgcagttttccatttatgtattttttatattaaagcaataaacatggttcatttatcttcccttggttgccacgtttttctgtgctgttgctatgaacttcagccattagctgtgctccaaggtaaactacatgaaccatcaacaaaagtgacaccccatctatggagttcatattttctctagattatctatgctagttgacaagctggtaatgaaaaaaatcacactaagcaaatggttcctctaataacaataaattttctataaaattatgaagggtacaaaacgtttccttgcatctattttgtcatgaattctaattaacattgcaaaaacctgagagtgctgggtcatcacaagaagtgcatcaaggtttgattgataatatggtataagttggccaatgctgccaagattttcttcccttaaattaatggccatccaaccttccctaatcatacagcccaaatgatattccccttcttatttcaattttcttgaggcatggaaaatgggaaagatcagtcatttatcttctaatagctggataatagatctatcacaataaaacatctgtacaaactcaggggtgtgttttttgcacataacggtggggcttttatcaacattaaatcaataacttaaaatttgtgtcttatccctacggtttagctatacactaccaatctattcattaaacataattttatagcaaaaatcaaaaagaggaaattttatgtcatcaaaaatatatacataaatcagtttttcagcaggcactgacctaatttgttttcctaagaaactctgttttctatcagaaagttcgatgttatcaaaaagatttatttaggattaacttgaaaggaaaaggaaataaataccactctgcttctaaagtgttctaaagaaaagaatgtcaacaaatatggattgctacattttaaagaaaaacaagagaaacttattaattttaaaaataaattcatacgtgaacattagaaaaggcttgtagtaaagtaggaaagtgtttaggacatgttgagaaggtagatgaaaatggtataaaatttaagaataaacaataaaaattcatataaagaaaaatggtaacagttgattggagatgacagaatatagattagatgcccccttttaagttcactgactacagttgtaaggtttctgtaatatcttttacctaaataacactaaaatgttctatttttaggaaaaaactattcatatgacacatactggtctttagtaaaagagaaaagccattctattatattttaatatatttataattccacctttccttaaaatgagaattatggaactaattttctttgagatctcaattgaaagaaaatatcctctagcctaaaagaagcaacagatggtatgcctcaaaatcaacagaggttaaatgaagaaagtttaatagatcaacatctttcaaatgtatatgtatcagcagcaacaccaatgtcatcatcgtaataatgatcccaaaaaactgctgctggcaacaaataaattccttttcaaaatgtggaaataaattagacctggtacatttaactgggagattttttaaatgaaagtgatttttgatcctctattgattttaaatgccaatgctgacattaaaaatttggtggtggggggcaggggagaaatgtacctgtcttccttcaatgaagaattacatgtgaccaaaaaaaggtaataattaagatatgatccacaaatatctgtgtagaatatttttaacctttctacaatggattataatcacacaaaagaaaaaattaccagaaaacattcacaaaatacagccaatttaaatactgggtagagaagttgatgatgcctaagtaagtctgaatctcccaacccaaatccaaaaaaaaaaacaacaagggaccaaaacccatgctttaagcctaacttcaaaacagagaatctctaaacctcaaattatatataagtagaaatataaaccctaaattccagataactattttcatgcttgtatcacaaaacttcacaaagacctccaacagtatagaaaaaaaactgcctggaacaaagcaagcagaagttaatggcaggcctaaaagtaaacgaaaatcaacaacagaaagagaaagaacaccctaagtgtgaaaatactggaaaagattcttggtagatcagagcagcctataagggaaagacttgaaagagaggatgattcaatgaggtagtgtagaaagggaaagtttcacggagaaaattagcttaaaaaaaaaaaaaagtaaggggagagcagtcctttggaaactgtgaaataacagaaaaaaagaaataagaggggctgggtgcagtggctcacgcctgtaatcccaatactttgcaagaccaaagcgagatcacttgagcccaggagttcatgaccagcctgggcaacacagtgggaccccatctttacaaaaaattttttttaattagctgggcatggtggtgcatgtctatagtcccatttactcaggaggctgggacaggaggattgcttgtgctggggaggtcgaggctgcagtgagccatgatcacaccactgcactccagccctgggtgacagagtaagacccttcttttttaggcagaaaagaaaagaagagagaaaaatttaggctgctacaaaacatatctcgaaatagtttggggacatatactggtcctatgcatgcacgccctcccaccaaaaggccatctactaagaaaacatactttgtaattctaacagagagggtactcttgtactaggaatcttgcaagctacctcaaaatcaaatcaccaatcctgtccaaagaaataagaagatgcaagtaatctgtaagtactaaaaacagaaaatgaaaatcaaaacaattcaactggcaaaaattaccgacaaagaaatataaatgatgaagcaaaaggaaacaacacgacacttcaaaatgaattaaataccctcaagagaagcatttgaagataggaaatataaatataaattataaattttttaaagttataaattaacaaaagaaatcaggattgattgacaacaggaaagaaatcaagagagcaaaaataatcagatgtgaagactaaattgcaaggtgcccttcgaataaaattactgaatgaaaattttaaaaggggtattaaagaaaggtagaaaaagaaccaaaagaataaaaatgagataaagaaagaagaggtttagagacacaatgattggaatgtaaaacaggcaaagaagatccaatgtgcataaaataggaatccctgaaaaagaaaaaaaataacagaattaatatttaaaattataatcttaaaaaaaaacactttgccagagataataaaaattctgaatctacattttgaaaggactcactgagtaccaaggcaaaacaattgacccatatcaagtaatcctgaagtaccttgcaaaagtactatatttcaaagataaaatcttcagggccagcatctttcttaatgcaaacacaatgtaagcatttcctttagactgaaacaaggcaagaatgcccaccatctccactactattgaacacaactgtagtgatggcactaaacaatataattaggcaagagaaattagagttctaggaactgaaaaagaggaagtaaaacatctctatttgcagatatgattcattctctaaaaaaaaaaagagagagagatttaggctgcttgcttctgcctcagagttggtgctgtcatggccagtcagtctcaggggatccagtagctgctgcaggttgctgaaaagggtgtctgagacctgcagtgaaagaaccggagggagaagcaggccaaagcagcagttcaaggtgaaattgaacaatattgcctgcagagggagaaagagttcaaggccaaggaggctgctgccctgcgatcccaaggcagctgcagcattaaagtagaggagacccaggagaagagaaccatctggaagcagtttaggcagaagaggggtgaagtcttggcctttttctgcaatatctggtagtccattcctgctagtggttagaacaatgaacactagtataattgtttgggccagttttagttacttaatcaaagaggacagaattcaagaacttgttacatgttactacttggtgtactgataatcatttaaaagtaaagactctttgtcatgcaaaaaaaaacccaaggaggatgaatgagaaaattaactcaaacaatagaagaattcagtaaaaaagcagaatataaaatttatcactcaaaaaaaatcaatagctttcttacataccaacacaacgagttcaaagatataaatagttgaagcaattttgatttaccatacattaaaaaaaagattaaagacaaaaacaactctaaactaatatttaactctaattaaatatttaactctaattattaggccccatgctactgtataccccacagaggtacagtgctagcaattctgaagcaatagtttctctgcattctgagactcagcaaaaatgtaaacagattgtggaaataggagccctgtttcttgtttttttgtttgtttgtttgtttctttttttttttttgtagagacaaggtttcaccatgttgcccaggatggtctcgaactcctggactcaagcaatccatccaccttggcctcccaaagtgctaggattacaggcatgaacaatggtgcgtggccagagccacatttcttaatgttgaataggcagtttcaaatataaaaaggaaggaggctggaaggaactctgtgctataccaccagaattacaggtgtcagtaaaaactttgttttttactatagacagaaaaagaaatatgtattcttaattaaaaaaaataaacatatagtatataacactttaggaaaaatgagtgcctcacaaagggtaggccaccaaagcccccaaagaatctacctatgaacactgagcatgaaaccactgcaggggggtgagggagacattaaaaacgatactacacacttaattactatcaccaagaatgtaacaaattaattcaacagtcattcaacaaatattaaatacctgtgatgaacaagtattcaatattttttactttctggtgtattttggaaacagacattccaattttacacagatattgtatctttacatctttttgagtacttatttcttatttggaatttttaatcacatcccatgtggtgttaggcactgtgctgagggttttatatacaatagttctttctctcgacacaaacagcaaatttataaattagatattataaaccctacaaatctggagcctaaaactcataaagaattggtacatatactatgtggcagacgctcagacattaagccagttctatctgattcaaacgctattgtttttacctatgatatgctgtatcctgtctgggaagacatgcacatattatacagagagagttcattcccaggccatccaaagaatttctcttagtctataatgtagcagaaatgatggtaaaactcattaaaatgacagatctgcttcttgtagatcttactactctccatggtacttagccaatctcttgcacttataatagaaaagcactaagtatttttttaaattattaaaatcaagttaaccataatattaataatattgacttcatatctggcagatagcatgcctgtcatacagaagacaaaaaggaatcaaatttcttttctctatcttcatttataatcaatctatatttagttacctcctacgttataccaactatgcatagaagaaatgcaataatgatttctggtacactacagactaacagaaatttactaaatggtctaggaatgaaactacaagtataatctccatgtataagacaatattttcaaaaatatatagtaaaaaaaccatgaaaagaattaaaatgttcactagaacatattcacttaatctaagaaaaagcaataaaggagaaataaggaacaaaaaaggcatgaaacatataaaagcaagtaaaatgacagcttaaaatccaactatattaataacaacaataagtgtgaatggattaaacattccaattaaaggcacacattggcaaactggataaaaagacaagagccaactatatgctgtctatggagacatacaatagatgcaaaaatataaacaggctgaaagtaaaaggatggaaaaagatatataatggaaacagcaaccataaaaaagctagaatagtagtatttataacaggcaaaacagacattaaaacaaaaaaatgttactagagataaagaggaacattttacaatgacaaaaggaagattaaaaaaattataaacatacatgcaccaaacatccaatctcctaaatagatgaagcaaacactaacagaattaaagagacttcaataccctgttttcaataatgaatagaacaagtaggcataagatcagcaaagtagaagatttgaacaacactaaaaaacagatatctatagaacactccactcaacaacagcagaatacacattctaatcaaatgtttattgaacattatccaggatagatcaaatgctaagccataaaccaatagttacagctacacagggctactgcctactgtattagatagctgccatgcatagatagtacatactccctgatgatagcatcctaagatgagctggaatccttttcctcagtagttttgagaaatataaagtgggtacaaaagccccatctaagatactagtacactagtaactcacatcccccataggtcacctctattccttgatcttaccatgttaaccacttagccacaggttaaagatttttttctcaacttgccttttttcagattctgatgaagaaacacataacgatctaaaactccaaatgcagtctttctcattacatgaaaatttttgttctttaaaaatagtcctgtgtgccattaatatttataccattttgaaatcaataaatacaactatataaaatatataatggtaaatgatactatgtaaataaagtacatttttatgtcaaagacgtaaaaagacattacttactgtgcttttatctttcagaagtttttcaattacttcaattaacatttccttctgctctggatcaaggctaaaaaatacaaaaataacatattaatttttccctttaattctagctttacatgatgctcaccaattcaaggatgttgagaaatttttaaagagggaaaggagagcaagaattataagttagaaataaagaaaaacaaataaaatgggatggtttttctcatgaatgtgtcctcatctttccctctaatattgttcatattaactaaaccagatatcaatggtttagttaagatagtactgaaagaacaagttcacttctaaaagagttggaaaacttcaagaaagcgactgtaagtagataaaccacaaactcttttcaactgggaggaaaaaaataactagatagcagtcattattttactatgcatacatacttcccaaaaacaaatatggagaatttccaaataagaattttatatcatactagttcactgatagagacatgcattataaaatctgccaactaaaactaggaaaaataagaggtagtaataagcttaaaacatttgagatagaatactaacagactataagctcaaggcaaggagaggcaagcattgaggctggaatatactggtgcccaatgatagaaggacttttaagccgttagagtgagcatggatcttatcccataagtttctaaggagaaaaggtgagtgagaagcatgataaaaccttgtctggcagttaacataggaatatgaggtttcactttctacaaacatacacatttattactaaacattataattatctggacaaactttttaattctttcaaatttcagcttaagtcttccttctcaaagcagtatttcactaccaatcccatctcattacatctttactttccggtaacaaaatatgatcatctctggtccctgtcctatcaaagacattgctagtgtacctttgtatatacatatatatcaagtgctaatatcttattcattatagattgcctttaattatttggtatgtctttgatcttcttcctcaaatacatgatatgctattcataattaagtgccacatcctctactgttttcatacatctaaatacacatagcacaatactgtgaatacaacaccagaaacagaagagagtctcaaaaagcttgaggaataaatgatagctgaaaataataccaaattgttgtagacaattctatttggacagtaaattttccacagagatcagggcattgtataatattgcataacatttctaaaatatcacacagatatggtatagcacactatatttcaaatcactacactttttaaaattacttaataaaatagctctggaaaagaattagacaacgaagggagcagcaggaacaaagatggaagaaaggaaaacacatataagtgagttgagaggatcagacacttaagattctaccctaaacaggaaaaaaaaatctcaattttctaataatacaagcatatgtgtacatgagatagactatataaatgagaattcaaattctgattattcttaagttataaaatctataaattatcacaggctctaacagcctcacaaataaaaacctgcatagggtctctatagccaaaacgaaattaaagatgtgtaaggaacatttgcagcagggggaaataccatcatacagtcactggatttacttagtgtaagagcagcctacctaaaagagcgaataaaacaagcctctgtggtctataacattccatgtaacatcagagatctttggtatattgttaacaatgcacctacctgtataatttttgtattgcatgggctgcattcttcctaacatatggtgataagtcagcagaagcttccttaatagcaagcatcatgataggtacaataattggcactctaatacttgacagaactctcaaagcgcttgcacgaattagttggtttgggtcctaaaaatagtgcaaaaatattcaccaaaatttcaactttacaatattttaaacatatctttcagacacagttaataggtgcttaaagggtgtaatatgacaatagcaaaagaaagctacttaatttaaaatgaacaattagtatataggaatgggaaaaaaagacagacataaatgtttacttctttaataatgttttaaagaaaagtaatagttataattctagttggtcatttattactaaatatgctgggtttttatactttcataataataaaatgctgcaggtcatcaatttcatgtttaaaaatgtcttataaccccttttgcgtactttcaacaactagtataatgataaacagctctttgaagcatgaaaataattatattgaatataaacaaacatacagaagctgtaacatatacagcaaggtttcagttggttgtataaattattttctaagtgtactgagtaggcactataggaggcttttaactctttcaagacactactgtgctatttagtggattatcgctccacttctttaactgacacactttcaactctgcagaaaccttgtagctatttgcctactcactccattatttaccttcagagctcgctgaaaagtgcttatggacaggagtgcaagatcctgctgttcttcagcatatcgaaccaggtaaacatataccaacttcttgatctgttaaaaaaaaatcatttattcataaccagagtgaaaatttaaaactcagtatttgctataccaaaatccatgctcaattcttctcaagtaaataactgaatctggtcacatgttagattgtaaaataaaaataatattttgtgggataataagtacaacaggaaaagcttttaaagtaagcattttaatagtccagttcacaatagcaatagcctatcaaagtgtcccttcctcttgaagggaataaaaaatccctgagcagatctcatataagaatattaactaaattgtaaaaatattttcaaaatgagggataaaaataaaagaaagaagccaggcatggcgtacatgcttgtagtcccagctacacaggaggctgaggcaggaggatcacttgagcccaggagttagaggctatcctgggcaacacagagagaccctacctctttaaaaaataataagagaaagaatttgggcccaggccactaactatatgttatgggaacttgtttcctcatctgttaaaagagtccagagccctaactctgatttttatggtaatactcacatttcaacacgcattacatgatattttcagtccagtaagaataatgtgtgactatgaataccaatttaacgtaataaaaattcaagaagattggatgtgtgttctggaaacagttttttttggttttcgattttttttctgagacacagtcttgctttgtcgcacagggtgcagtgcaatagcacaatcacggctcactgcagcctcaacctcctggcctcatgccatcctcccacctcagcctctccagtggctggaactacaggtatgcaccaccacacccggcttttttttaggattttatagagacggggtcttcctatgttgcctacccaggctggtctcaaactcctgggcttaactggtcctcccacctcagcctcccaaagcacaggggttacaggcatgagccattatgcccagccttgaaaacaagttttaaaggtaatttaatcactaagtttacaacaaaattatgaacagaaaaagaaataaacaaaaactagaatttgagttgaaatttatccattgcttccttctagcactatttatagcctgtatctaccttctcaaatatcttcacattcctgattacccttctaagataccaacacagtatatacctaaaagttatgtactcagccaggcacagtggctcacgcctgtaatcccagcactttgggaggctgaggcaggcagattgcctgagttcaggagttcaggaccagcctgggcaacatggtgaaatcccatttctagtaaaacaaaaaaaaaaaaaattagccaggcacagtggcatgcacctgtagtcccagctacctgggaggctgagatgggagagtcacctgagcctgggaggtcgaagctgcagtgaggcaggattgtgccactgcactccagcctgggcaactggaaagagactctgtctcaaaaatttaaaaaatttaaaattaaaaaaaaagttatatactcaaagaacacaagaaatgaggggaaaaagttggagatagctggaattggtgctggaaatataaaaacagtactatactggatcatatttccagtcatactaaccaatctggactactttagagacaactgtcatgaccttccttccttgtaccctaatttctcgtgaaacataacagctttagttcctctaccatcctgtttgctccttcctaaactcactccaatttttttcagcgtgacactacaaactacaaataaagtctaaacagaacaaactagataagaacttgctccagatgaggtacttccacagatatgactaattcttgattaaaaccatacaccttttccaaatgtactgctgaccaaatcaaaatccaactgtcctcacggaatttttttaaaattattttaaatgaaaggcaaaatcttccatttatctacagaaattgtcaacaatttagattcaacacatcttggcaccctgttaagataatttgagatgataattttataatccaaactatttctcaattcataagtacaaatgaaaacttaatgagcaaacaaactttgtacatcttcatcattgataaatatgttaaacacaaccattttaagttgatatcaatccatctatactatacgggtagagttataaatgaaatgaaaaaacctttttccaattactcttcaatgttgaatggctccacaaaaccttaaaaacaaaatctaaagctcttaacctagtactcaatacagtttataatctgttcgaaacctcctttcctagtcaaacagaaatagtccccaaatataacttgcactctttatctcaatctccactcaggttatcccaagttatcccgcttcaccaagttccacttccccaagttccacttattaaaatcttccacaagagcaaaaattaaacaataaagagtcctagtagataaacagtaaacaaatgacagttcctccatataacactatactattcagccactatacaaaattaaataaatctgtatgacattgaaaatatatccttgtggccaggcacggtggctcacacctgtaatcccagcactttgggaggctgagacgagcggatcacctgaggtccggagttggagaccagtatggccaacatggtgaaactccatctctactaaaaatacaaaaaaattagccaggtgtattggcccatgcctgtaatcccagctactgggaaggctgaggcaagagaattgctggaacccgggaggcagaggttgcagcaagccaagatcgcaccactgcaccccagcctgggtgacaaagcaagacaccatctgaaaaaaagaaaagaaagaaaagaaaatatgtccttgaaaaaggttttttgtttgtttgttttttgtttttaagacaaagtctcactctgtcaccaaggctggagtgcagtggggcgatctcgcgacttactgcaacctccgccacccaggttcaagcgattctcctgcctcagcttcccaagtagctgggattacaggcacgcaccaccacgcccagctaacttttgtattcttagtagagatggggtttcaccaagttggccaggctggtcttgaacacctgacctcaggtgatctgcccgcctcggcctcccaaagtgctgggattataggtgtgagccaccatacctggcctaaaattttttaaaggtgtaaaagagtatgcattgtatgatctcacttctgtataaaaaaaaaatagatgcccacatactgtattttatgcaatctaaatagaccaccaattgtaaaacataccattatattatggaccacaaaggaaagaacaacaacaaacaaacagaaaacactacccatcgtaatcaccaccagttgttaagttaaatcccaactgcagaaactttaaaatagcaaacatatgtcttagaatggacataatatggtaataatagcaaatccttataggtagcattaactacatgtcagacactgttctaaatgtcttacataaattaactcattttatcctcacaactcaataaacaagtatttattcttactttacagataagaaaatgaaacacagacagggtaagtaacttgactaaagtaccgtatctattaaatagaagaactaagattcaagtcaagtaagcacaaaattgagaaatctatacaataaaatgttaatagtaactatctctgtgtgatggtattaaccagtgactttcactctttacatccttctatattatctttaaaggaatattaattactttggggtcagataaaacaataaagatatttcacgataggggtgaatctcatctttccagatggccctcaaaacaaaataatagtgctgtgattcttctaatactttaaattctttaattataaaaagatttcaaattggtaatgtttttaagttcccacattcctcggagagacaggtttttctaaagccttggcaacatgtagccaccagaactgttttaaacctgttctacagaacaataaaaaggcacctgaatgaacaagttttcttgctcagcctcttgcttgtgaaagttagccagtcaggaacaactgcactcccatacacccacctctgagtgccaatcaatcaagagcagtctcacccacatgaccatgcatctacagatgatatcaacccacttaggaccctgaaagtccatcaatccctgaagactgcccttcccaataatccacaataatatcagcaatctctatgcccagagaagctgtgcctaaaaagcacagttgtcccttgctatagtaagcaataaattgtcttatttcagatatcatccttcaatacaacctactgaaaagttccaagactagttcactgaagcctcatataggcttcatttatgttttattctttctttcttttttttttagacagagtcttgttctgtctcccaggctggagtgcagtggcacaatctcggctcactgcagcctctgcctcctgggttcaaatgattttcctgcctcagcctcccgaaaagttgggaccacaggtgcacaccaccacgcccagctaatttttgtatttttagtagagacagggttttgccatgctggccagactagtcatgaactcctgacgtcaagtgatccacccacctcggcctcccaaagtgctaggattactggcgtgagccaccacacccggccgccttcatctatgtttttcaattgctaacactacaattataaaattcaggaaacataacatcagtgcattatttattatctaataaataatccatatttagaaattctcaataacatcctatatttatagtattttttctgatctgggatcatgcatcatatttaagttttcatgtctccttggtcttctttcatctggagaagttcctcagcctttgtttttcttttttctttttttttttttgagacggcgttttgctcttgttgcccaggctggagtgcaatggcatgatctcagctcaccgcaacctccgcctcctgggttcaagcgattgtcctgtctcaacctccagagtagctgggattacaggcgcatgccaccacgcccagctaatttttctatttttagtagagaacggggtttcatcatattgttcaggctggtcttgaactcctgacctcaggtgatccgcccaccccggcctcccaaagtgctgggattacaggcgtgagccaccacgcccagcccagcctttcttttctaaaagtacccttgtcattctggctagtattaaaattaattaggaaatacagaatatgaaaggaaaactgcctgcgacagcttttgttcttcacctcaatctgctataactttccagctagaatttaaatgtgtaaggccctacatctacattatattactcgtttaattctcatatctatcctaggtacaattatctccctctcaaagataaggaaagtaaggctcagaggtttatataacttgcccaaagtcacagagctagcaagtgcagaatcaggatgcaaacaggggcatgttcctaactactacatgttgtggcctatgatggcagtccgcagatatttctattaaggtacccctaacaaaagaggagacaactcttcccctaagagcatctgaaaacctaggaaaaaaattatattttatttataatatatacatttataaaagaagaatgctttaaatcactgttttttaaccccaattgcacatcttctcatttgaaaatgacatcattgcagtattattattaaaaatccaacaagaaatttacaactgtagtaaaaggtagtaatgacttcattccatagaaccccatctctattatcaatgtactttccatctatattcacgattagactctttacactttcttggtttaaattagtgcttctcaaccttcagaatttttcaaacccaaaatacacatatttgtgaaacactgttcctttaaatgatcacttggaaccaagtgatgttacacaagaatacaaatataggtataagatggaaaccaaatgattcaaactatacttaatgtttcagattatatttaagtgtaaatataagtttttcaaattcttagatcagttttagaagcgcttctctaactatttgaggatagatgactttttcctcaactagatttaaagttcctaagaatacagcaatggtagaaagcaattaacacgtggttgactgattaacagcagtcaatatatcaaatatatatcaatatatcagcagttgattaacaacagtttcaatatatcaaatcaacacataatatgtatttaactaagtaatttatcccatctgcctggaagtgaacttgaggctatttagtacaacaaccatttcttattcatctgtatattgcaaggacttattacattgcttggcatatagtaaaagctcaatatttatcagctggatcacattccagaccaactgtagactgaaaaaaattaagacatttcccattagagtgctacatctaggatctaacttctcacaccagtgggtataattcattgaacagcaaagtctagaaagacaccaacatactatgaagaaaacaacaggttttggaaagactgcctccaaagtctttaacttgttagtctggttgtttttttggtgtatgtgggtgtgtggggaggggtgtgtgtgtgtcagtgagtgggggtggaggtgtgggtgtatgtttaaagagagatagggtctcgctctgttgcccaggctggcctcaaactcctgggctcaagagagactcctgcctcagcctccctggtaattaggactctaggtgcacaccaacacagctggtttggttttttaaaatattcttttaaaatattctttctctttactaattatattcagatctcactctacagttctctggaaagttttgagaaagaatgggtccagttctcccttatccccttacaatttatttctcagcaatacctttattcaccaagtacagccagcttttaaaactggattatgaactctagaatatatcacagagtttatattggcaacactgaaacattcagaaccacagctgagctagcaggcattgcaataattactcactattggagaaggatttctgtgactgttatggcaaaaagcataacaatattaaatcacagaaggttgcgaaacactaaatttgttctacttctgttataagaatcaatcaatattgaccacaagaggcctatgcactgacaggctgcaggtgtgcaaagaaagcctaccttccctgaaaccattctgtgaccagaaatgggagtagttaaagctccgtgactacatcattctctgatcggttactttcattcaatgttataacactccttgctgtaaagctaatcatagcagagccccagtaggctggaagaacacagacagatctgtttaattagcttatcaatactagtacatcaaacttcatgagttattgactaaacctttgattatttttgtactataaccactgattgcttactaggtcacttttggtatcatttgacatttaatggtagatgacgtacagctcacctgtgtgtctaaagcagcatgtacttgtaaaaatgaaattttgcacttgagaggagtgaaacattcaatttctgaacataagttttaagaaacttatgtcagttttcccaaaacattaaaggcttaaccatgtttcaaaaaaataaaataaacaaggtatttaaagaacgaaagaaatccaaaacaaatagaccaataattatgtttatattgacatttttgtaacagaacattaggcagctaccagaatctaattgtaaagggaaaatatgagcaaatggaaaagttctcctactgataactatttgaatagtaaaacagttctgaaggaacaataattggtatggaattttctgtttacaacaagaactagaagtcctcagggaactagctactttaccaccaatttctaaggacttcgtcatttctacccataactaaaacataaaagaaaaaaaatatgccaatactaggtacctcccaaaggatggctaatgccagatgttgataaggagtcaaaaatattaagagacaaaacagagggaggaatcatcaaacaggaaagatggcgctgaatgggctaagatgggttctgaagtcaagcaacctagctttggattctgactgctacacactggctgtgtgaccttgatcagctaatttaacctttctgccatcttgtcctcatatataaaatacaagtaatgacagaaacagccccacagggttatttgtgaggataaaacggagtagatctatgcaaggcactaataaccttggtcagacaggtttttttaatgttagcaattattcctattgctactaagagactctattcctgataatactaagacaagcttcacctatgcctcataatttttctaagttaaatgtttattttttccagatatttggactttcttataccacaggccataaaactaataaacatatcaaattagaagctcagatatcatggccataaggtgtcaaagggagagtagttgaaaattatcaattcagaattatatataacaagcacatagtgtttaataaatatctactaaattaatcataagtaaaattgattttactcaagaaatctacaaagaaagtatggtttatcaagtcatttaaatccagtactaatttaatctaattcataaactggccacaagaatacaactgttttgattttggcttatccaacttagtctaattgagtttataagaactatttcattttgatagaaaaattcatctatctgaaatacagaatgcacttcctatctaatgaaaaaaattaagagctgggcacagtggctcacatctataatcccagcactttgggaggccaaggcaggaggatcacctgagcccaagagttcaacaccagcctgggcaacatggagacctcgtctctacaaaatattttttaaatagccaggagtagtggcacgcacctgtggtcccagctactcagaaggctgagtcaggaggatcacttgagcccaggaagtgaaggctacagtgtgttgtgttcatgccactacagttcccccccaaaaaaagcaagaagcatactttaaaatattaaatctttttttaaaagtaggtttaggctgaacatggtggctcacacccataatcccagcactttgggaggccaaggtgggcagattacttgagctcaggagttccacaccagcctgggcaacatgacaaaaccccggctctactaaaaatacgaaaaataaattagatgggcatggtgacacaagcctgtaatcccagctgctcgggaggctgaggcaggagaatcacctgaacccggcaggcagaggttgtagtgagccaagatcgtgccactgcactccaacctgggcaacacagcgagaccctgtctccaaaaaaaaagtaggtttaaagtacctatccttaaaatgctataatccagtgatgcattgcttaacaatgttctgagaaatgcgtcgttggacaatttcattgttgtgcaaacaccacagagtgcaacttacacaaacctacatggtatagactactacacacctaggatatatgatacagaccaggggtctacacacctaggatatatgacatagcccaggggttggaaccaggccacacagcaggcagtgagcagtgggcaagcaagtgaagcttcatctgtatttacagctgctcttcattgctcgcattacctcctgagctctgcctactgtaagatcaacagcagcattagattctcataggagcacaaaccctattgtaaactgcacacaagagggatctaggctgcgtgctccttatgagaatctaacgcctgatgatctgtcactgtctcccatcacaccccagatgggaccatctagttgtaagaaaacaagctcagggctcccactgattctacattatggtgagttatataattatttcatcatatattacaatgtaataataatagaaataaagtgcaccataaatgtaatgcttttgaatcatcctgaagccatcctacccaccctgggtccagagaaaaattgtcttccacagtactggtccctggtgccaaaaacgttggggactactgatatagcctattgctcctaggctacaaatctgtacagcatgttactgtactcaatactgtagataactatcacacaatggtaagtatttgtgtatctaaacatagaaaaagtacagtaaaaatacagtattataatcatatgggaccactgtcatatatgccaagaaatgcaagttggaaaaaaactaaaatgaaattttaaaatgtttctagttaacccaaaaaaggaataggaagaatagaagacaaaaataaaagagacaaagagaaaagaaaaagaataatagtagactcaaatctaagcagatcaataattatattaagtgttagcaaaatagacactccaattaaaaggcagagattgacacacgggatgtagggaaggctgcaactatacgctgtcaacaacaggtgcacactagatataaacagacaagctgaaagcaaatgaataaaaatgataataaaaagaaatgagaaggttggagtggcaatactaataacaaatcaaatatgctttaagacaaaacatattaacaaaaataaaggatttttttataataaaaaggtcaattcatcaggaaaacccaaagagttatgcctaataggagtacttttaaaaataagcaaaaaatactaaattaaggggaaaaataaaacattccagaatcagcccaggcacgatggctcatgcctataatcccagcactttgggaggccaaggttggcagattgcttgagcctgggagttcgaaaccagcctgggcaacatggtgaagccctgtctctgttcaaaatatgaaaattagctggacatggtggcatgcacctgtagtcccagccactcaggaggctgaggaaggaggatcacctaaacccaagaggtcaaggctacagtaagccacgatcatgccactgcactccagcctgggagatagagaggaaccctgtctcagaaaaaaaaaaaaaaaaaaaagccaggcacggttggtcacgcctgtaatcctagcactttgggaggctgaggcaggtagattgcttgagctcaggagttcaagaccagcctgggccacatggcgaaaccctgtctctacaaaaaaaaaatataaaaaactagccaagcatggttgtaagcgcctgtagtcccagctacttgtggggctgaggcgggaggatcgcttgagcccaggaggtcgaggctgtagtgagccaagatcacaccactgcactccagcctgagtgacgaagtgagactctgtctcaaaaaaaaaaaaaaaaaaaaatcaaaatcatgattgggagattaaaaattcctctctcaccaacactatcaatcacatttagttaagtaatatttaaagaacattagctcaaaaatgttttctttttctctggttggttttgctggcaagaatactttgaacatttaaaatcatcacgcaaaatagaaaaaacttcactaccaaaaaatgaccatactatgcatggaaaataaaatcataactacaaaattagcgaaccctctgaaatcacacacccatcctccttacgctctcacacttgcccgtgcaagaatgcttgtgcactttctctgtcaccataaccatgttccctggattagaatgtttctgttatttgttaatgagcttcatcatctgccaataaaatggcaaacaaatagtagcagtaacacatctttaattttatggtgagggaaaggctttaaagctttaaactgagaaaaatttatcaattaaccaggctttttcaattaatttatcaattaaccagggtggagaggagaatgtaaccttaatactagactatattagtgtagcttacagaaaacagtattttactgggacgtgttcattcaataaatccacatatatgtactgagtgcttagtacatgtcatgagtagtctgagaaacttgggaaatattcttgggctcagtcctagaaatcccaaaaagccccaaatcatcaaggtctggatatacccaaataggtctttttcactggacatatgctatcttaaaattaagtccctggaacaaaatttaaactaaacgggcctctaggaacaggtgaaaactcgacaacttaccatcattcactcaggggaatcaatctgttttgcttttcatattttctaccaaaaatccaaagctaggattgtgcctactttttatttgatcttacctacatttaaaattaaggacattttaatcataacaaaaatctagtgatacttaagtatcttatgttgcattatactacataaaaagtgtacggtcccatgaaaacaaaaggaatcataaaaattatagatcaaaacagtacctcaatatttttactggccacattcttcacaacagcaggaaacagttcagatgcatttttcccttttgcaatcatctgaagaataaacaaaacagacaatatgggaaattctatatatattaaatatttagaagattaggtcaacaaataagctacgtaattaaccgctgaactctttttgaatcatcttacctcaactatttacagcaaataataaacactatcttgtacagcaatataaatacacaaatacatagacacaataaacaagaaatatttagtaacttaagatatatatttaaatattttactagttttctctggctaactgggttataagtaattttttttttttttagacagatcctactctgtctcccaggctagagtccagtggctcaatcatagctcacggcagcttcgacctcccaggtttaagtgatcccccacctcagcttcagctgaggctacaggcgtatgtcatcatgcctggctaattttcgaatttttttgtagagacagggtaccactatgttgcccaggctgggtaaaaactttttaaaaatatttaaaaatatttttgctattttctattttccaggatctgacattaaagatgtactgcatttgcaatgggggaattgagagagggatgaatgttactttgaaccaactaattatgtgaacctttgctttcttttcataggttaccctacttctgcaaccattgcttttcaaagttgccttcactaaacattcttcctctgcccactaaagttctgcgcaccaccatcttttcagcctacactgttctacaatctctgaaactcctaagatttcattcaccgttaggactaactgtagcccaaatccagcctgagttccacatctctaactagacatcattagattgctctcatcccaaacttgctatgtctaaagccaaactcatctttcatgacaaaatggcattcatgataaaatgacattcatgatagaatttcctatttccacagttctcctagataccaaaaaccacaaaattaccctggtctcttctcacagaagagtaactaagtcctgctaatacttctcagaacacatgttaatcccttccactgctattatcctagcatgggtcagtatcacctcacagagaacttttcagtctcctcttcctatccataatgtatatcactgacagtttaatatgcttaaaacactactttgcacatgtcagcccccgtaaaagatttcaaaagcttctgactgtctggagtccaaatgattttatgtaacattcaaatattctcacaatgtgcactaacatctgttcttaaactctctgacctaaggttctattaaaatgaccttactcactactagaatattctctggctgccccactatgcctctgctcagatcatggccccagctttctaagttctccccttctatctaaagcatcatcaaattttactccttctcccttgctacagccatctcctaacacctgggccactgtgtcacccaatcctaatttctttcagaatttttttttttaagacagtatctcactctgtcgcccagcctggaacgcagtggcacaatcttggctcactgcaacctccgcctcccgggttcgagcgattctcctgcttcagtctcccgagtagctgggattacaggcacctgatgccaccactggctaatttttgtatttttagtagagacgaggtttcgccatgttgaccaggctggccttgaactcctgacctcaagtgatccacccccctcggcctcccaaactgctgggattacaggcacgtgccaccatgtgcagcctcctctagaatattttaatctacacttatcatttagaatttcctgtgcactattttacatttctatttattttagttttatatctatctgtattcccattttgtctttctcattctcagattataactttatatcttttaaaagtccagactttggtaaccacaaaataaagttcaaactatagggtaatttggggaaaagggattccttatgaattacataccatatctaataaactgcctttaaaaagatattagctttattaatttacaacaaatgttatataaatatgtgatacttgaagcattagaatccccgttaccaatttcttataagaactttctatatgatagccttaaaatattcttgaatacaagctagtctttttatattctatttccttacctgtgacattcttttgagtattttgtgaaacctgctgagcactatggagggtttacaaaatactgaagctaagacatctttctatgatttgtacacctctctccattttctcatctttgaaataagaaaagagagggattaaatgttctgtaggacccctgccattcattcattcattcattcattcattcattcaatgattacctaaagtcagacatcctgtcctatggtatcctactccatgactatctaactttattccgcagaacgttattcaaatatggggaaggaaaaaaacaccacaatcaaattcactcaacaaatatttgctgagaagatactttctagcagggaccatcctaggccttagggatccaaccataaccaatacaaagtccttgcccatgtgctgcttaccttctaatggggcaagggtcaataaacaataatagtgaggtggcaatagactactgtggagaaaaataaagtagtatcgggggatgagaagtgctgaggtggaggtgggagttgctcttttagataaggtggtcagaaaaggccttccttttggcagggatgcaaaggaagagaggaagggacccatgtgactagctagggaaacaatggtttaggcatggcatgtgccaggaataggaggccaggagagccagactggagtaagtgaggggaagaatggtgagagataaggtcagaaatgtataaaccactgtaaaatgagttggcttttactatgagtgaagcaggagaccaatggagagttgtgagcagaggaaagacatcattaaatatttagcaatgactcatattttaaaaggatctttctggctgcaatgtgaaaaatagaccagaagatatgataccatggaaaacagaaggctacagcaattatgcagaggaaagatagtgagcacagtgagaatgggctagatttgggatttattctgaaaatagattatatatgatataagaaagaagggacatgaattaagaagaactactgcctgtaatcccggcactttgggaggccaaggctggcagattacttgaggccaggagtttgtgaccagcccggccaacatgctgaaaccctgtctctactaaaaacacacacatacacacacaaacacaaaattagccaggcatggtggcagatgcctgtaatcccagttacttgggaggctgaggcaggagaatcacttgaacctgggagccggggattgcagtgagccgagatcacgccactgcactccagcctgtgtgacagagtttgagactccaactcaaaagaaaaaaaaaagaagaaggactacaaatgactaactggagaaatggaattgccatttactatgatgagaaagactagggaagaagcaggtatttggggagatgagcaatccagagtttggtttcagatatgctgagaagccagctgaatatatgggaataaaggctacagaatacaggagacagcactggttagcaatatgcatttggaaagggatgagatcactacaggagggcatacagacagagaagtagactgagtgacaagacatagtacaatcctaaaagtagaaattgtggccaggtgcggtggctcacgcctgtcatcccagcactttgggaggccgaggagcgtggatcacaaggtctggagatcgagaccatcctggccaacatgctgaaatcctgtctctactaaaaatacaaaaattagctgggtgtggtggtacgtgcctgtaatcccagctactcaggaggctgaggcacgagaatcgcttgaacccaggaggcgaaggttatagtgagccaagatcgcacccctgcactccagcgtggtgacagagcaagactctgtctcaaaaaaaaaacaaagtagaaattgtggagtgttggggaccagcctcaaaaccacccatagggtacccaaagtccggtggcaacaaaggattgagaagagacaagttaagagtaaaggtggggagccagggggccagttgtacttttggaggctgcaaaaggctcagagctctggtctccacactatttattgagtacaatcacttagatctgagaagcagacgttcagggcgaaacagtgaaagggaggcaatgcgtaataggcgtaatctacagcgatagtggtttaaatgaatctcctttgtgctcaaacagcctatctttaacttatcagagagcagctagtaggagcgggcttaactaggagcctgcacgcctgttcacattccagtgtttcaaaggagtgtctttctccttgaacacagtgtttacagataagaaagcgggtctccctctgagcatgggaacatgatggcaattaggagactttcctcctcagaggcctcttgtggcttccacaacttattgtcccatatttttatggccagtttatacagacaccccacaagcccttttcccaacatgaagaaaggaagaaaccagcaaagaagctcttagactccttgaacctcagtttgaaagcgggcagtccttctcagtattcctccttatccactcaaataacatacttctcccaccctctctcccttctgctttaggtaaaaaccctgttcctggtccccttgtactcttttacccagaacaaggagcataggaattgaggggagccacatttgggccctgagggaaaagtaaggttcataggtggaaagcataggagaatatgtcctttttcattttatttggttgaagttcctgatatttgaaaaagctgcagtaccagcgattctgccctttgaaggtgactctctagataaaaggtgagaaaggaagacaagttttcaggtaaaaagtgagagtcatgtttagggagcagctgggcaaaagttgaggagataacataaggtcatttgtagctctaaactctcctaggttctaatcatgccctctgctaagctcttagatagcttctacccaaggtagagatggaattccagagtgccccaaagaacattcactggttgcaggcatctgattaaaagagtgatcatcagtttctgatacctgttctctaacttcacacatttgacttttattttttttcatccttcaacctttggtggcctcagccccaacatcaatgtttttacttacaatgggtatagcctaacagcactgtattttgggaaatttgactgatttactctccatccaatcctctatgttcatgagggagatggacataatttaattttttcataatgtctttgtctagttttcagaccaggatagcactgaactcagaaattgaattcagaggtattttctcatattctatattctggaagagcttatgtagaactgaacgttccctgtagaaatttttttaatgaaaaattcaattactttattagatataggactattcagataatctagttcttcttgagtaaacatcatagcttatctttgaaggattttgctcatttcaacaaagtagtcaaatttatggggctaatgatgcctaaaatattccctaattatcccttaaatgtcaacagggtcttgcatttctgatattgataatttgtcctgttttttcttggtcactctgtctacaggtttatcaattttatctatcttttccaaggactagtttttcatttcactgattttactctactgtttttctctactcaatttcattgatttctactctaccttattatttctttctttagttttaatttgagtttaatttgctcttctatttctgctatgttaaggtagctgctcagagcactgattggaaatacttcttttcaaacataagcttttattactataaatttccttgtaagtactgttttacctaaatcctccaaactttgatatgtggtttttcaatttcatcctaatttccttgtgacttttactttgactttgactcatggatcatgtcatcatttctaaatgtataagtttgatgtataattttcaaatattttaaaaaaattttgatctcttccaatgactgtgtttagtttaattctatatggtcagataacacacttgcataattttaattcttttaagtttgttaagattgtgttttatggcccagaatgtagtctatcttgctaatatagataataattataatatatagataatatagataataatatagataataataataaaaagaatgtatatttcgctactgttgagtagactgctctataaatgtcagttaggtcatataagttgatattattctagtcttaaatttccttattggttttctatctccctattctattgatttttaagaaaaaagcactgacgtctctataattgtgaatttgtcaatctttcctgtcagttctaacaggtttttttttttactccgtttttgaagctctgttgttagacacatgtaagattattatgtctttttgggaaaatgactcttattgttatgttctttatcctaaccatactatttgttcaaaagtttactctctctgatataaatagattcatctgaactttttttggttagtgtttgtatggtatgcatttttccttccttataacttatgtctttatattaaaagtaggtttcttacaaagagcacagttgtatcttcacattttcatccaatatgaagatctctttttattggtaatgtcagaccacttacatgtaatagaattattaacatggttagattcaggtctaccattttagtatccgtttcctgtttattccctgtattttctgttctcctacttcctcttttctcttttccttagaaaatttttagtatttcatatttttatattaactttctgcctatatctttttatataatttactggttcctcgtaaaaatgcatcataggcataatctatagcaatagcggtttaaatgaatctcctttgtgctcaaacagcatatctttaacttatcggattatcagatacataggtagataaacagacatataaatatataaatacagaaacagcaaaccttacacagtctacttacagttaacactgtaccagatcaagaaaaatgcagaaacaggcagggcacagtggctcacgcctgtaatcccagcactttgggaggctgaggcaggcagatcacaaggtcaggagttcaagaccagcctggccaatatggtgaaaccccatctctactaaaaatacaaaaattagccaggtgtggtggcgtgcacctgtagtagtcccagctactcaggaggctgaggcagaagaatcacttgaacccaggaggcagaggttgcagtgagccgagatcacaccactacactccagcctgggcaacagagcgagactctgtctcaaaaaaaaaaaaaaaaaaaaaaaagaaaagaaaaatgcagaaacattgcaaccatatagactcttttatttccacctccccactagcttttatgtttagccacccatattaaaaacctctcagatagtgggataacttaagaataaaattagtcctttatacgtatttaccattttgattggtccgcctaaatatccatctggtatcatttcccttcagcctacacaacgtctattaacatttcattaaagtaaacatgttagaaatggatactcttagtctttatttcatcttcgttcttgaaggatattttcaatggatatagagttctgggttaacagttctcttctttcagtacttgaaacatattgttccactctcttctggctgccatgatttctgatgagaaatctgcatttattcaaattattgttcccctctatgtaccattttttcccgctactttcaagactttatttttggttttcaaccatttgattactgtgtttatgcgtggttttcttttagtttatcctaactggcatttgctgagcttctttcatctataaatttgtatcttggctgggcacggtggctcatgtctgtaatcccagcactttgggaggctgaggagggcggatcacctgagatcaggagttcgagaccagcctgaccaacatggtgaaaccccatctctattaaaaatacaaaaactagctgggcatggtggggctggggagcgggggcacctgtaatcccagctactcaggagactgaagcaggagaagcttgaaccccaggggcagaggttgcagtaagccgagattgcacaatgcactccagcctgggcgacaagagtgagactccgtctcaaaaaataaaaataaaaataaaaattgtatctttcatcaaatttgggaagttttctaccattatttcttcaaatattttttcctactccaatctctttctcctctccttctgctgttctaatgatgcatacgttagacctttagaatgaaccaacaaaactccaaggctctgttcttttcaatctctattcttcagaatgatttttttctttttcttttttttttttttttttttttgagacagagtcttgctgtgtggcacaggctagacggcaatggtgccatgttggctcactgcagcctcaacctcttgggctcgagtgggctttctgcctcagccttctgtgtagctgggaccacaggcaccctccaccatacctggctgattttttggtatttctgtagagacagggtctcactttgttgcccaggctggtctcggaactccttggctcaagcaatcctcagcctcctgaagtgctgggattacaggcatgagccaccgtgtccggccacaaactgaataatttctaatgatctgtcttcaacttctggctctttcttctgttatcaccattctgctattgcatcaatccaggatattttctattttagataaagtactatccacataacagaaatttcaacaaatttctgcaggggtatggttcacataagataacattttaggaaacaagcatctaccaatctagttacaacctaagaaataagtggatgaacttactacttaatcaaaagtggacctaattttacctactacttaactatcagacaggcccttggctccaatatattggtctttctaataatcttcagggaagtaccctgaggacaacataccaaacagcagaatatatagtacctattcccaaagaatcttagtacctattcccaaagaatacttaaacccaaaaaagaaaaataaaggaaaaaacagaaaaacagtgaagaacttaatgaagacgtaccaattaaagacagagggaagagtgctctcaggctccttaccctcagctatctgtttgtcccactctattctaaatagacatttggtcttctaatacttaatttattaatacgaatactactctcttcaacccacaatggagcctgaaattattgatcttatgaatttagagcctacaacagaaccaatttcaaacagaaattctggaaaaataaagataaataactctaatgctttctgaggatgacttaaggaggaaaaaaataacagggcatataaaaacattccacagttcaaaagaaatggacccactggagaagtatgaataaattatatggggaaaaagttggatataaaagagaaaaaccatgggaaatatatctaactcatattcttagtgagatttgaggggatgtggcatttttttaaaaaagaatgactttggaatagcaaagaaaattttcagataaagatataattaccaaattttaaaatataatgagagaagaaaggataatgtcaaaaattctaaactgacttcaatgccagctcaaaaaaaatcctaaaaatgacaggaaaggttagagaggtcaatttgacaggggagaagacagaggcaaacagaggatggatccaaaaaatataatacacacataataggaaggctaagagagaactggcagactgacagaaaagggagaaaataaatagcagacaaacattctctaagtaaaacagatttaaaattttagaatcaaagggttcattagtaacataacaaatcagtaaagaaaaaacacagaccgtatcttgaatattttctttttcctcaaaatattaaaaacatctacatatccagacagttgaaacagattctctaaaagagaaagagaaaaagcaatctcagaggcagagcaagatggtgcaatagaaagctccaccaatcgtccccccgaggacaaaaaagttaacaactatctacacagaaaaaaacaccttcataagaaccaaaaatcaggggagcactcacaggacttggtttgaacttcatatcactgaaagaagcacagaagagattaaaagtaacagtcctgaatcaccaatgccacccttttcctcagagtggtgactcctcttccagcagcagtgcatggtatggagggtatctctgggcactggggaagggagaacactgcaattgtgaggcactgaactctgtgctgtcctgttagagcagaaaggaaaaccggaccgaactcagctgatgcccacccacagggggagcatttaaaccagccctagccagaaaggaatcccagaggtccaaacttgagtccctggaaaacctcgccaccgagggctacagcactgtgtgtctccaagtaaacttgaaagacagtctaggccataagaactgcaactctttggcaagtcctacggctgaactaggcctagagacaatggagggagcacgcaacatactgagataccacctggggcagccaagggagtgctgacattatctctcctaaccccaggttgcacagctggtggctccaaaagagacccctcccttccacttgaggagaggagagggaagagtggggaggactttgtcttgcatcttggataccagctcagccacagcaggatagggcaccggtcagagtcatgaggcccccattccaggacctaactactcccagacgacattcctagacacaccctcgtccagaagggaacttgctgccttgaaggaaaggtctgaggcttggcagcattcataatctgctaactgaagagcccttgggccctgaataaccagcagcaatatccaggtactacattgagggccttggtgaaccactgagacttgttggcttcaggtgagactcagcacattcccagctgtggtggctatggggcaaaactcctgcttgagaacagcaggggggaaagtaaaaggggctctgccttgccccctaggtaccagtacagccacagcagggtagagcaccaagtgggctcttagcgtcttcaattctaggacttggctcttggacagcatttctggacatgtcctgggccagaagggagcccactgtcctgaagggtgagtcccaggccaagcagcattcatgaaaagtactgccagagttcccccgatagcttttcatgaatgctgacttaagagaccttgggcgttaagggactatgggggtactctggcagtactctttgtggcctggggtggtggtggctacaggttgaggctcctctgccttcagaaaggggaggaagagtgggaagcattgcaccttgtggtttgagtgccagctcggctgcaatacaacagaacactaggtagacttctaaggtttctgactctagtccctgactcccagggctcctagacagaacttcttgacccatccggggcctgggggagctcgccacccttaagggaaggacacaggcctggttggctttgctacctgctgactgtagagccccagggccttgagcaaacatggcaatagccaagaagcggttacagcaggccttgtgcaagacccagtcctgtgctggcttcaggtctgacccagcacatagtaccagtggccacacgggtgcttgtgtcaccattctcagctttatctggctcaaaacagagaagagagagactctgtatgtttggaagaaagtaaggaaagagaacaagagtctctgcccggtaatccagataattctcctagatctgttctaagaccatctaggcagtacctctatgagtctgcaagaaccacagtgttactgagcttggggtgccccctaaagccaatatagcttagatcacaacacccacgttctttcaaatatctggaaagacttcccaagaaggatggccaaaaatatgccaaggcagtgaagactacaataaatacctaactcttcaatgcccagacaccaaagaacatctacttgcaccaacctctatgaggctgcaaaaaccacagcattattgggcttggggcccaagttcctatgaatactagaaagccttcccaagaaagataagcataaacaagcccaggcagtgatgactacaataaatacctaacgctccaatgcccaaaaactgatgaacatctacaaacatcaagaccatccaggaaaatacgacctcaccaatcaaactaaataaggcaccaagcaccaattctggaaaaagagaaatatgtgacctttcagatacagaattcaaaatagctgtcttgagaaaactcaaagaaattcaagatcagagaaggaattaagaattctatcagataggccaggcgcggtggctcacgcctgtaatcccagcactttgggaggctgaggtagacggatcatgaagtcaggagatcgagaccatcctagctaacacagtgaaaccccatctctactaaaaaatataaaaaattagccgggcatggtggtgggcacctgtagtcccaactacttgggagggtgaggcaggagaatggcatgaacccgggaggcggagcttgcagatcatgccactgcactccagcctgggcgacagagcaagactccacctcaaaaaaaaaaaaaaaagaattctatcagataaatttaacaaagagattgaaacagttaaaaagaatcaatcagaaattctagagttaaaaaatgcagttgatatactgaagaatgcatcagagtctcttatcagcagaattgatcaagcagaagaaagaattcatgagcttgaagacaggctctttggaaatacacggtcagaggagaccaaagaaaaaagaataaagaagaatgaagcatgcctaaaagatctagaaaacagcctcaaaagggcaaatttaagagttattgtccttaaagggaaggtagagaaatcgatggcggtagaaagtttattcaaagggataatatcagagaacttcccaaacctagagaaagatatcaacattcaagtacaagaaggttatagaacatcaagcagatttaagctaaagaagcctacctcgagacatttaataatcagactcccaaaggtcaaggatagagaaaggatcctaaaagcagcaagagaaaaagaacaaataacatacaacggagctccaatatggtggcagtagacttttcagtggaaacaggtaaggtttcctaacatatttaaaagtgctgaagaaaagtaactttcacctcagaatagtatatccagtgaaaatatccttcaaacatgaagaaataaactttcccaaacaaaagctgagggatttcatcaatgccagacctgtcctacaagaaatgctaaagggagtacttcaatcagaaagaaaatgacattaatgagcaataaataatcacctgaaggtacaaaactaactggtaatagtaagtacacagaaaaacatagaatattataaaactgtagctgtgatgtataaactattcttatcctgagtagaaaaactaaatgatgaaccaatcaaaaatggtaactacaagttttcaggacatggtacaataagatataaacagaaacaacaaaaggttaaaaagtgaggagacgaagttaaagcacggagtttttattagttttctttttgcttgtttgtttatgcaaatagtgttaaattactatcaggttaaaataatggattataagatagtatttgcaagcctcatggtaacctcaaaccaaaaacatacaagatatatagaaaaagtaaaaaacaaaaaactaaatcatattaccagagaaaatcccttcactagaagacaggaaggaaagaaagaaggaagagaaaaccataaaataactagaaaacaaataacaaaatagcaggagtaagtccttacttatcaataataacatttaacataaatggactaaactcgccaatcagaaaaacagagtggccgaatggatgaaaaaacaaaacccattgatctgttgcccacaaaaaaacacactgtacccataaaaacatatatcagctgaaaacaaaggtatggaaaatgacattccatcccaatggaaatgaaaaaagagcaggagttgctatacaataccaaacaaaataagacttcaagacaaaaactataagaagagacaaagaaggtcactatatgataaaggagtcaattcagcaagaggatataacaattttaaatatatatgtaccctacactggagcacccagatatataaagcaaatattattagagctaaagagagagacaggcccaaatgcaataacagctaggagacttcaacattccactttcagcatcagacagatcttccaacagaaaatcaagaaacaccacacttaatctgcactatagacaaaaatgaatctaatacatatttacagaaccttttatccaagagctgcaaaatatacattcttttcctcaacacataaatctttctcaaggatggaccatatgttaggtcacaaaacaagtcttaaaagcgttcaaaaaattgaaataattgcatcttctctaatcacaatagaataaaactagaaattaataacaaaaggaattttggaaactatacaaacacatggaaattaaacaatatgctcctgaatgaccagtgggtcaatgaagtaattaagaaagaaactgaaaaatctaagagggaatttcatagctataagtgtctacatcaaaaaagaagaaaaacttcaaaagcacaatctaacgatgcatcttaaggaactagaaaagcaggagtgaacaaaacacaaaattagtagaagaaaagaaataatagagaccagagaagaaataaatgaaattgaaatgaaaaaatacaaaagatcaatgaaacaaaaagctttttttgaaaagttaaacaaaattgacaaaccatcagccagactaagaaaaaaaagagaaaaatccaaataaataaaatcagaaatgaaaaagaagatattacaactgatgctacagaaattcaaaggatcattagtggctactatgagcacccatatatgccaataaattggaaaatctagaagaaatggacaaattcctagatacatacaacctatcaagattgaatcaggaagaaatccaaaacttgaacagaccccaatatcaaatcacaagatgaaagctgtaataaaaagtctcccactgaagaaaagcccaggacccgatagcttaactgctaaattctaccaaacatttaaagaagaattaatatcaatcctactcaaactgttctgaaaaacagagcagggaatacttccaaactcattctacaaggccagtattaccctgataccaaaaccagacaaagacacatcaaggaaaaagaaaatgacaccccaatatctctaatgaatattgatgcaaaaatcctcaacaaaatgctagaaagctgagttcaacaatacatcagaaagatcactcatcatgaccaagtgggatttatccctgggatgcaaggatgcttcaacatacacaaatcaatcaatgtgatacatcatgtcaacaaaatgggcaataaaaaccatatgatcatttcaattgatgctgaagaaccgtttgataaaatccaacatcctttcatgataaaaaccctcaaaaaactgggaatagaaggaacatacatcaacataataaaaactatatatgacaaacctcacagctagtatcattctgaatgggaaaaaactgaaagtctttcctataagctctggaacacgacaaggttgcccactgtcatctctgttattcaacataccactggaagtcctagctagagcaatcagacaagagaaagacataaagggtctccaactggaaaggaagaaattaaagtatccttgtttgcagatgatacaatcttatattggggaaaacctaaagactccaccacaaaactattagaactgataaacaaattaagtaaagttgcaggatacaaaatcaacataccaaaatcaggagcatttctatatgccaacagtgaacaaggtgaaaaagaaattttaaaagtaatcccatttacactagccacacacaaaattaaatacccaggaattaacttaaccaaagaagtgaactatctctatagtgaaaactataaaacactgaagaaggaaattgaaaaggacaccaaaaaatggaaaaatattctgtgttcatggcctggaaggctcaatattgttaaaatgtccctactacccaaaacaatctacagattcaatgcaatgcctatcaaaataccaaagacattcttcatagaaatagaaaaagaaatcctaaaatttatatggaaccacaaaagatccagaatagccaaagttatattaagcaaaaagaacaaaactggaggaatcacattacctgacttcaaattatactacaaagctatagtaaccaaacagcatgtactggcataaaaacagacacacagaggaatggaacagaatagagaacccagaaacaaatccacacacctacagagaactgagaaagatgcgaagagcatacactgaggaaaagacagtctctaataaatggtgctaggaaaactggatatccatatgcaggaaaacaaaattagatccctatctctcagcatatacaaatataaaatcaaaatggattaaagacttaaatctaagacctccaaccatgaaactactacaacaaaacattggggaaaatctccaggacattggtctgggcaaagatttcttgagtaataccccacaagcacaggcaaccaaagcacaaacagacaaatcggatcacatcaagttaaaaagcttctacacagcaaaggacacgatcaacaaagtgaagagacaactcatagaatgggagaaaatatttgcaaactatccatctcacaagagatttaaaaccagaatatatcaggaactcaaacaattctataggaaaaagtctaataatctaaaaatgggcaagatttgatcaaatgataaaaagggggcaaaagatttgaaaagacgttactcaaaagaagacatgcaattggcaaacaggcatattaaaagatgctgaacatcactgatcatcaaagaaatgcaaatctaaactataatgagttatcatctcaccccagttaaaatggcttatacccaaaagaaagacaggcaacaacaaatgctggtgaggatgtggagaaaagggaacccctgcacactgttggtgggaatataaattagtacaaccactatggaaaacagtttagaggttcctcaaaaagaaactagtaattgagctaccacatgacccagcaatcccactgctgggtacaacccaaaagaaagaaaatcaggagtgcaaagagacatccgcactccaatgctcgctgcagcactgttgccaaaagctaagatttggaagcaacctaagtgtccaccaacagacaaatggataaagaaaatgtggggcaaatacacaatggagtactattcagtcataaaaaacaatgggatccagtcatttgcaacaacatgggtggaaatgaagatcttgttaagtgaaataaaccaggcacagaaagacaaacatctggccgggcacggtggctcatgcctgtaatcccagcactttgagaggccaaggcggacggatcatgagatcaggagatcgagaccatcctggctaacacggtgaaaccccatctctattaaaaatacaaaaaaatacaaaaaaattagccaggcatgatggcaggtgcctgtagtcccagctacttgggaggctgaggcaggagaatggtgtgaacccaggaggtggagcttgcagtgagctgagatcgtgccactgcactccagactggtgacagagcaagactccatctcaaaaaaaaaaaaaagaaagaaagaaagacaaacatttcatgttctcacttacttgtggggtctaaaaatcaaaacaactgaacttatggacatagagagtagaaggatggttaccagaggctgagaagggaagtgggggatacaggggaggtggagtggttaatgggtacaaacataacagaatgaatgaataagaccttctatttgacaggaaaatagggtgaccacaatcaacaataatgtaattgtacattttaaaataacttaaagagtgtaattgaattgtttgtaactcagaaggaaaaaggtataaggagatggatatcccattccccatgatgtgcttatttcacatgcacacctgtattaaaacatctcatgtacccccaaaatacatacacctactatgtgcccactaaaattaaaaatacatatatatggccgggtgcagtggctcacgcctgtaatcccagcactttgggaggccaaggtgggcggattacttgacggtaggagttggagaccagcctggccaaaatggtgaaaccccaactctactaaaaatacaaataaattggctgggtgtggtggtgggcgcctgtaatcccagctattcaggaggctgaggcaggaggatcacttggacccgggaggcagaggttgcagtgaactgagattgtgccattgcactccagcctgggcaacagagcaagactccatctcaaaaaaacaaaaaacaaaaaaaaattaataataaaattaaaagaaataaaaattaaatgttttttaaaaaagcaatctcattgtcatcacatcacatttctgctctgtacagctaaagccagacaaaatcaagaatgaaatctacaaaaatctaaggaaaagaaaacattgcaacccaacaatactattcttaagtaatctattttcccatggaaaaaaaaatagaaacctgttccgacaggcaaggactttgaaagaatgccatctacattctcttcctaaatgaaatgcccccatcacctgaaaataaaccaaaactctaaagaatgaggaggggccgggcgtggtggctcatgcctgtatttccatcactttgggaggccgaggagggcagatcaccagaggtcagatcaccagaggtcaggagttcaagactagcatgatgaaacccccgtctcgactaaaagtacaaaaattagcggggcatggtgacacatgcctgtaatcccagctacttgggaggctgaggcagaagaattgcttgaacccagaaggcggaggttgcagtgagctgagatcacaccactgcactccagcctgggccacggagcgagactccatctcaaaaataaaaaatagaaaataaaaaaagaatgaggaggaatgtaagtttaaaaaaaaaagtgaaagcataatgagtgggacagcgctcatgcctacacaactatttttaatagggttcataatatttaaaataaatgtccaaaatgatttttgaaagacaagctcccaatttctcgctttccccctagctgctggcaaccaccattccactttttgtctctatgagtttgattattctaggtacctgataaaagtggaatcatacaattttttgtgtgtgtgtgtctggcttatttgactcagcataatgacttaagtaaggttcatccatgttgtagcatgcatcagaattccattccttcttaaagctgaataacattccattgcacagatgtaccacattcgtttattcatccactgatgagcacatgggttgtttccacctattggcttctataaataatgctgctacgaacactgatgtagaaatatctgttcaagtatctcctttcaactgttgtctgtatatacccaaaaggagaatggtggattatgtgataattccatttttagttttttaaggaaccaccatactgttttccacagtaactgtaccattttacattcccaccagcaatgcataagagttcttatttctctaccctcaccaacacttacaattttgttttcttgataataaccatcctaatggtgtaaagtgatcttactatggttttgatttccattttcctaataattagtgatgctgcacatctttctctgtaattatttgccatctatatatcttctctggagaaatgtctattccagtcttctacccattttttcatttggtcggtttttgttgttgttgttttgttttgtttttgagacagagtttcactcttgtcacccaggctgcagtgcaatggcacgacctcggctcactgcaatctctgcctttcgggttcaagcaattctccttcctcagtctctcaagtagctgggattacaggcgcccgccaccacgcctggctaatttttgtatttttagaagagacgaggtttcactgtgttgaccaggctggtctcgaactcctgacctcacgtgatctgcccacctcggcctcccaaagtgctgggattacaggcatgagccaccggttgttgttttttgagacgcggtctcactctgccacccaagctggagtgcagtggcatgatcttggctcgctgcaacctctgcctcctgggttcaagcaattctcctgcctcagcctcccgagcagctgggattacaggcacccaccaccacacctggctaatttttgtatttttagtagagacgagatttgtctttttagtagagaccaccgtgttggccaggcttgtctcaaactcctgacctcaagtaatccgcccacctcgacctcccaaagtgctgggattacaggcgtgagccaccacacccagccatttggtaggtttttaatggttgagttgtgggagttctttatatattctggatatcaatcctttatcagatatatgatttgcaaatattttcttgtattctatgggttgccttttcactttgttgacagagtcctatgatgcacacaagttttaattttgataaaatccaaataatctactttttttttactgttcttgttttagtgttgtatctaagaatcctatgccaaatccaatgtcatgaagctttttctctatgctttcttctaagagttttatagttttagctcttacatttaggtctttgatccattttggtttatttttatttatggtgtgatacagaaagaaatccaacaccattttcttgcatatatatataatccagtttccccaacattatttgttgaaaagactgtcctttcccaattgattgatctggcaccattaccaaaaatcatttgaccatttacgtcagggttgatttctgagctccctattgtgttccattggtctatacgttgtccgtctttattccagtaccacaatgtcttcactactatgctttgtcataggttttgaaatcaggaagtatgagacattcaattttgttcttttttttttttttgagacagggttttgagatggggtctcgctctgttgcccaggctggagtgcagtggcatgaacacagctcactccaagcgataccacaacctcagcctcccaagcagctgggaccacaggcacaggtagtaatttttttcttattattagttttgtggagacaaggtcttgccatgtagtctaggctggtctaaaactcctgggctcaaatgatcctcctgcctcagcttcccaaagtgctgggattacaagcgtgagccactgtgcccagccaattttgctctttttcaaggttgttttggctattcagggactcatgggattctatataaattttaggatgaatttttttctatttttgccatgcacatcattggcattttgataggaattgcattgaatatacagatcattttgacatcttaacaatattagtcttccaacccagaaacatagatgtctttccatttatttgtgtcttctttaatttttctcagtaatgtttcagtgtacaagtctttcatctccttggttaagcttattcctgaatattttattctttttgatgctattataaatgaatatttgtttaattttattttcaaattgttcattgttaatgtgtagaaatgcaagtcattttggtgtgttgcttttctatcctgcaactttggtaaacttgcgtattggttctaacagttttttgtggaatctttagggttttctacatataagatgatgtgaataaaaataattttacttcttccttttccatttggatgtcttttatttctttttcttgcatgattgttctggctaaaatttccaatactgtgttgcacagaagtggtaaaagcaagcatccttgtttctgaccttggagtaaaagatttcagtctttcactactgagtgtgatgctagttttgggttttccacacctgctctttaacagataggttgaggtagtttcctcctattcctagtttgttgagtacttttatcatcaaagtgtattaaattttgtcaaatctttctccgaataaattgagatgattgtgagggatttttccctttccttctgttaatgtggtatattacaatgactgaattttgtgttatttttaaattacagtcgtgccacgttttggtcaaggagggaccacatatataatcttattgtaagattataatactgtatctttactgtaactttctatgtttagatacgtttagatacacaaatacttaccattgtgttacaactgcctacagtattcagtacagtaacatgctgtacagatttatagcctaggaagaatagactatgccatatagcctaagtgtgtagtaagcttgtgtaagtatactaggttgtgtaagtactctatgaggttcacaccaacaaactgcctaaggatgcatttctcagaaagcatccctgtcattcagcgatgcatgactctaagtgatgcatgactgtattgaataataatctagatccaaaaattcacataatttttaaacccagttttttgaaaaaggatgaaattatgtttaatttttaatttccactggtcattcttcaaagcaataaagatgagataaaagttcagaattttgaatttacagaaaactgctagttaattcacaggtaacaaaaacagagagaaaaggtttcaaagggtttcagacccaacagtaactcttaagaatcaacagtcaagaataaatggagatacagaaagttaactgacccttattttgtattccagagactacattggagcaaagctgatagaaaacccactaaagttctataggtgtcacatcaccagtaaaacctcaggcctgataaccaggaattcatcctgatgcacactaatactgcagaaaaatcttggtcttttaaacaatttccaacccaataattttttaaaagatgcaagcaacagccccaagttgaatcctttaaagcatacatagaaccaaagcattgttattgaaggaagaaagggaaagaacaagggataaacagtccgtctggaaagatttatacaaaactatttattacagtcattaactcaaaacagtataccacctgactcagctaattttcctgttttgacaaaaattttaagcatcatagatcaattgtaatttttccagttggcttattaaaatttctttccatggtttctgcttgcattcctgcagggcatagacctgcactaccatgcaaagtagggactgcccttatttatttctttaaactatggctcttacatcccattaaggtaatttatttcactaaatccctggatactatttaaaatttctgtcaaagcattaataactcttttactgtcagttataaatttataggaaagtgaaaaaataataaaaatcaatatttagtatactataacttaaaacgttggaaaaattgaaaattaacttggccaggcacattggctcacacctataatcccagcactttgaaaggctgaggtgggaagatcaagtaaaaccaagagttctacaccagcctgggcaatatagcaagaccctgtctctacaaaaaataaaaataaaaaaattagctgggcatagtggtacacatctgtagtccctgctactcagaaggctgaggtgggaggatcgcttgggctcaggagttcaaagctgcaatgtgttacaactgcacaactgtactccagcctggacaacagagcaagaccctgtctctaaaaaaacaaaaaaaaaggcaaagaaaatgaacttatcaagagtggtttgaacagaacttgttctcttatcagtgtttaactcatgatactgaggaagaatctttcgtattcctcagtaaattatcatgctcctttctaagtctggatcagcttccaacattttaccctttgcattttcaatgttctcaactatctcctagagttcctttaatgaatgtgaggtcttctgacagcatcacttcctctgagacagcttcatgctcttcaacaaaatcactttcatcatttatgttggttgaaaatctcaccttaccaagttcctccagctataaattcagtctcttaaaaacgtgtaatgtcagtagttccacagccagctacttctgtataacttcatttatattctacctgattttcattacatgttatcacttttcatttctttgctgtattttcactttgttgggcaaatgcctctttcaattattcatttctgtaaaatgtcacatgtgtttcttactgggagacaaagaggcaacacaactacatgctttgttgtctgtgcataaactgagtaacagatgcacagtgaccaatcactgacagattttgaaagaagtgacatgattgatcatggatcatgatacatgtttgtaatttacaagttatttgtagaatgaagagctagcagtcaagtttgtacattatccaagtacacaattaatacaccatggtaaatgaaatttgaaccatattgttaggggattggtgtcacttaactaaactgtagtaactgaaattcatatgtataaaagccatgcaaagcaagaactgcctgcccataaatactcctatgtatagagcataacattaacaaatcaaaaatttacaatggaatcctcaaaattgcccctatactgccaaatgacataaacatgaaagcaaggatcaagtcacttacagatgtcctacagatacaattagtacttgactttaatatatttgattttcataccacctcactttttaacagagcatgctgatacctgttatttggactttaatatatcaagaaaggaaaagagatctgaagctctcatacgatggcactgcctgctggaaaacagtattgttttagttgtgtcatcgccttattacagtagtttatttaagcaattatgcaaatgtattcaattttgaccttattatataaaattaagtggaaaatagaatcagcaatggtggtgataaaaaggatagtgttaataagaaaaatcagttttatgaatttgattccagtgaaacaaaagcaaaactcctgagcatcagatagtcagtggaattaagcaagttttttctctgtgaatgtggaaaatcaaatgagtacgtacagagagtgcaacataaattgcaaaactattttactaaagatggtatatacaactagaaccctggaaaaataaaaaattaaaattaaaacattaaaaataattaaggaactatattatatctttaattctctggcaatagaatcctcataacttattaatcaattgtttatgttttgctttacagctgaacactggtgaatgctcttatatttaataatatttattagaagttctaggcttctaaactgaataaagtgtttctattggtagtaagagaatttaaaaaacagatgaaagtatgctcagaacatttaggctgtgaaaggacaaaaaaaatcattctttagtatccctctgtgtaggaagtcaaaatagcttgtatatcatcttattttgtcttcaaaatgactaactacctcattctcatagtagaaataccttgaaattagatacagggaaattaaaacagagaaaagataaaattaaaacctaagtttcttgatttttgacacttcaataatgtacttttttctttaacatttttggacaggaaattctaagttaatattaagggcaaacagaatattagacttggtatttaacgtatttttatatatatatataataatatgatcactgcttgtccatttttccaaaattgaagtaaatgagtattttacctaccccaacaatccgcttcatagcatccagtttagcagaatctttgttgctctctaacatttgctttagatcttcattcctattacaaaagagaagaaaaaaaatccatactttgatttttatattagatagcttaaaatatatcattttcataagaattagaagtaatatcatgggcaatgttaaataactgcagcaagaaggtggccatctgcaggccagagagaaaggcctcagcagaaaccaaacccgccaacaccttgatcttgtactcccaggcattaattgtgaaaaaattaatttctgctgattaagccacccagtctgtggcattttgttatggcagctctagcaaactaatacaagggttaaatgttacaaactgtcattgcaagaaaaaaataagtaaaagctaagcacatttttttcaaaaggaataaatgcaatgaaatttattatgaaaaaaatgagccttactttccaaacagctcataaaattaaatgcaatggtgaccagtagagaagacaaaatacaattaaataattaaaacacctacttcttcctaattaaaaatacagcttgaaaatatttaaacagtagaggtagtaataaataaaaactgtctctgagaacatacaactactacacatactataaatgttcaccttaaggaatttaggatccctgcataaaacttttcaggctctttcagatttcacaggtaacagaaaagggagagaaattaatggaactatatatgtaactgtattttgttcttctactttttgctgtattttcctatttacttaatgactatgtatacttttataatgaaaaacctaaaccctaaaagaaaccttaaaaaaatcttactgaagttaggtaagaaaaaaaaagaattcgataggaactaaatagaaaggaaatgtggtcacacatacacacatgccaaaaaagaaaacaattttctcctgcttgttccccttttctgttccccaaagtgtcccattattctcctctaccagttttatctggagagagaagtgagcaatgaagaggaatgaagtgtcaatttttagaacagcccaacctctaattccaggcatagtcttactcgtaaactaatggaaacttggtttgctcatctaaagcccaaattcccagagtgcccagaacaagcacctgctctctgaaactaaaaacaagaaaacagaatctcaatattaaagataaaggttttgctcttcatggttaacagaaaagctagtcttcaacaacaaatactgcattaatataggaagagaaactaataattctgaggttcagggaagagacaagaaaaatcctaggcactgtttcaacctgatgtaatatgcagcttctcacgtatgtcataaggatctatttaaaattctgatataaattacatgtttcttcccaaattcttctttgcctgtcaccaaaacagtaaagatttaggaaagttaataccataacacctactttaccctcaaaatacattaacttttattaagttcttttaggtctaccttcttcattacgtagattcaaatatgatcagttaacatgtattactgcataaatcttagatactattttgttaaatatcaatatttgagtcaaaataatgctgaattagcaatattttcctcaactctttgctgaaaacaatagttgtttcaaatatattcatttttaatttacctgtgtcttcatttacctagttacctgtagctttctagctttgagtattaggataccaactttatttttacataagtgacatcttgtggtgttaaatggtataacttttcctttcatgttcaaaataggccagttttaagtttcaaaggacagagaagaatatataactgaacatttaaggcaaatcttactattaccaggaaagtcattcttattttagccccagaatgaactagtaactataactgaaaaataaagtttaccagttatatataagaactagggatgtgttagggctattatgtagtgtaaattacctctctttttaatcaatctataatccataactcattaaaaccttctactccttctaaagacaacataaattaaggggaaaattaagactatgtagtactgtacactatatcagtgctacttaaagtatgatctgagaaagtctggtccaagaatcatgactaattcacaaatttttgttaccaacccatgaggagataggtaccaaaattcagaataagcacattgagaaccgtgacggaacaatttgacaatgtaattttatgtttattgagtctaatttaaaaagtggggcttgtattttattttgtgtgcctttttcattttatttttctttaattttattatgtttttgtttgtttgttctttcttttgagacagagtctcactctgtcacccaggctggaatgcagtagtgtgatctccgctcacgcaacctccgcctcctggattcaagtgattctcctgcctcagcctcctgagtagctgggattacaggagtgcatcaccacacccagctaattttgtattttaagtagagatggggtttcatcatgttggccaggctggtctcgaactcctgacctcaggtgatccaccaacctcggcctcccaaagtgctatgattacagaaatgagccaccacgcctggcccattttatttttctagtaatttattttttattgtattttgtagaagtatccatcaatattggactggaaattttaaaaagaaaaaagaaaggacttttaccatttgagagccccacactacaaagttaccttctttttcctcaaaattatggtacaccaaaatttatataccatagaaagcaacacctaaaacttacatccaggaaatcatggactggaaaagtgataaggaatagcaatttccaatcagagatacatgcccaaaaaaggatgtataaaaatattcaacgaagggaaggctggacctttatggagccctaccaaaaaattccaaaacacaggcacctctttaggcatagagaaccactccaataaaagatgctactatccaagtggtgcgctgcaaatatgaatggatatgcagaaaaaacgctggaaacagagtcagaacttaccatttcccagtgctatgtagccaaagggagtggccctcataataataatgtttttgtgcaaaacattaaggcttaggaacattttcagttcacttaggatctaagcttcccttgcagagtgctcagaactttggctctttctgttgacatctgatacccatgaccactactctttcatcttgaaattccctcctccttttgattctgtagctctattctcatctggttctccattcgcatttgtgacacagcaatgaacaaaaatgacagaaaaacccttgccctcatagggatttcattctattaagtaaaagaaacaacaaacataataagtaagaaatttttaagtcatgaggtaatataggggaaaaacttttggcacaaagcctccacttaataaatgcaacagtgaatagaaacaaaaaactccattgctagtgtctttacctgctcacccatctattaactttctaggcagggcacagtggctcaagcctgtaatcccagcactttgggaggctgaggcgagaggatcacctgaggtcgggagtttgagaccagcctgaccaacacgaagaaaccccatctctactaaaaatacaaaattagcctggcatggtggcacatgcctgtaatcccagctattcaggaggctgaggcaggataattgcttgaatctgggaggtggaggttgcagtgagccgagatggcaccattgcactccagcctgggcaacaagagtgaaactccatctcaaaaaacaaaaaacaaacaaactttctaaaagtcagaatcataaattatccaaataaatatgaatattcctcctatactgttcacaagattaaaaagaaaaaagcctacagacccttcctcaactcttggtaatctcatttacctttaatttaaaatgtctctcacacagggtaacaaacaacgtcttaatttaaaaatccaaggtaaaatctcatgaatagtttcagattattcctctgtacttgtgaggactaaactctgacttttctctctcttgcccaaattcctaaggggcctgaggagtcctgccctacaaaccataaattctcatcagatggattttaatttaaccctacgtaacgtggcttactttccaacctgactatagcataacgtcacatgacatataaagaaggcaatcaaaatattttaccccaaaatatgcttctttgccatatttttgaaccggccctgcaaagcagccttttgtggaagaaaatctgcatctgtaaaggatctctacagagtttccccttccaggctctaacaattctaaagagattaactgagagtccagcacttttaaagatttgaataggaaacatttgccatctattgtctctaaaggcagccacctaagagacttcataagaatcttggtttctacagccctttatcctaacccagccacacctttctcttgatcccaggtttttcaataacaacttaactctttcaagtaattgccaatcagaaaatctttaaatccacctgtaacctgtaagccccctgcttcaagctgtcatgcctttcccaactgagccaatgtatacctcacatgtactaactgatgtcttacgctccttaaaaatataaaatcaagttgtaacccaaccaccttgggcacaggttctcaggatctcttgaggtcatggtcactcatatgtggctcagaataaacctcttcaattattttacaaagtttggctctttctgttgacatctgatacatatgaccattactcttccatcttgaaattccctcctcctttagattctgaagctctattctcatctggttctccattcgcatctgtgacacagcaatgaacaaaagtgataggaaaaacccttgccctcatagggatttcattctattaagtaaaagaaacaacaaacataataaataagacatttttaagtcgtaaggtgatatgggggaaaaaaacagaggaaaaggatacagaaaggaaagaaggaggcaattttaatagcacagtttgagtaaattttaaaagtgacatctgaacaaagattttcaaataagagagttagttatgcagatatcatggggagcaaagggggacagggaggataagcaggtcaaataactctaaaagtttttggtgttaactctgaataaataaagaactgcaggttttgaacacaggagagtcatgatctatttaacaggatcattctggctgctacattcagaatatactgtagggacttccatatctgtccatgacactgtagcttacaaaaaactaaacctgccatagaaaataactataaaagctgaaatacatacatatacacacatatatgtatgcatatacatatacacacacacaagtactcttaaggggccatgatccttgaaagaagagaagcacaaaaagtgagcccctaggccaggacagtggctcacacctattaatataatcccagcagtttgggaggccgaggctagtggatagcttgacctcaggagtttgagaccagcctgggcaacatggtgagactccatctttactaaaaatacaaaaagtagccaggtgtggtgacatgcgcctgtaatcccagctgctcagagacacggtgggagaatcttgagcacaagagggtaagactgcaatgaaccatgatgatgccactgcactgtggcctgggtgacagagtaagaacctatctctctcaagggaaaaaaagagctcctcattcacaccagctttttccctcagtacatttcccaaattgccatgtgggagaacagaacccaaggagaagtcacagtcttaataacttgaggagacaaatgttgaattccagggctgccacagtgactgagacttgaaggacaaaattacagaggagggaaccagagacaaggtacacaaaaatctgtgtgcaaaatgttggctgcaattcctaaggcaagactccaggaaacacaacaaaaaacagcagctgtcaagtctgtcctcagaagagaggctttggtgaatgccctggactttccattaagattactgaagagccacacagagtgctaaggaagatgcccgaggagtataagaaaaagttccataaacaagaccttaaaaagtctaaaactgagctttgacaagatcagaatgatctgcttacattctatttgcttggctggaaaaaaaaacaaaaacaaaaacccagccctgtatggaagaagctatcacccaaagcttcatcaatcatttttatcctaaatacctagcatctgatcaaaacttacgagacatactaaaaacaggatgaaattacccccgcccaaaaaagaaaaaaaggaaaaaaaaaaaaaaaaaaaccaggagcagatccatgagtgactcagataccagagttatcacacagggattttaaaataattacaattaacatggtcaggaaaatgtagaagagatggacaaaacagatgaaacaacacagaaatcaacaattagtagaatccatacaaaacaaccaaatggacattcagaactgaaaagtatagtatatgaaattaagaactcattagataggtttaatggcagactggaaatgggagaaaaaaaggattatcgaacttgaaggcaggtcaagagaaaatatacaaattgaagcacagagaaataaaagaatggaaaaaatagaacagagcatcagaggcatatgagataaaggtaaaatttctaacatacctctaattagagttccaaagagaaaagagagtatgaaacaaaagcagtatttgaagagataatggttaagaattgttctgaacctatgaaaaacataaacccacatatttaaaaatcttagaaaaaaaggacaaacataaaactacaccaggtacagcatagtcaaactgctgaaaacaagaaacaatgagaaaaatcttaaaagcatccagaggctgagcatggtgaatcatgcctataatcaagcactttgggaggccaatgcaagaggattgcttaaggccaggagttcaagaccagcctgggcacaacatagtgaggcccagtctctacaaaaaatatttttaaaaaattagctgggcatgatagtgtgcacctataatcctagctactcagaaggctgaggcaagaggattgtttgagcccaggagttcaaggctgcagtgagctatgattacaccactgcactcagcctgggtgagaccctatcttttttttaaaaaaaaaggcatccagaaaattaccttgagacaggagtcaacaaacgtaaagggccagaaagtaaatattttaagttttaccagccataccatctctgatgtaactagtcaactctgctattgcacaatgaaagcatctatagataatacaaaaacaaatgggcatggttgtgttctaataaaactttatgtacataaacagatgggtggtttgctggtccctaccttaaaaggaataacatttcaacagacattataaaggccaaaagatatcggaatgacatatttaaagggctgaaagagaaaagaatgccaacatagaattccatacccaggatattaaaaatattctttatttcactaaaggtgaaataaagtggttttcaaacaaataaaagctgaagatctgctgcctggacatagggtatcatttcaaaaggaaaataattttacatttatatgcaatttatacagattctaaatttacagtttccatgtgtaaagcaaatgctgacagactcatggaagaaaaacacacatccataatcatgataggcaatttttttttttgggggacagtcttgctctgtcaccaggttggagtgcagtggcgcaatctcagctcactgcaacctccgcctcccgggttcaagcaatttccctgcctcagcctcccaagtagctgggattataggcacgcgccaccacacccagctaattttttgtattttagtagggacagttttcaccatgttggctaagatggtctcgatctcctgacctcgtgatccacccacctcggcctcccaaagtactggataacaggcatgagccactgcccccggccatgattggcaattttaacacacctctcagtaactggcagaaccaggaaacgaaaaattcaataaaggtgtaaaaaattcgaacaacataattaaacaacttaaacttacaagcatagaacaatatatccaacaactgcagaataaacattcttttcaattgtacataggacatttaccaaaatagactatataaggtttcaacaaatttgaaaggtataagaatcagagtatgtggaatctaaatagaaaccaatacttaaaaaataaaataaaaactaaaaagtgctcacataatggtaatttttttttttgagatagggtcttgctctattgcccaggctggagtgcagtagtatgatcacagctcactgcagcctcaaactcctaagctcatgagatcctcccacctcagcctcccaagtagctggggctacaggcatgtgctaccttgcctggctaatgtttttttattttttgtagagatagggtctccctatgttgtccaggctgatcttgaacttttgaactcaagcaatcctcccacctcagtctccaaaaatgctaggattgcaagtgtgagccaccatgccagcctgcaacatactttgtgatttgacaaagtgcaacatttcataacttgtgggatgcagctaaagcaatatttagaagcaaatttaggctgggggaggtgactcatgcctgtaatcccagcattttggtagaccaaggcaggaggatcacttgagctcagcagttcaagaccagcctagacaacataacaaagacactatctccacaaaaaatccaaaaattagttggacttggtggcatacacctacagtcctagttactcaagaggctgaggtgggaggattgcttgagcccaggagttcaagaccagcctgggcaacacggcaagaccctttcaccacaaaaaaaacaaaaaattagtcaggcatggtggcatgcacctttagtcccagctactcaggaggctgaggtaggaggaccacttgagtctgggaagctgaggcggcagtgagccaagatcgcaccatttcacttcaacatgagtgacagagcaagaccctgtccctaaaaaaaaaaaaagaagaagaagcaaatttatatttctaattacaatacaaaatcagaaagattaaaaatcaatgatctaagtttccatctcagaatgctaggaaaaaaaaacagcaaattgaactcaaagtacaagtaataaaataataaagatacaagaagaatttaataaaacagactaacatgttttgcatttatagtatattattaacttatttagctacctggtattattttctgaagcttgtatcttattttagtatcacaaagcctctatgaaacaaaactacaatagagaaaaatcaacagaactaaaagctgatgtctatttcaaataggttgtcatgaagacttaataaaatcataaagcacttatcactgggcctagcacatttatttattcaacatccattatatgccagaagctgctctaagtattgaagtccctgaatattctaggacctaaattttaacaaacaaggaattggtgggagggagtttaaggggaatgacaggaaaaaaaggagaagggagggaagtaaagagggagagagcaaggcagagaaggaagaaagcagggaggaacaaaaacataaagaaagatcagataagtagtacacaaacaattaaaataaggaatgcaataaagtaagactgggtgatcacaaaagacctccacggataagtgatctgaggtctcgaagtacaaggagacaaccaaagaaatcatacaagataacagagcaagaacaagcttggctataaagaatccaaaagaagatctatgaagggcctctaaaggtaggctgaagcaggttacattccttaccggtccataacagatacacaataaacattagttgaaaaaacaaatgaaagcaggctatatactaaacttgtttcttagaaagacacagaagaaccctttcactgtaaagtctcaaaaggatccatgatcccaataaaagttaaaaaccaagcatatatcttccatgtcttcatatcattcatatgcgtattaaaagccatgatgtcatacagacatcacaggacatcttcatatttgccatgatctttatcaatgccctcagctacttggcctcttggtaggcagcaggaagtatgttttacctttgctcaggagattaggaatgtcttctagaatgtgactattcagtagtatatttgttaatgtttccttttattgcttctgagactcccccaatcttaatcttctatacaaagtggcatttttggtttacagtgtttttaaacagtgaaaaggaactttttgcctgttacaaattttatgcatcaccatatataaactaaactatgtcagtggctctatgagatttcctgtaaaacttttttcctacaaatagataaattcacacaggtatgcaaaaacttatgttgaaatattgtttttatgtgatgaaaagtgaaatcaatcaaatgcccctccaaaaggggactaattctttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagggggggggggactaattaattatgaggaactattacacagtggtttaaaacaggggtcctcaacccccaggccacagaacattacccatctgtggcttgttagaaaccaggatgccacacagcaggcaagtggcagatgaggagtattactgcctgagctccgcctcctgtcagatcagtagcggcattagattatcagaggagtgcaaaccctcttgtaaactgtgcatgcgagggatctaggctgcacgctccttatgagaatctaatgcctgatctgaggtggaatagtctcatccccaagccaacccccacccccttccatggaaaaactgtcttccatgaaacaggtccctgggtactgctggtttggcgattgctggtttaaaagattaaaatggtatcatatgttgatatggaaagacatatcaacatatggaaagatcttttaaaatataccaggtggaaagcaagatacatagagaatagtatatatatgatcgtttaatttttttaaaaaatttctgaaaggatacataagaacttgttctttgtagttacacatgaatgggagttatgagatatgggattggaagttatatcctttccacatcattgactaactcaccgctaacatgtcgtgtttataacatattattaacttatttagccacgtggtagtggttttattttctgaagcttataacactgtcttattttagtatcacaaagtctctatgaagcgtgtgtagctattattgttcccatttaatagatgagtaaaccaagtctcagaatatataaaggtaacataagattacatagcatgtgagaaattctaaaatcacatgccttttatgtatatcatcataaaaccagggaatggcaaagcaaggaattaaatttcaatcttgttttgaaattcaacattcttcctattcaccatactacgctgtcaatttctgctataaagctgactatattaagaatatatttcaatggccgggcactgtgactcatgcctgcaatcccaagactttgggatgcggaggcaggaagatcgcttcagcccaggagttcaagaacagcctgggcaacatagggagacctaatctctacaaaagaaaaatatatattttttaacatattatataaaatttatatatattatatattaagtcctatatatgtatatataggtgtgtatatatatataggacttaaatatatataggacttaaatatatatatatatgacttaaatatatatatatgacttaaatatatatatatatatatatattagccaggcatggtggtgtacacctgtgggcccagctactcaggaggctgaagtgggaggatcagaccaggaggttgaggctgcagtgagccgagatcgtgccactgcactccagcctgggcgacagggtgagactctgtctcaaaaaaaaaaaaaaaagaatatatttcaagaactataaagtaataccttataaaaggtataaaatccataacctggagtgtcatccccctccctacttaatctataatcacaagaagaacttttcttttaaactcaaaattttcatgaaaagaaaactgatcactagaatcatagtaaacactgattctaattattctcaatggtagtctaaaacatctgtgatacacttctgtataagtcaaaataaattttattttcactgacattactttgactgtatttggttaacattatctcatgtagattcatcagctcaaaattaattagtattacagaatagtgtattccgtccaaacaattcatctttgttggctcacatggctcactgctattggcatgccacagtaataataggcatggtgccacagtaacagatgggcatacacacaaacatgccaaagaatccgtttgtgcatcaagtttgagtattagtattagatttttctccaagaaattcataaactatagtagaggaaatataagttttctacaactgtgttaataagatatgccaactcaaagctagattaatttttaaattctttaaaaaaacaacaacaacaacaactttccaaggccacagaaggcaagttttccatctgatgagtttggatcagcattctgtaaagggaattcaggaaaccaatatgcaatgtctgcctttgtccctgatgcacttggaaatctcaataaaaaaattagtttttaaaaagtcacagggcagtattgcagatgaaacagttctagacatctgtagcacaacaatgtgaatatagttaacactactgaattgtacactcaaaaatggttaagatagtaaatttaatgttatgtgttttttaccacaattttttaaagtcacatggtcccaccaagtttcctgatgaaggctatgtagaaccagaaacagaaaaaaagtcctacaaatttgtacttgacaggaatagaatctaaaagtgcaaatcacttaagttttatgtgattattttaaagtatgctatcacttaaaaacaattctcggccgggcgcagtggctcgcgcctgtaattccagcactttgggaggccaaggcaggtggatcacctgaggtcagcagctcgagaccatcctgaccaacatggcaaaaccctatctctactaaaagcacaaaattagccgggcatggtggtgcatacctgtaatcccagccactcaagaagctgaggcaggagaatcgcttgaacctaggaagcagagattgcagtgagccaagatcgtgccactgcactccagcctgggcaacaagaccaaaactctgcctcaaaaaaaaaaaaaaaaaaaaaaacagttctcatctatagttaattatcccattataatttatttttaaaagactgactaacttatttccatgtgtagttttacatttttgaaacataaacatatcctattgaccaaactatattgaaactttttttatagttttgctacatgaatgaaaaaccgttttacaatactaagaatgctaagaaaaaaatcatttgcagtcactatcatccaaaattatttaagtaatatacaaagtatcaaaatagatgggactctgtgtgtatgtaggaataggagagaggagaaaatagggatttatttaatgggtgcagagtttcagtggtgcatataaaaagagttctggagagggatggtggtaacgattgcctaacaatatgactatatttaatgccactgaactgcacacttaacaatggttaggttgcttgataccttgtcaaataggggaaaaaatggttaggatgataaagttattcaggtgtattttaccataattaaaaataaaagagaaactactctaaaagaaaaaaaagctcgttagactccatgtctccctgcaataaccatccttcgtcctctacctgaaagccaaagttcttcggagaagtgatcttcttttactcacttctcacccatccaccaatggactgccatcgatttccacactcaacatcccttgacactgctgtcaccaccaccaaggtcaccaacaactgccttatcaccaaactgccttaccattttgcttgattccacaccagcagctggcactgctgaccatttagcccctcctctttttatttctgttaaagcaaaacatacataagcctgccttcttttaggaaaaatgagaaataggctgcttcttcaagaacagcttcaaagccataggatacaaaagaagactgaaaattgaaaaaaaaaaaaagtttaaaacaaatacactttttactcctttgtactataatcattgttcccaaatccttgataatcacacagaagaatcagggcttattaatttcatttatttttatgtggtgcacattaaaggtactttgtattaagctggtgcaaaagtaactgcagtttttgccattaaaagtaaatatatttagttgtttcaaacacttgtgaaatataattcagaaaaactgaagtttgatgaaaatttgaaaattaaaaacataaagcaatggttaatgttaaaattaacaataattctaaaattataatagcttaaaaagtacatcatattaaaaataaaacaggccaggcatggtggctcatgcctgtactcctagcactttgggaggccaaggcaggaggacggcttgagcccaggagttcaagaccagcgtggacaacatagtaagacttgtctctaccaaaaaaaaaaaaaaaaaatagctaggcatggtgatacatgtctgcagtcccagctactcaggaggctgaggcagaaggatcactagagcccaggagtaagccatgatagggccactgcaccccagcctggggcacagaaagagattgtgtctcttaaaaccaaaaaagaaaaatgaaaacaaaactttaaatgactttaatggtgttataatggtaatcataattactatgtttattatgtaccaggcactatttacatatgttaaatcttttaatcctcacaactagtcaatgagtgtaggtacattatcatcctcatccccattttacacataagaaaaccaagggcagagagttgtaaaataatctgtccaagtaccatttattaactctgtgccacattttgacacccaggaatagttccagagtgggtgtgtctaaccgtcataccacactgtctcaacaaaccacacaataaaccatttatcggctgtcttcctcctacggaagtaggaattaagtttcgccctttccttataccttaaacacaattcaaaaacttgtacaatcaactttcatggtttccccaaactgaattctcccttcttagttttctaagtaagttccaattctcctactctcttcaatgtagactttactaagattcctcactggccttctcttcacatgccgcacacacactttccactcaatggctccaactacaatgtcatcaattaatgactcccaaatctacatcaccagcccaggtagctgtcctgaataccttatctatctatctaactgctcaacgaatgcctaactatcaattcaaattcagcagatccaaaacggacctcaacacttaccctcctcactccaaacttactctatccatctgtgtttccagtatcacagaattctagcatcattcacatacttgtccaatccaaaaacactggtgtagccaaggtgatctttttaaaaaataaatcattttatgttgctcctatactttagcactccttactgtgcaaaccttcatgataaaatcctaatttctgagcatggtatgcaaaactcttcataatacagactgattacctcctaaccatctttcaccagtcagtccctcatttcctcctaactatgtgctctcgccacactgaattgtttcctgttccctatgtaagccataaatccttgcctctaaaccagcagtatccaatagaatgttctgtgataatagaaataatcacttatctgcattatccattatagtaactgctagctacatcacatacatgaaatgtgactagagtggtggagaaattaaatttaattaaattaaatttaaatagctacatttggctagttgctactatattgaacattacagctctaaacctaggtatatgctattctgtctgcctggtatacacaggtatgtgtggaaagtcctcatcagtgctactatctaacatcattagtattcattcttttgcaaggttattctatttatgtaggtagtaattaataaggtccattctacataagatactatttaaatcctctagtggagctagctacataacctcatttgtataccttagttgtttactttcctaatagctaatagatagtaatttaactacaatttgtcctaaaaggactatcattttaagaaatgagcaggctccatgcattggtaaatgaaacaagcaaattataatgtcatattataaaagcatatagctttgctctaaaaacacatgatatacacatacatacatataaatatatatgcaaaagaaaaaaggctaaaagatatatactacattaaccgatttcttctggatattgaaattagggttgttatttttcagctaacctgtatctgtaagttttctagaagaaaaaggggatatcagcaattctccagcaattttccttctctctaatgcatcatctattttctctcctctacatcagttggttccatcagcaaacaagataatacagtttctcctaccttaaggaaaaattccttgacataacattcctctccaagtgctgctccatttctctgctcttctatacttaaaaatatactaatggccaggcgcggtggcccacgcctgtaaatcccagcattttgggaggccgaggtgggcagatcatgaggtcaggagatggagaccatcccggctaacacggtgaaaccccgtctctactaaaaatacaaaaaaaattagctgggcgtggtggagggcgcctgtagtcccagctactcgggaggctgaggcaggagaatggcgtgaacccgggaggcggagcttgcagtgagtcgagatcacgccactgcactccagcctgggcgacagagcaagactctgtctcaaaaaaaaaaaaaaatactaaccacaattcttcttcttccttctctcttgagcccactcatgaggctttcagccccaccagtgcacctaaactgcttgtcacggtcaccaaagtccacccagtgacaaatccaaaactcccttctcagtaatcatcttacttgacctatttgtattatttgacacaattactccaggaatgtcccaggactgactgactctgacctttttctacactcacttcctcagtgtctcatccaatcccatgatacctgatgactcccaaatttatacttctagcctgactcctcctctaagctccacactctgatatccaactgcctatttagtatctccacatggatgcctaatcgcatctcaaacttaacatgcacaagctcttggtccctttccccctttaaaaaaaaattcctctttgcacaatattcttcattttagttgacagctattccaaacttcgagctgtgtaggcaaaaaactttgtatccacccttgatatcttttctcccacacacatatcacatccaaactatcagcaaatctcattggctctacctttcaaatatatccataactcacccacttctctccactaccaccaatcggatcaccttctcttgcctgaattactgtaatagtctccttgctggtccttgcctcaaatctgcagtccactcctagttcaagaggcaaaatgtccctttaaagggtaaacaatcatttcacccctctgctcaaaactctccaaatggcatcccttctcactcagagtaaaatcaaagaccttaacaatgattttacaaggccctacacaatcaggtctccgccttccactctgccccttatctctctgccctcatattttactaattaatttcccccacatccttcttgaccacattctcaacctaggctttaaaaacttgcagaaaacccattccaagaataaagttgggtgatgcctagctctgccaacctatgattttggaaccaccctactatggtttcaatgtgtcctctccaaaattcagatgttcaaacttaatggccaatatgatagcattaagaggtggggcctttaagatttagtcatgagggctcctcccttcatgaatgagattaaggcccttgcaaaagaggcttcacagtcttccattctcttgcccttccaccttctgcccagtaaggacacagcattactcccctccagaggatgcggcaacaacagaccatcttagaagcaaagagcagccctcaccaggaaactaaacctgcctgtgactcaatcttggacttcctggcctccaaaaatgtgagaaataaaattatattctttagaaattacccagtctcaggttttttgttatagcagcataaaacaaactgagacagggccttattcattcttctctcatttgtccagctaccatgccaactcactcagctgaattaaagacagtggacttctaattaggctggttcctatcagcaatataaataatcagtccatcaataaacagatattggctataaactgttcacttttgtagatctattaagtctttccagctgataggctaaataagccttctctaaatacacgaaccaacgttattcataataatatgaaatagaggaaaatcatttccttcttgattattctactttaagctcttcattttaaattttgaatttggactgcaggcaatttgtttttgtcagtagttcatttatatacacaagtgaaatactgtcaaattatttcactgtaatacatttgtcattctatgagcatttataacttttcatgcagcaaaaaagaacatttcaaccaaccatctgtctgcctttttcatgtgctttaatcattcagctctggtaatgttgctccaaatactaaattttttttaaataacataaaatctcacatcttatgatttaatggtaaggcttgaaatttaattttcagatttttctcctcaaattttaccagatcagtgattttaaaaataacatatcctactgtcaagaaagaatattttcttgaatatttattaagacaaaatgtagaagtcagaaccaactctccttcaaggagatatgcaagcaaagcaaaataagataaaaggttttataatctgttggaaagtaagactctgtttacaggcagtatttcatcaaatttctattcaatgtagtaaaatcttatttaatttgaaatatatttcaagaattaaatcataaatggaaccctactgcaccactgaaatgacaatccttaatttgaatagttggccctttgtaaaacttacgatcttatttttatgaagacaaaaacaactagttcagctgctaggaatgcactgcagatgctagtatacagtttcttcttttatttttagtcaccttggaacaaatgctgaaatttagtgaaaaatcaataaaatactaaaatttcctaataacttaatgtaccccttgtaaaaaaaaaaaaaaaaaagtaggatccagtttacatatgtagcaagcaaatatgttaacagctctagtaccagatctaatgaccataaatttcaattagctaaacataataaacaagacagatcagttatcaaacctggaattattagaacacaagagatttaaatcttcataactaaagatgatcagatgtataacagtatgctgacaaaatcatgactgaagcatattttcatagcagcaaccctgaactcctgagcacaagagaaaggaattcacaatgaggaaggagcccgtgcctcttcatgtcatgcttatgactcagggcaccaacacttcaacgtctcaaactaaaatgtccttaacatttcaaaattccagcatttccattttcttcagtaaatcactgtttacacaaacaaaggcttataacaaataattttcaataggtatgccacactgaaaagttgaattacacaatttaacactaattgtatacttgaattactgacggttagttcacattagcctaatctctccaaataaagtctgagtttcttaaaaacaagataaagacactataattgttatgcatttttatggtgaaaacacagaggaatgaaccatacatatggaataatccaagactgggaggtaaagatgcctttgaagactgggataaagactaaaaatcctgattgtaaagttcattccatacctacatgacaattccgagtcagttaatcctaaccacagcaaagacccaagtgaactacacaaaattagcttcagggtgatgctgtactacaatacaatggagataccagatgagggtttccttctgtatagggtccacggaatcagtcatgcttcattttttaacaacattggctaatgagagagcaaatgttaatggaatctaaatcactgaattgagtaaaaggatctgaaaatattttattaagcaaaattatgagccaaacactttgctaggcaccttcacacaaatcacagtctttaatatgagcagaatgtgtgaacgatttatctatataaatatttaagaaatattcactgagcaactacataaactgaaaatacacaatgagataaagtttaaatgagaaatactaggataagcaaaaagaaagtagagcaagctctaaacaactagaccatgaaaaaatgttaaatgaaaaaaaaaaacacccaaaaatatggtacagacactagataaaattaagtattaataaaaaatggacttaaacacaaacaagtttagaacccatagtgagacacaatgactctttgaggtaggtcaaatataatgcgttactattaataaaattgtatttttaagaaagtatattcaataacatccctctaagtaaatgaatctcactcagctgcatttctatatgcctttcagaaagatacaaaaagtagtggagataaagtcagagttgctataattgcgtacaaaccacagacacatgtaatcttcctactggactctcctgagaatcactgatattaaaggttaagaatgaatgtaatagaattttcatgtttgatattgtaaagttgacaatgaataagatttaagttaaaaaataagtcaggctttattgatgcaatccaaatacactgggttgtattactgactacaggaaagcatgcagtactttgcttggatctaaattagctctttgaatctaaacaaatgaaaagcccaccccgatttaaacagagtaaaaatgctacctttcaacgtgtgcaggaggtactgcattgctaagttactggctgctaaagtcacctttcagttgttaaacccaagggcctcttttcagccttcattctatttgcccttactctacaactcctgacatagctgaacatttccttcttttaattttcctgttagcatcttcttttttaaaccttcctgtgttttcccacccttctgagctcagtctctttttctagttcttccattcatactttatatcctgttgtcccctgggttttgtccaaactgccttctcgtctaacaagaaaagtcttccctgggtgatttcatccattcccatactttactacctactattcataattgtgatgtctaaatatccatctcatttgaacatgctttttcttttgcaaatcttctggtttctacatactctgcctaaagaatccatctttcctccccctggcaaaaacctcaggctttaagatctaaagtgtcactacctcagtgaagtcttcaccaactttcccaaatagcgttagttaatatcctagtttagaaatcactttgaagtacaccatctcatgagatcctcacaaaagaggcaagtattatcacatcccgtctagaaatgaggaaactgaggtttgaagagatcagcaacttgaacaaggaagcactactacaaatggaaaacatcaacttaaatccaggtcttctaactctgggcccagtgttttttgttttttcttcccattttcatttatagagacaaggtctcactatgttgcccaggctggtctggaactcctgggttcaagcaatcctcctgcctgggcctcccaaaatgctaagattacaggcaggggccaccattcccagcctcagtcttccttctaatacaccaagatgctctcaaaggaaaagagatttacaaatttagtagctttactattgtaattaagaaaaattaattagtcttgtctgtttctagaaattaattcctaattaaatgtttaatccagtaacagaattattaaaattatttttaattataggcacacatacccaaattggttaaaagaagtttttttttaaatgaagaaaaacaacttagaaaaaaacagaaaataaaagttgagaatattttaaaaagaaggaaggggccaagcacagtggtacacgcctccaattccagcaccttgggaggatgaggcaggcggattgcttgagcctaggagttcaagactagcctgggcaacatggcaagaccccatctctacaataaatacaaaaattagctgggcatggtagcatgcacctgtagtcccagctactcggaagcctgaggtgggaaggatcacttgagcccagatggttgaggctgcagtgagccatgatcacaccactgcactccagcctaggcaacagagtaagacatgtctcaaaaaataaaaaataagagtacaaaaataagttctttacattttaaataaagaaattgaaaatcttgaagccaataatctaatacacaggcctttttagccaataaattaggtataggatctactttcataaagccatctaattctgcttctgtttgaagagaggagaagataaataatattgataaataagattaaattcagaaaacaaaaattgccgataatactatgactaggaagtacctaggcatcattgagatggttagtgaaggatcagtgaacacagagctctaggccaagaagccaaagagcagaacagcagagggagttgcagctgaaacattaccattttgcagccattgtggaaaagacaggttcaggagattgatcaatggttgttaaatgtagaagtggtccatttaaaaaagagcaagacatctgcatggtctcagtgtctccccacagataatttgaaaaaaaaaaaaaaaaaaacagaaatgacaccacagagaaactggacaaccctgtgactaggaaaattaacatcatgaagatggacaacctatgcctccaaatgtaatagttcaagaagcatgcatcacctatggtagtatcccagccaaggatacataacctgaatctaaacatgaggaaacaccagcaaacccaaaaactgattaacataaaataaaataataggctttgcaatccttagatatgtcaaattcatgaaagacaaaaaaggctaaggaactatcccagattaaagaagattaaagagacatggcaactaaattaaatatattatcttggactggaaactgtacttgaggaaaaaaatgcttgggaaaaaaaacactttattggaacaaaggataaaattagattaatttcctgaatacatcaacactgtagttgcgtaagagaatatctttgttcttaaaaattacacattaagattttcattgtaaaagaacatgatgtgtacaactgagtctccaatggttcagaagacataataacatgaatacgtatatgtgcctgaatatgcatggggagagtgagtggcagagagagtaagcaagcaatgtagcattttttttttaattggtaaatctgcaaaagggtagctctctgtgtcattgttgcaacttttttgtaaacttgaaactatttcatcagagtaaaccattaaaaaccagaggtgaggaatagggtaagctttaagttttttatataaactttgtcattcgattttttaaaaggcaagtaatattacggttttataaatgagaaaatgtggactcaagagagatttaatgaccacttccagaacaggggtctccttgtttctgtacaattccattagactgcaggtcaatagccaaatgtttctaatccctggaagcttctctggtggtactacttggagctactatttaaagttttaaactttttgtgagttgtatgcactcactaataaaaataccatacatttcatcaagtagtaagtagcacatctaaacttttgagagaatgggctctaatattagagcccctgagttcaaattcaggcagtgcaatgttctacctttgtggccttttccaagttaacaaccttgctccaatttcctcacgtgtaaagtgggagcagagaagtacctggtaataacctgcagggttgtttaggaaaactgaatgagataataaatgtaaagtggtgtgcacaaatactcaataaatatctttcggggaacacaattcaaccatggttatttgcatatattacatatcacctctaatcaattagctacttttattttaaatccaacctgttaggtcacctcaagagcactggtcacagagtcaaagccgtaagttttttttgttttttttttccaaatcaggtccaaatttgacaaaaatctttttcttttttttctttttttgagacggagtctcactctgtcgcccacgtttgagtgctgtggcgcgatctcggctcactgcagcttccgcctcccgggttcaagcgattctcctgcctcagcctcccgagtagctgggattacaggcacgagccaccacgcccggctaatttttgtatttttagtagagacggggtttcaccatgttggccaggctggtctcgaactcctggcctcaagcgatccgcccacctcaccctcccaaagtgctgggattacaggcgtgagccgcagtgcctggccccaaatctgacaaaaatctaagagaaaacatcgtagatgttcacaaaccataaaagtaaattaatttgcgaaacagattgatgccgatatacaggttaattcagtctaaacattttgctaatagtagaggcaacaagctccgtacttgttctagaacaatggatcatcaaatgcatataatgaaaaatgaaatcagttaccttacttttaaacttttctaaccttgggaaaaaggaaaagattgtatcttacatgctatatatatgattttgatcctcaatacagccaaaatgtaatcccaatttgaagtagtagcactttctagactacccaatattgttagtaacgtttaatttaaattttaattataccctctaacagatctgcaaagctactagcacagctattctaccttaatttagcatgaatttagtgacagactattatgtgaccctattgcttagtaatgaaagatttaaaataagagaaatgtaaaaatgataattctggtaaatgtaaccactaccaccaacccaccccccaaaacaaacaacttgggatttctttccatttctcggtgatactttttacaaaactaagtgtaccttgtttaacattcgtttttaaaattcacattattaatctgtaaaagttttggatttgttcacagtaacactcttttaaaatattttctattcatatgcttattttggattggtgtttttgtctgtagtgcaaaggacataatccaagaacattaatactggtgtaaaccagtttgtccattcaaacagcctaaatccacctctctgctcctacactccggggtcacaaaataacttcccacaagcaacactcgcactctcaccttcaccaaaacactcctttcaccctaatcagggaatgtattaaagtctgatccggcgaacggtaaataaactagaagacgatgctcaaaattcagactcctgagcccagcccaagtccaattcaatcagtgtcttcaggggtgggatctaagctcaccaagtggtttccttttcactaaagtttgaaaactactagagacccctacacacattcgccccaaactcccacaactcccaccaccgccaaccaaccccacctacccacccgcgggacacgttaccgccctgccctgctcagacctcagggcgaccccgctcctctccaggaagcccaccctggcgcccactcctccgagtccgcagctcctccctcccatccccgcaacccaaacctttctcctcacttcttcaaatcgctgctaaagaggccgaaggcccccgagggggaaatggttgaggtcgcctcctgacccagctccgtcgcctcccctcctccggactgctcattgtaaggaaaactattgctggacattgccgcggtgctggcgggtgcggggttggtcctgccgggggttctctccaaaaggttccagtccagagggcacggaacaaaactagttctcgtacggaggagcgcgcgcaggcgcttccggactcgtcacggctccctgagccgacctggcagtccaccccctgcgcatgcgcagt

SEQ ID NO: 1526 - DNA, 292430 bp, Homo sapiens; identical to SEQ ID NO: 1525

SEQ ID NO: 1527 - DNA, 50602 bp, Homo sapiens
tagagagaagacattttattgagcctgctacataaatagctacagaaatctgggaggactgaagggagtggctgccatctctctctgcacagatcactaaggaatccatggggagggcattaggggagggcttggtcctccagagggagagaggacaccctgaatgctatctggcatgaggaggatgatgagagagagagagaaagatgagagagactgacagcctaggtgtcatggggaggtatagatgggagccaaacaggtcacagcatttggaagtcactgggtcagagcctgtatcacatcctttaccagcatggtgccaatcaccattttctcgctgttgacagtcagctgggcagctccagctggccgggcatccagggtcagcagaacgaggcttccaccagtcagtgtcctccctgcaaacctgaggtgggaatagaaggggtgaggaagagctgctaagggtgactgtgtttggaaggggatcagcagctggggctcctccttcaaaccagggcccccatgctcatcatttcccctctactggtggcctagtacctgtactcatcagatgtcccacaaggaacacgacccaggttggcagtggcagtcactttctgcaccacaatgtggtcactccgacaggtgtctggcagcatgagtttctctgtgatctcattcatgcccatcagctttcctgggggtagaggtcgtgatgagggcagaggccatggtgggtacagaggccagcacctgggtctgcttactgagcaacaagttctcccaggctgggaaggtatcatgcaaagggcaggtcagaatttaaatcatcagtcttggggagaaggtacttccctctcagactgggccctccctcaggaagcctttgtcagcctctctacccctcccacccaggcctttatccatgttgttaccaaagactgatttggcgcttcctccatcagacatctgggctaccagccccttgagagtggccagtcagttcttaagaggttcgcccatcctgaacctcacaccctttgatctttcctggggggccctccaacccacattcaactcccactcagctcctggaagctaagccctcacaaaaagatcacaggtggctgctgtgatctctcagccagaatccagtagtcacatgcagcattcacaggtacatttttaattgtacctctgcagtagcagctccagacctagccagggctcctgaagcctccaaaccttcacagcacccccagaactcctcattctgcaaggctgacttctctccactcacatgatccaggccccccatgggagctcctccgtctgctctcctgcacaccagcagtcttctcttcagcctctttcctccctccactgcttcccctattcttcacctccttttagaaactgacatccctctcctgtttcttctatccccttcattcatgactaataacattttcttgtttttgttccttcaatctgttcatgttcaagtgtccccgtctccaaaaaatcctttccagaagtgagatccttcatcgtgccaatgccctgtctccctcctcattcatggctaaagtcctccaaagaggactgcatgtacttgagccgtggtctccctcaacccactgcagttggcctctgtccctcctttagcaatgaccctctctccctcaggttggcagtagccttttatatgctgactctgaaggtcttaggtaactgtggtttgcagacaccttctgccttgttgtctctcctggttctcctcccacctctccctgtgctccttctcttatccctcccctcctctttcttctgcagaattcaggttttcccccaaggttctgtccttggccttcctattttctcccacctcccagagtgatctcattcatattcacagcttccattaccacctctatgttcatgactccagcttcaaagtgtttcctgggcatagacccatattttcagttgcatactaaatagctcctcctgaatttcccaaatgcatttcaaaatcagcttatccaaaactaaccatgatcttccctcctcccttgcccaagccactcttctttcttctaggccagaggttttgcaaattacagcctccagaccaaatccagcccaccacctatatggcccacaatgtttttaatattttttaagtgttgggggagcaatcaaaagattaatatttcatgacacatgaaaattacatgaaatttaaacttcagtatctataaatataaatggaaatttcttggaacacagccatactcgttcatttacatactgtctgtggatgtttctatgtttcaacagccacagtcgtgttgtaactgcaacagagaccacatgattctcaaagcctaaaacatttatctttggcccgttacagaaagtttgctgacccctggtctagatgaaggacaccaccattctccctaccatccaagctggacattctggagtcagcttctatacttccctctctgcccactcccagggagcactcaccctgttccttcttaaactcattttcactcatgaacacaggggccatcagctccccaacaggtggctgaatggagacgtagaactgtcgggtctgggtgctgggaggggtgggaggaaacggagaagaattaaggctgtcatctctcccctcacttcccaccctgtgtagaggcacagcttggaggcagtgaaagagtgaggtcaggaatgagggcctgagatggcttccagacccacccaatcatgatgtatccccactaagcaccacctccatttccagttcattgttaccctgtccctttccagcccatcctctcacccccacctcgagttgggcacataccacagctggaagttggctgcctgggttgagtcacagaaattaatgcccattacagcagtggcagattctccaggtgccagggactctgaagtggtataaggcagtgaaggggagagggagggccaccatcacctgataggtctagaacccagcctagccctactctcctctccactgtcacagctgaccagccctctacagaatcttggctttcttggctgctggagactgttcccggtttcctcctgaactctaagcaccctttcccccactcaccctcaccacatttaagttagtcctgaaacaaccaaggcccaaatctgctgctgcaagcacctcccgccctgatgtgaacttgcttatttcatcatctgtcttgtccaccagagtgttgatcatgttagatgctatctctgtgcccctatagcttggcccctggcctggcacaaggagggtatcagcaaccacagaaagactgactctgcccaggagcctcctcctccaccccatccaaagcccttcgcaccaatttcgggaaattcttggatgctgatgccagcaggcagtttgggagtgcccacatgcaggcccttgatgggggtatcagagctgttggagaagtggatgtgcacggacaccatgtggggatccccggagaaaggttggcggctgaaggtgtagtccacagccagcccctcgccagctacccggtgcagcagctcctgccgcccaacacccgatactggactcagaagctagagtggaggggtagggaaggacagaactgagcaagatggagagagcctgtcccagcattgtcccctagggccatccagcagctgggactcaaagctatcacatcctccatcacacccaccccccacacacatccacaccataggatgcagcacagggatgtgtccctgccccagcccggtcccctcctccatcccactcaccgacggtaccagggtggagtctgtgagtgtcaggccctccaggtcagcagccagactggtagacacaattgctgggggagacacaggctggacactgggaggggtgactgtgggagtagataagactatgaggaggcaaagtggaggtggcttgggttgagcagggagcctagggatcaaggagcacgcatttcagcaccatggacagcggggcacatggctgcctggaggctctcgcaaaatacccattcctagacctcaaccccagacctggggaggtcagccctgctgccctctcaggcctgaagatatgttctgtctgctcccctgctcccacaagacctgaggaacccgatccagagtccctatgggctgttctaattcatgctccccaggcctcctttcccctgtgacttttaccacccaaactcacaatcctctagatcaagcagggagatctccttggttgcaggagcacttttgctgctgggaggctgaaagagaaaaatgggatgtgggtgtggggaaggggagcaccttggcatgttctgggttgggtagaagatgtcatgttctgttctggatggtagggagatagatgtctgggcctggcccagaggttggggagggccctggcccatgagcacaccctgactctgccccaaggctctcactgttttcctgctccaggaggcaggttctaactgctcctcctcggactccgatgtcatctcggactctgatgagctactgctggaatcgctgccctcatcagaggatgacgcttctccttttctctctggcaccttcttctttgtcttcctcttaccatcctcctcactctgttcactgaaggagtgggaaaggttggctcaggcctggcctggacactccctccttgcttcacagaagcaggagaaatgctgaaaagctggagtggtgtggggagcctgagccaggagggttcacacctgaggtcctatagcagggaccccgtgagagcttgaagccagcttgtgccagctcaggctctaggactctggttgcttctccacaccagcccatgaggcctcagagatctcctgcagccagcgaaagtaggcgtcatgtgagctgacagccccacccagctcacgaggggctcaggggctcttaggagactggctaaagctcaatgctagccctctttccaggaaagccccctgaaccccaccagccatctggctagctcccttctcacctctcactgcctctccctttctcctcatcctcatcctggtcttcattgtcggactcactgctggactccccagagccgctctcactgctgctcttactgtccgattcactctcagactcagggtctgtggaggaacaatatgaggcctcctccctcatatgcaggcctccttgggtctggagcagacacctgggttccaccttcacattcagtactgaaccctcaaacctctctgacctgcccccagccctacatgccagctggaactgacagaaacacagatggactccatggatagaaacctgcacaagcacacacacctggaacatgaatccctcaggtgcacaaacaattcacaagcaggtgcacacccctagacacacaaccatatacatatacccctcatatagtcagtcacacagatgcatgggcagagcacagaggaccccagctctgccatctgctcaccactgtctgcggactccgtggggcctgactccccctcagagtccgagtagaagggtttttccttctcctttctcttctcccgatttgagcacttggtccattcaggtacctggagatgggggtagggtgcagggtcatttcatcatggttggggagaaggcaggcaggcacaagcccttaccctttattccacctctttgtgaggccctacctggtctgtcccacaaagggaataacagaggaggaagaaaggggcactgtccatggaggggagggaatgctgctcacagaggagcactgccaaaccaaggtggaaacagagtatgggaaggcccaggagcacaacacacaggggaagaagagggacacagacagggcaggggagagagcacacgtcacacgaaggtgggacctcagtgtattcgcccaacaggcccacgtgagtctcaataagggagagatcttcttcctgtgtgtgtgggggagggtgttaggagggctgggccggcactgccagggctccctactgtctgcccccaccaacacacacacacacacacacacacacacacacacacacacacacacacacacacacacttcaaccctccaccccgctgacctccacgttgcgcacagatgggtctggggcttcctccggccagtctgggagctcctggtagcctgtggccttggcattaagcaggtgggacagtgagcccagctggaagtggtcccggtctagggataggtttagaggtcaggcaggtagcagcagtgagggaaagctctgggagctgttttccaggtggggctgggtggtgattctggttgggacttcccaggtgggtaggggaaggagatggatgtgtgccctaatggctcttccaccctgactgcacctttaggcccacatgctggaagaaaaggctgtctggccaggccagagcagggactgagggccagggaaaggcagcctacagaggtgggcaggaggagactctgggcccacagatgctgccgacctgtctgctcagcatgcacgtctagtcaggctctggactcagcagggagggatgaacagtcagagcatgagtgtgtagaagtctggatcagagttgaggcactgctggaggagggcagcacaggcctgtgagtgaggatggtgtcggggagaaagggactgttgccttcttcctgggagaatttcaaagctgtgcccaccctcagaatctccccattcgtgaggtccagggaagagaaaaagaacgaaaagatacccagaagaactgagctttgtgaaggaggctctcttctgtgtaggttcctggcttccactcctggggcccggagaagcagcgggaggacccttccctcccaggcccatctcaaggccgttgtcttgggaaaagaggccttaagggccaagcccaggaacagaggcaaggctgaagccctggggcctgggatttggactgactgtagtgactaagctcacagaatgcaggcaactgctttctcaggacctttataaaaatatacacctctcctttgtgtgttgttttgctttctgccttcctgggtccttggtatttaagatcttggtatgtattccaaagcctagtgtctgctcagggagggagatggaaaagggagcctgagaggagaggaggcacaagtccatcctggccaggaaggcagaccctcaggtgagatgatgctggcagtggttatgggagggtgaaagagtaattcctggtgccacaggagggacaaaaggagtgagccagggagcaggactgtccacagaagcctggtgcctggctaggggcctcaggaaggtctggggcagagactctggccagttcctttccattcccctaggaaggttacccttgatttcagctcccacctttgaaggatgactccaagactggagctggtttgggtgccaggaagagcttcttggcatggcggctgagggccccaccctgctcggaagggacgatgagctgccgggtgaagcgcgcccggtcgcgaatatcatagttctggtcatatttggccagactcagcacatactgggtcagcagcttggtctggaggaacaggaagaggtgggtcagctgacggggggatggggacacaggaggctcagaaacagattctttaagccgacactttcaggcagaacgtctcctctccctgcttaggaccggcgcttccacccagctgtccctccccacctgcccttgttctgggctcagaattttctctcatctctctggacatgcctcctgatgatcccaactttgacaactgccttgggccaacaaaagaggttttccttttggactttccccactcctggctctggactccattcttccctagatttgtggtccctaccactccaggcctgtccagcctctttactctagggcagcagggtatgtggaagtatggaatgctctgctggacctcacagtttccaggctccaccacccagggggaattagacaacaaaaagacagggcagataaacaggggtccctttggcaggggccaccctcatgccctatccacccatttagtagattctgagcagcccaggggtctcagaggtctttatccttccctggaagcttctaatgacatcagggcaaactgcagctgcccatgcatttgccaaggtcatgtagggttcacagtctgcagtcagggaagctacaactgcagacctaaaatatctccatttctgccatgatcttggcctaatctaacctgccttaacatggcaacagcggtagcagccatcacttatcaagtgccttctggcaccaactctgtgctaggtgctccacactagctcatctaatctccccaagccttctgagaagtaggcattattgcccccattttacagaaaagaagcaggatcattaaggggcttttcccaggccaaggagcccatcagtactgcacctaggcctgcatctgctggagctgcaccccatctgcttcccttcactgcctacctgctgacataaggagcctgccctggcccaggtctccatgtttccatcacttgtgaccaagatcaaaaccaccaagtggtcaacaagcagaatgcccaagggcatcaggggccggcaggagggagcctggaactgactctgttcttcctgaggtttatggtgacatactgttacgtgtagccttggacatggttaacccagctaatctggcagggacatcaagcagatgtccataaggggcaaagcccctcagatgctgacccagagtctgagcagctgctttggcagaattgccccacaccactctagagagccactatgattccacattcctacctccaatctggcccacaggccctcttcagctcagtcccttccagcaaagcagcacctgcgatactgttatagtcacagataagcaatcccaatcccatgcaccgctaatagaatagacttaaaaatatgaaaataagatgccatcacaacagatttcatcaccaacctgcccctctcttggccagacaccatctaaatggccagggctagtggatgcccttaccaacatagtcaattatcaagaggctgctgatccctcttttggtttggacaatgtcttcctccacagatttcccagctggctgatcacagactccctccttcaagtccttgcctagttctagaaagaactgtttggtatttggatccatctgtccacagccttaactgcatgttaacaaccaacacaggaaggggctggcccaccacctcaacactgcaggatttgcctataataattcattacccttctccaccccaaggggccattccctgtggattgtggcatcctgtgtgcaccaccaagacccccacctcatctagccaggatgtgcaggaattacaggctgttcaagaaggcctctgagatacactccagtgtgccaagaacagaacaaggctccccctcaccaacaggctccagttgtcagagaggaattttaagcaggaaacactgacttcctttccataacctatgccaacatacatgctaccttgcagatgcctgctaatcatgcttagaaaactggctgttaaaaaaaattgaaatatatcctcaattcacacattacacatgagtaagtttaagctctagatggatgtggcagacagattctaaggtcttccccaccagtagctgcctcctggtgttcatgcctttgtgcaatccctcaccttgggtatgggcaaaacctgagacttgcttctaaccaacaggatatggcaaaggtggtatatgactatatatgatcctatgattatgttttattaagaagactctgtattggaagttctatctagagcaatcagacaggagaaagaaataaagggtatccaaattggaaaagaattcaaattatccttgtttgcagatgatatgatcttatatttaaaaaatcttaaggattccaccaaaaaactattagaactaataaattcagtaaagtcgcaggatacaaaatccacataaaaatcagtagcattggccaggtgcggtggctgatgcctgtaatcccagcactttgggaggccgaggcaggcagatcgtgagatcaagagattgagaccatcgtggccaacatgatgaaatcctgtctctactaaaaatacaaaaattagctggatgtggtgatgcacacctgtagtccgagctactcaggaggctgaggcaggagaaccgcttgaacccgggaggtgaaggttgcagtgagccaagatggcgccactgcactccagcctggtgacagagcaagactccgtttcaaaaaaaaaaaaaatcagtagcattgtccaggcacagtggctcacacctgtaatcctagcaagcactttgggaggccgaggcaggcagaatacctgaggtcaggagttcgagaccagtctgaccaacatggagaaaccctgtctctactaaaaatacaaaattagctgggcatggtggtgcatgcctgtaatcccagctactcgggaggctgaggcaggagaattgcttgaacccgggaggcagaggttgtggtgagtggagatcgcgtcactgcagtccagagcctgggcaacagagtgagaactccatctcaaaaaaaaaaaaaaaaaaaaacccattgcactccagcctgggcaacaagagcaaaactccgtctccaaaaaaaaaaaaaaaaaaaaaaatcagtggcttttttttttttggcggggggggacgaagatgaagtctcgctcttgtcccctaggctggagtgcagtggcgcgatcttggctcactgcaacctccgcctcccgggttcaagcaattctcctgcctcagcctcccaagtagctgggattacaggcacccgccaccacgctcagctaatttttgtatttttagtagagacagggtttcgccatgctggccaggctgctcttgaactcctgacttcaggtgatccaccagcctcggcctcccaagatgctgggattacaggcatgagccaccacgcctggccgtgaattcatttttgacaaaggtatcaagaacatacattagggaaaggagagtctcttcaataaatggcgctgggaaaacgggatatccacatgcagaacaataaaaccagacccctatctctcaccatatgcaaaaatcaaatcatagtggattaaaaacttaaatctaacacttcaaactatgaaactaataaaagaaaacattagagaaattctccaggacattgtactgggcaaagatttcttgagtgataccccacaagcacgggcaaccaaagcaaaagtagacaaatgggatcacatcaagttacaaaggttctgcacagcaaaggaatcaacaaagagacaagccacagaataggaggaaaaaatttgcaaactacccatctgacaagggattaataaccagaatacgtaaggagatcaaataactcaataggaaaaaaaaattcaataatccaatttaaaaatgggcaaaagagctgaatagacatttctcaaaagaagacatacagatagcaaacacgtatatgaaaaggtgatcaacatcattgagcatcagagaaatgcaaatcaaaactacaatgaaaggccaggcacgggtggctcatgcctgtaatcccagtactttgggaggctgaggcaggcggatcacctgagatcaggagttgagaccagcctgaccaacacagcgaaaccccatctttactaaaagtacagaaattaacggggcgtggtgacgcacgcctgtagtcccagctactcaggaggctgaggcaggagaatcacttgaaccacagaggcagaggttgcagtgagccaagatcgcaccactgcacactccagcctgggtgacagagcaagactccgtctcaaaaaacaaaacaaaacaaaaaaagatatatcatctcaccccaagtaggcttatatccaaaagataggcaataacaaatgctgacaagaacatggagaaaaggcaacccttgtacactgttagtggaaatgtctggagaacagtttggaggttccttaaaaaactaaacataggccgggcacggtggctcacacctgtaatcccagcactttgggaggccgaggtgggtggatcgcgaggtcaagagatcaagaccatcctggccaacatggtgaaaccctgtctctactaaaaatacaaaaaattagctaggcgtggtggcaggcacctgtaatctcagctacttgggaggctgaggcagaagaagaatcacttgcacccaggaggcagaggttgcagtgaggcaagatcacgccattgcactccagcctgggaaaaaagagtgaaacaccatctcaaaaaaaaacactacaaataggccaggtgcagtggctcacgcctgtaatcccagcactttgggaggccgagtcgggcagatcacttgcggccaggagttcaagaccagcctggccaacatggtgaaaccccatctctactaaaaatatgaaaattagccagacttggtggcgggcgcctgtaatcccagctactcaggaggctgaggcaggagaatcgtttgaacctgggaggcggaggttgcagtgagctgagatcatgccattgcactccagcctgggtgacagtgcaagactccatctcaaacaaacaaacaaaaactaaaaatagtgctaccatatgatccagcaatcccaatgctatgtatatacccaaaagtaaggaaatcaacatattgaagttatatctgcacacctacgtttattgcagcactgttcaccatagccaagatttgaaagcaacttaagtgtctatcaacagacaaatagataaagaaaatacggtacatatgcacaatgcagtactataaaaaaagaataaaaaagaatgagatcctgtcatttgcaacaacatggatagaactagaggtcattattttaagtgaaataagccaagcacagaaaaacaaacttcacatgttctcacttatttgtgagggctaaaaattaaaagaattgagctcatggagttggagagtagaataatggttaccagaggctgagaagggtagtgggtgggggaagtggggatagttaatgggtacaaaattatagttagatagaatgtgtaagatctagtatttgacagcacaacagggtgactacagtcaacaataatttattatacatttataaataactaagagagtgtaatttgattgtttgtaacacaaaagataaatgcttgagaggatggataccccattccctgatgtgattgttatgcattatatgcctgtatcaaaatatctcacataccccataaatatatacacctactatgtacccataaaaattaaaaaataaaaagaagacggtcttgctagcagactggctctagagactttctcccttgtggctttggagaaattaagcatccgtgttgggaggcccctatggcaatgagctaaggacggcctctagaaggcaagggcagcccccagctgacagccagcaagaagccagggccacaatcctacaactgcaaggaagtggatcgtggcaccatgtgacttggaagtggacctttccccagtacagcctccagataaaaactcagccttggctgacacctcagttgtagccttgcataagatccaactaagccatacctgaattctcgacccatagacactgagaaaataaacgtgtgttgtttgaagccaccaaatttatagtaatttattatgtagcagaaaactaatacaattgatttaaaaatgtgaaagtagaaaaaaatttggaggaaattctttttaatttttatttatttttgagatggatcttgctctgtggcccaggctggagtgtggtggtaccatctcagctcactgtaacctccacctcctgggttcaagcaattctcctgccacagcctcccaagtagctgagatttcagcgcaccaccacacccagctaatttttttgtacttttagtagagacagggttttgccatgttggtcaggctggtcttgaattcatgacctcaaatgacccacccaccttgggctcccaaagtgctgggattacaggtgtgagccactgaacccagcctggagaaaattctaagtgaaaagtttaattgaaatgtgaatggggaaaaaaaagtattaaatatgaaagcattgaaaagaagcagaaaagtttaaaatattggacaatagacaaaagtacaacttctgaatgactatatataggaataaaaaataaggaaatatataattaatggtggtcttctaaatggtggacttattaatagtttaaacttataattttctgagttttccaaatgttctatgataagcatgtattacctttagcatattaaaaaaagtttacgtttttaaaagcaattctgcaaaatttgtcagaatcttctattcactgtaaaggcggtcacatgggagggttgtagatcccactgtgcccctggcagaccctcctgccacacatctcacctgacacataaaagcaaactaacctgctaggcagtttccccagggtctatatccaggtggatgtaatagccactttgattaccaacccccccatcccccgccacctgcatgttatgcctttgtggcctctggtctagtatctgattatctgctgatcaatagcagggcagaggcctcatcttggtcatttccttggcctcatcctgggccaggatctggcatgccgtgggcccatgtccaaattggagagaatgactgagattactgtggccttttagctgggcagattgccactcatggtcccaggatgggaagcatcactactgttttgcaagcatggtcatgtgcgcatccaaaccacctccctcctagtaccccaaggactcccccttctttaccactcccagaagaggctgggaagaaaggagaaagaaagggaggacaaaaatctttattgaatcaaataaccattctaaggggcctgcaaaaactcacttgcaggtgaagggcgccctggaggtgagtgtccatttgcctgaacagcctactctgggttccctgacaggggtcattcctaggggagggttcagctgtatatacccacagctcgctgtgccaaccctgatgacagctgttactgctgtgtttaaaatgtttatttttgtcctgtttctcctacttggctgtgagtatctggagacctgtaaatgtgtctcactcattgtcatatcctcaggacgcagcacagtaccaggcaaatagtaggcctacatgttaaataaatgaacaaatgcacatgtagctcacagtaacaacttgggggaaatgacatgtggacaggcccaggcttatgaaaacatgccaacctcaccatcctggggtttaggactctggctcagtgctgagcatgtcagactcccacctacatatatgttaaataaatgaacaaatgcacatgtagctcacagtgacaacttgggggaaatgacatgtggacaggcccaggcttatgaaaacatgccaacctcaccatcctggggtttaggactctggctcattgctgagcatgtcaagactcccacctacctgggtggctccccacccaggctgcttcatcttttcaaacattcctcccacttgctccttcctcccacctgaacaaaggaagtatacaaatattttttcaacgattgaacgcttccccatggtgctctttctccctctaacttctctctctccccctctaacttctctctctccaatctgctttgcccacaacactgataacaagctcagggtcacatggtccagtgtctctcctccttccacctgaagacctaaggtttggaagttacttttgataaggctagcatatttaattatacagactcagttgcctccacatgttgctgctgtcctttgactcctgattacagtcacagcacttggtggccctgcctacctcaccttgagcctctggggctcactctggccacaatggatcaaagaagccactgaaaaagataagtgccaccatccaaagactcccacgcacagtggacatggcagggatgctacagtctccaggggatatccctgctataaatctgtagaccccagccacctagccagaggttttgcttcaaggattggcagagtctttttataaaagggccagagaataactattctaggctttgtgggcaatacagtctgttgcaactagttaaccctgctgttgtagcacaaaagcagccataggtaatttgtaaatgaatgagcagggctgtgttccaacaaaactttattacaaaaacaggaataggccaaattcagcctatgggcagtagtttgccaatccctgtcctgcttaactgagtgggagagtgtggaaatcgtcatggtgtttgatgtccctgacaccttgaaaagctcagcacattatgcttcattttaggagaatctcctggaaccatctcaggagatgccagacagctaggaggctctgaacaccctgatactacaacttagttgagcctcatccttggctgtgtatctcttataacctttcaccttgggaatgacagtggccaccagcaccacccaagcccaagcagagactcacccccttatctttggcacagactggccaagcattgtcaagctttggaaagaagcacagaccacatctgggatgcatgttctcccatcagtacctgccactgttgggcccttcccttatcccaatcaactgtggttcttcacagccccagagttccaaggtggcagacaggactcttgtactagcagactggaggtcacagcttcataggagagtctcttcaacagtgaccaccagcactacaaggtctttgtgggcactggggtagcattggttatgtgggcagaccagccaccttccctgattcttcttttccaaaataggagctagagttcagccctgcctagggagggccaaaagaatactgtctagggagtttctggggaccagagtatctggggggtcatctcttaatctttacctgtttagagttggtcaggtagagcttggctgccaggttgatgacctgcagcttgacaatatcctcctctgctgtgaatgacttggccatttttcttaagacatcaggtgcaatcctggggacatgctcacagtactctccgatgagccacaggatgctggctcgggccatgggcacctgtggttgtgggagaggagtgaagatgggtaaatacgggaaagtgggtgggtaggattgtggacttccagggaaacagcactcctcatctgtgctggcctgttgtattatgggttctctggaaatgggagttgggggtggtgagatagagagaggttaaaaggtagacatttcctagacagcatttcccctcttccctagggcttcattagcatagagctttcaagaccctaagtcagtcatgatgtaaaagattgattttctggattcattgtaccctcagtactttatttccatgttactctccagaatctttgggaatgccttgtttagatgtttcagcttagcagtgcgatagaaaaacacaagatttgtcactcaaccatggttggctagagctttagagagaaaacaagagtagtagtaaagtccatcgtgctcattgagggtctccaaagggaaagcaaatcaggggtaacaaggtcagggtcacatggtccagtgtctctgctccttccacctgaagacctaaggtttggaagttacttttgataaggctagcatatgtaattatacagtcttgaaatcatggggaggaccttgaagtggggagtgaaaatatggcttctccctcacctggatgttgtctgtaagctttgccaagtgtttgatgatctctccatgttgtgctggctgcatctgtagcaatttcttaatgacgaccactgactctgcaaccacaagctctacagaacaaaaatgagtgtgtggaccccaagacagtcagatggccacactcaggtggacagacacacctgcagtgccccaggcccttggctctttctctcaacccccttcagttctctagcagccctcagaggtgtaggaacacttgggccctgatcaagacagacagaccaatggatacacattgtgtctaggcagactggtggatatccagtggccagcagagtcagacctgcaggcagacaccctctgatcatcacggttagacactcagggaaacactgaccatcacggttggacagcagctgcaccaggccattgaggcaggtgtcacggactcggccgatgttagttgcacagcgtccaatggcctggattgtggctgccacaaagtccttgtccatgctgcgaatataggtctgtgggatatgacaaagaaatccctcagtgactctgcaggcttgagggtgaccttcaagaaggctgtggcctttcattttatggcttatcatgccggtgactaagacttgggaaagggggtgacaactccacccccaatccagtgattccttggcccaaagccagccaaacacattggaacgggaatgtaagataatagtttctccagccttgggctcataagaggaggtttacccaccagggcacaaggatctgatgggcccctctcccaggcccttctggctgggagctggcctgtacctggaattcccgtaggacagtaggaatgttggtctcattggccaggttggtcagcacttccagctgcagggagggttggagaggcagaaaatgggtgggttggccagtggactttctgtgctttcattccaaatacacttcatagaccagaaaacaatcctcatgacagccctgcatcatcctcacactgatgagggaattgacaggttatgaaacttgtctaaaaagcaagaggaccagtttgcctcttaagtggattccctacacagtatgcttacagtatgaccatgtcacctccctactgcattgaaaacttaaagcttcctattgctttcaggatggagaccatcgtattcaccatggtctgtaagtccctgaatgatctgcttgctgtctacctcccatctcccatcactgtcccccttgtcttccaggccccaatcccactccacttcctaacccagggtcttcgcagatgctgtttcctctgcgtggagcagttcttcccatttctgtccctgcataattcatgttcatctctcaggcttcagctcaagtctcatatcctccgggaaaacttccctggcaccagactagatgaggtctccctattttatgcccttatagctctccacactttcttccatattttgtaagtggacttttacatttgccttgtgattaactgcttaatgtctcctcctccccacatctgtaagctccacaaaggcagggtccctgattagtttgctcatcatgtacccctagaacatagtggatgttcacaagggttaggaagattaactgttgctgaaggaaatcactcaataatgaggcagcagagcaggaatcaaatggaggtatgggctcccgccactttccttgtccgtgaatgtttgcaggagagcctgagggggcaggtgtgtgggggccataacactgtgggtgggagagaaaagtgtgaaccttggagtcagcagaattatgtgacctggggcagttacctcccagagtctttttttctttttcttagattgagatggagtttcgctcttgtcacccaggctggagtgcaatggcacaatctcagctcactgcaacctctgtctcccaggttcaggcaattctctagcctcagcctctcgagtagctgggattacaggcacctgccaccacgcctggctaatttttgtatttttcgttgagacgaggttttgctatgttggccaggctggtcttgaactcctgacctcaggcgatctgcctgtctcggcctcccaaagtgctgggattaggcgtgagccactgtgcctggccagagtctatatttttataaaaggaatataatgtacacatcctgggattattatgaggtgatatcaggttacttcatttatgaagagtagcaggtgtataccaggtactaggcaaagagcagttcccttctccccctgaccctccttagcccagctccctgaacaaacagctccagctggggcagtcatgggctcctgggctcagccccaggaataggcaggcaccaggggggccactgtgagttatttgagtgggtacatggggtggggagggctgggaagcacatgcacttctgtccctcactcaccttcaggatcttaattgggtggggtcggtggacctgatgtagaagctcttcaggtagggctcaaacataccctggcacaagagaggcagctagggagctccaccgaagccccaggcctgcctcgctgcccagagacacccctcctatcctgacccagcgcccaggatccttgcctcctcaccactgccctccactcctcaagtcttccctcgtccatctcagatctgactagctctttttccactggacatcccctcagcggcccctcaggatccaggccctgctccctatctgtatttggagcctcccctgccccatcctctgcacagccagggtattcctccatcttccctttccccggccccggtcccagccccgacaacgcctccagtgcccgcagaagcggccctcggacagcgaggacagcccgccgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctcaaaggccatcaccacactgcccgccaccagctggggaaagaacaaagacgagagggtgaacgcgaagggtggaaggccggctgccggtcaccacccctcccggagcgcccctatacacgcaccgtggtcttgtcagccagaagcttctcaatgacttctatcagctgatccttctggtcagagtccaaactgagggagaaatcggtgaggggaatttgccactctcagccccagccttcccaatatctgtccaagccatgctcacctcctgcaccccagccttattgttctcctccatctctgtcagtcccccaaactaccctcctcaaaccctctgagaagcagcaggcaagacttaggaaaggccaggggtgggttgagaacttaggaaccagcctcctggggagcgtgggacagggctggggcatacctgtagagtttagggatggcgtgggcagctgttttccgcacatagggtgacatgtccgaggcggcttccttgatagctagcatcatgatgggcactatgatgggcacacggatgctagagaggacacggagggcactggcacgaatcagctggttgggatcctaaaggcagaggtggaggcagagctatgaaagggcaccaggtgccctgatggggggaggccacacctttggaagtcactgtccccagcgaccactagctcttgcttccctgccgcttgactggagcctggatggtgtgccagtgatgggtatctgggggacacttaattttggctctggttgcagaaatctgacacctgaacaggtgttgcaatgggtagcttcacttccagaaacactgaaaaactttcagaacacctaaaattgctgaaacacctgaaacacttcctgttccttgtaagggtttttttggaggtgcctgttttaatgcctgaggtgaccgcccagcagatgcaagctggtctcccttccggagttcaaccttacactcctttctcccagaaatcattgcaaaagctgctgttcttccacagtgtttaaaacaaaataggggtgtaggcccttcctttttttttttttttttttttttgagatggagtctcgctctgtcgccaggctggagtgcggtggtgcaatctcggctcactgcaacctccacctcctgggttcaagcgattctcctgcctcagcctcccaagtagctgggactacaggcgcgcaccaccacacccagctaattttttgtatttttagtagagattaggtttcgccgtgttggccaggctggtctcgaactcctggccgcaagtgatccgcccacctcggcctcccaaagtactgggattacagacgtgagccaccacgcccggccccaagcccttcttctttattcctactgcatcctatacagaacgtataaaagcattccttacactgtattgtgatcatggggcttaggactgtcttcccactatcagcagcagcagctatatattacaggcatacctcggagatattgtgggtttgattctagacctcaacaataaagcaaatatcgcactaaaacgagtcacataaattttttgtttcctggtgcatacaagttatgcttatagttacagctgcttgggaagctgaagtgggagaatcacttgagcccagggagttggaggctgaagtgagctacatatgttcatgccactgcactccagactgagcaacagagtgagatcctatctccaaaaaaaaaaaaaaagttatgtttacaatatactgtagtctactaagcatgcaatagcattatgtctttaaaaaaacaatgtaggctgggcgtgatggcttgtgcctgtaatcccaacactttgggaggctgaggtaggaggattgcttgagcctaggagttcaagaccagcctgggcaacatagggagaccccagtctctacaaaaaaaaaaaaaattgaagtcagtcctcttaaactctgcctctgctttatcaactaagtttatgtaatattctaaatcctttgttgtcatttcaacaatgttcacagcatctgcaccaggagtttttttttttttttttttttttttttttgtaacggagtctcgctctgtcgcccaggctggaatgcagtggcgagatctcgggtcactgcaagctccacctcccaggttcacgccattctcctgcctcagcctcccgagtagctgggactacaggtgcccgccaccatgcctggctaatttttctgtttttagtagagacggggtttcactgtgttagccaggatggtctcgatctcctgacctcgtgatccacccacctcggccacccaaaatgctgggattacaggcgtgagccactgcacccggcagattccattttaagaaaggactttctttgttcactcataagaagcaagtcctcatccattcaagttttatcatgagattgcagcaattcagtcacatcttcaggctccacttttaattctacttctacttctaggtagaattccaccacatatgtagttacttcctccactgaagtagtgaacccctcaaagtcatccatggagtttagaatcaacttcttccaaactcctgttaatgttaatattttgacctcctcccatgaatcatgaatgttcctaatggcatctataatggtaaacctttccagaaggtttctataaacctttccagaaggttttcaatttactttgtccagatccatgagaggaatcactatctatggcagctctagccttacgagatgtatttcttaaataataagacttaaaagtcaaaattactcattgatccataggctgcagaactgattttgtgttagcaggcatgaaatcattaatctccttgtacctctccatcagagctcttgagtgaacaaatgcattgtcaatgagcagtaatattatgaaaggaatctttaagcggtaggtatcaacagtgggcttaaaaaattcagtaaaccataactgcaaacagatgtgctgtcatggcactgttgttccatttatagagcacaggcagaggagatctgccataattcttaaggaccccaggattttcagaatggtcattgagcactggcctcaacttaaagtcactagctgcattggcccctaacaagagccagcctgttttttaaagccaggcattgacttctctctaggtaggaaagtgctagatggcatcttcttccagtaagaggctgtttcatttacattgagcatctcttgttgaacatagtcacatctatcaatgatcttagctagatcttctggacaacttgctgcagcttctccatcagcacttttgcttcaccttgcatttttttgttatggagatggcttctgtacttaaacttcatgaaccaacctccactagcttccgtcttttcttctgtagcttcctcacctctctcagccatcatagaattggagagatttaagacctgcctatgaattaggctttggcttaagggaatgtggtagctggtttgatcgtctatccagaccacttaaattttcctatatcagcaataatcctgtcttgctttctttatcattcatgtgtttactggagaagcacctcaaacttctgggttcaagtgatcctcccacctcagcctcccaagtagctaagactacaggtgcgtaccaccacatcaggctaacttaaaaaaattttttatagagacggtcttgaacccctggtctcaagtgatcctcctgcctcggcctcccaaagtgctgggattacaggtgtgagccaccacgcccagcctggagtagcacttttaatttccttcaagaacttttactttgcattcacaacttggctaaatgtttggagcaagtggcctagctttcagcctatcacagcttttaacataccttcctcactaagcctaaccatttctagcttttgatttaaagtgagagatgtgtggttcctcctttcacttgaacacttagaggccattgtagggttattaattgatctaatttcaatattgttgtgtctcagggaatgaagaggcccaaggtgaaggagatgggggaacagtcagaacacacacaacatttattgattaatttcactttcatgtctgagcatggtttgtggcaccccaaaacaattacaatagtaacatcaaagatcactgatcaccataacatataataatcattaaaaagtttggaatattgtgagaattaccagaatgtgacagaggcacaatgtgagcacatactgttggaaaaatggcactgatagacttgattgatgtagggttgccacaaaccctcaatttgtaaaaagtgcaatatctggcaatatctgcaaagtgcaatacaatgaggtgtgcctgtactattactcttagagaatgacgggaatagaacactaaagaagggtagatattaccctgactttctgaaatggaaaaagacaagacaagatcctcacaattgcaggtaaaattgatgctaattcctgacaaaattctggaattgacttttaaacagatgggttagaaacatttattgaaaaggaaggagtctctgttttcttagagacaaatagtcacatcatctgcttaaacctgttttccttttttgtgtgtgagcattttatttgggaaatgattatagattcacagaaagttatcaaaaaaaatgtgttttcctttttgatggggtaactaggccggtggatattagtatcttgatttcagtgatatgtttgtggaagtctcatagcatttcctgcattgctattttttaggtaggccttttgtttcacctaatagccaagcatttttaagagcagaattcacatctgttttatctctgtgtcacccacaaccctttgcacatgaaaggtgttatttatttatttatttattgctattgaataagatccttcctaacaagatagaaaaatgccagctgtctgtacagtcaggtgggtctacaacgtggtgaaatatacttggagaaggtttattaacagatcagtgtcaacctggaaacatgctatgcctcagtcttttgccctggtccaaatagcttatcagtatcttgaaagaagacacaaaatcaggagggacataattaagattcagaatcaccctggtttggaccctgtgctaaactgataaaatgaaatagagtagggtttcatagggggttcaagggaccaactgtacaaagacaggatgtagggagacctggattatctgcttgccagtcagaggtttgattccatgagggatctcctaagaaagtgaacacggccctagcctgggctaggattgaaagaagggagaaggctggattgaaatgattggttccaacatgcaggagagaccaaaagccagtgacaacaaaaaagaaaacaagttttaaaggaatacatatgtagtacgatgacaccatttacaaaacattttatattgcttaacaatatgcaaattactagcacaggaataaatacatacctatgaatgataaacaagagaagatatataggaggctttggctatttgagaaatgtgtcatttcttatggatattcattatattattctttatgccttttgtgaacctgtagtaaattttattttattttttagatacagggtctccctatgttgcccaggctggagtacagtggctattcacaggtgcagtcataatgcagtacagcctgaaatcaattttttttttttttgagatggatctcacactgtcgcctgggctggactgcagtggcacgttctcggctcattgcaacctctgcctcccgggttcaagccattctcctgcgtcagcctcctgagtagctgggattatgggcacccgccaccatgccaagctaattttttgtatttttagtagagatggagtttcaccatgttggccaggctggtcttgaactcctgaccttgtgatttgcctgcttcggcctcccaaagtgctgggattacaggcatgagccaccacacccagcctgaaatcaatttttaaaaattatagttgtggaggtttcaacaaaagagaatggtttaaaaaacaccccaaatagtggtagttgtcttgagatggagcaagttgccttatgaaggagtgaggtccctatcagaaaagatgacctgttagacatgttctagagcaaaggctggcatgctacagcccttggataaaatctgtctattgcctgttttttatatagatttattggaacacggccacgcccacttgtcaatggctgcatttgcaccataagggcaaaattgagtagttgcatagttgagactataaggcctacaaaacctaaaatactatttggcactttgcagaaagaaattatcacattgagttgaactaaatgagctctggttttctaaaagggggacagggtcagttggtagagactataggtgaaaatctgtacaacaatttcagattagtttttatacttaacccttactcaaaccaaaagattacttgccaatctaagacggattccatggttttgacttataaaaagaaatctagcacaatgtgtggcatagagacacccaagtatttactaaatgaatgaattgtatattcaagtgaccatgctttctactctcaccccaaagaagccgactgtcaacccctcttgctggccatagcagattggacaaggggtgggccctggatttgagcagcaatcctgtctacccagcaacctacagaacttctggatatgaaaagatgagctggacctttcacaatctctctcacagaaatttgaactaaaagtatccaggctaggagtattagctcatccctgtaatcccagcactttgggaagctgaggccacttgagcccaggagtccaagaccagcataggcaacagggtgaaaccccatctctacaaaaactacaaaaaaattagccgagcatggtgatgcaggctgagtagtcgcagctactcaggagacagaggtgggagaatcacctgagctcagggaagtcgaggctccagtgagccatgattgcaccactgcactccagcctgggcaacacagtgagaacctgtctcataaataaataaataaataaaggtatgcaaaaatagaggagttaatggttgtaatcagagctgaaaaatccaatatggagagaatggccttgaaatggctgtctttaccctcaagatgtcttagactaaccagaaaagcccttaggggggagacttatacatgcacctaacatatgtaaatccaactagaggccttgggcaaaatgaaacaaaaggtgagaatggtgtgggggattcaggccactgctaaaggttgaaatctacctggctgtggaccacaattcacacctttacacaaaggggggtgagggttgaggggttctccattgctagagactctccactctccgggggctcaagtggttcatactagaagcagccattaccacaggctcctgggaagagagacaggggccctgggtacccacttcatctcttacgccccttctgagcccagcttccactctctgagggtctggctggcctcttctgactgtgaccctcccaattttaggcaggtaggaaggggtctgcagagcccgctcccatgctcatggcctctccccaggcctactcctccgatacagcgccaacgaggcccaggccctgggaggcaaactgagacccctgacctttaggccacgttggaaggtggagatggacagcagggccaggtcttgctgctcctcagcgtagcgtaccaggtacacatagacaagcttcttcaccttggggagagcacgtttctcagcagaacgcttctcagcaggcacctgtgcccacccccctacccctgggatgtcatctccccagccagctgcggtccatggggacaaactctcccagtgggggagagcacccctgagtgtatccgggtcctttaccttgatccacatccagttcagggacatggagacagtgtcttctcctggctcagagacatttctcagcaggtcgggcccccaggggctaaatcatttccttcctcaccccaagcttgagtgtggtcctgggggaggtggggacaagcaatccctcaccaggtagtgctcacctctatgttcttacaggccacgttcttcaccaccgcgggaaacaggtctgaagcattctttcctcgggcaatcatctgggtggtggggtcaaggtaggggaagagggacaaagcgagaggcacagcactaactagagggaaggtctacaaggagctaaggagagctgctcttggccacccaggccccgcccggagggaggcctcctccttcccctcttaccgccacaatcctcttcatggcctccagcttgagagaatccttgttggtgtccagcatctccttcaggtcatcatgcctggtgggaggtacaagaagtcagctgagggcacaagggtggggatggggtattaatcaggagggtccaggcacaaagaagggacatggccaggggaggctcaggcaggacctgacccgaggagggaccagagccagggggaacaagtaaagtacagatcaggggaaacatgtggccagctaatattgtgggttgaactgtgtccttcctaaaaaggatatatttaagtcttaacccctagtacctcagaatgtaaccttatttggaaatagagttgttgcagatgtaattagttaaatgcaatcctactctaatagagtgggtctctaatcccatgtctggtttcccataagaagacagccatgtgggctgggtgtggcggctcacgcctgtaatcccagcactttgggaagctgagacgggaggatcacttgagccctggagttcgagaccagcctggcaacatggtgaaacaatgtgtctacaaaaaatagattaaattgaaattaaaaaaacacaaaaaacaaaagacagccacttaaagagacagacacagggagactaccatgtgaaggcagacgattggaaagatgcgtctacaagccagggaatgccagagactgccagcaaacaaccagaagctagaaggggcaaagaaggatttccctatgggtttcagagggagcatggtcctgccgacaccttgagttcagacttttggcctccagagctgtgagacaattcatttctgctgttccaaccaacccaattgttgtacttttttttttcaattactaaactttttttttttaattatacttttaagttctagggtacatgtgcacaacgtgcagctttgttacatatgtatacatgtgccatgttggtgtgctgcacccattaattcgtcatttacattaggtattcctcctaatgctatccctccctcctcccccaacgccacaacaggccccagtgtgtgatgttccccaccccgtgttcaagtgttctcattgttcaattcccacctatgagtgagaacctgcagtgtttggttttctgtccttgcagtagtttgctcagaatgatggtttccagcttcatccatgtccctacaaaggacacgaactcatccttttttatggttgcatagtattccatggtgtatatgtgccacattttcttcttctttttttttttttttttttttttttttgtgagatggagtctcgctctgtcgcccaggctggagtgcagtggcgcaatctcggctcactgcaagctccacctcctgggttcatgccattctcctgcctcagcctaccgagtagctgggactacaggtacccgccaccaccacgcccagctaattgtttgtatttttagtagagacggggtttcaccgtgttagccaggatggtctcgatctcctgacctcgtgatctacccgtcttggcctcccaaagtgctgggattacaggcatgagccacgctgggattacaggcatgagccaccgcacccagccatgccacatgttcttaatccagtctatcactgatggacatttgggttggttccaagtctttgctattgtgaacagtgctgcaataaacatacgtgtgcatgtgtctttatagtagaatgatttacaatcctttgggtatatacccaataacgggatcactgggtcaaatggtatttctagttctagatccttgaggaatcgccacactgtcttccacaatgggtgaactagtttacactcccaccaacagtgtaaaaatgtttctatttctccacatcctctccagcacctgttgtttcctgacttttaatgattgccattctaactggtgtgagatggtacctcattgtggttttgatttgcatttctctgatggccagtgatgatgagcatttttcttaaacgtttaaaacatatttttaagcagaatgggccaactcagtcacagtaactgttgatctccatagcagagcaacccacaaagacggaactgattttttacccatattcaggagtgaaaaatatacaacttgtttctgaaccaaaaccacaatttctgcagtttaaaatgtttcactgctaatatggccctggtagaaagtatgtagtttttttttcttctttaaaaaaaaaaaattaaaataatttcctaagacgctaaatcctcaatctggaatgcagattctgagcacaaagcagctcagttaacctaaaaaataaagaaaaaattcccatcacctgtctcagtagggcctgaaaggagagaagtggtgtggggaaccccggctttagtatggagagtcacggccccttgacccaaaccgagactgtgagtagccatagctggtgcttctctcaggataaactcagatgtaggaagtttcactatcatgagagtggaatttagtgtcatccaatttatgcagggcatattccatgtcttcttttctgagatactcaaccatccccacaccgtccttctgcacatcggcataacagacatccccaacttctcgcatgtgatccttcaggtcctgccagctgcctgaggaagtcctgaaacaagaactcggaaatcagatcttcttgcagaaggcccattcctcccaccacggggccacccaccccgacttcgtaagtcctggagaactccacacgaagccgacactggccataatcataactatttcttccataaatagcatcctctgcatctcgggggtcctcaaagcgcaccaaggcgaagggcacaaggcagtgcccattcttaagcttgatcttgcggatccggccgtacttgtagaaaaggtcttccacgtccttctcgcgcacgttggaaggctcaccacgcagatgcgctcatccgcccagcccaacatcggcacctcccaacgccccctccccgcaatccccccgcagcgtccccgcgggctctgaggcgctcagccgcactgcactgtgggaacgagaagcaattgtggtacttttgatacaggagtgtaggaaatgaatgtagccagaaacagagagccaggaaacaagaggaagggtttggggtgggaaagtatggacctggctcagggaaaaggactagttggatggataagaaggaccagcggaaaagaggtagatgccaaaacaagagcagggtgcccttgccctgcctccagtatgtttccaagtcctgacctctcagaccaaactgattccagggactggaagggtcccagagactccatagatggcctcacaacaaaagccagacctgtcactgaacattgaacagccattcaaggaagtcattaaactctagtgggatgaataaagatttgagtaagtgatcccttgcacttggctgagaggaataagggtaatgctgagccaatacacaggtttctttttttttttagatctcatacttcatttcaaaaatttgaaatttcaaagggaacattttgtcaaacttaagtgacagcaaaattcatctggaaaaaaaaaatcagtaggtaagaactccaaagaatatttttgggaaaagaaggaaacaatcatagacaactcaccctattggacttcaaaacataaacaccacgagacgatgataaaagctgtttggtaccaggttaaaaacagaaggtcaaaggtcatggggggaatttcataaaaggtctaacttgataaattacgaaccaataagaatctccccccgcccccacccccccgcccccgccccacttaaataaatgctattgggacaactgctttgcagcactttttttttttttagatggaattttgctctcattgcccaggctggagtgcaatggcacgatctcgggtcactgaaacctctgcctcctgggttcaagtgattctcctgcctcagcctcccaagtagctgggattacaggcatgcaccaccacgctcgggtaatttttgtatttttagtagagacagggtttcaccatgttggtcaggctggtctcaaactcctgacctcaagtgatcttcccgcctcatcctcccaaagcgctgagattacaggtgtgagccaccacacctggccagcagcaaataatttaacttgtatacatatttcaccccaaaataaatcccgcatttgcttaacagttaattatttttaaatacaaaagaaggaagggaagattttattaaggtcataaaattattagcagcaacaatatggctaggtttaattggtacgtttttgttttttgagacagagtttcgttcttgttgcccaggctggagtgcaatggtgccatctcagctcactgcaacctccacctcctgggttcaagcaattctcctgcctcagcctccagaatagctgggattacaggcatgcgccaccatgcccagctaatttttgtatttttagtagagatgaggtttctccatgttggtcaggctggtctcaaactcccgacctcagttgatccgcccacctcagcctcccaaagtgctgggattacaggtgtgagccactgcgcccaggcctttttttcgtttttctgtttgagacgaagtctcgctctgttgcccaggctggagtgcagtggcgcaatctcggctcactgcagcctcaacctcctgggttcaagtgattctcatgcctcagcctcctaaatagctgagattacaggtgtgcaccaccatgcctggcaaattttttgtatttttagtagagttggggtttcgccatgttgaccaggctggtctcaaactcctggactcaagtgatttgcctccttcggcctcccaaagtgctgggattacaagtgtgagccactgtgccaggcctaggtttaatttttaaactttggtatctaaaaactaaatttatgagaaaaataaggcaactatactagcttcctagaaccaccataacaaagaaccacaggccaggcatggtggctcacacttgtaatcccagcactttgggagactgaggcagaaggattgcttgagctcaggagttgggaccagcctggacaacatagtcagatcctgtttctacaaaaataaaaaaaattagccaggcatggtggcacatgcctgtagtcacagctactcaggaggctgaagtgggaggatcgcttgcaccaagatgttggaggctgcagtgagctatgattgtgctactgcactccagcctaggcaacagagcaagaacctgtctctaaaaaaaaaaaaaaacaagaagtactacagatggtggcttaaacaacataaatttatttgctcacagttctggaggctggaaggctgagattaaagtgtcagcagggttggtttcttctatagcctctttctttggcttgtagatgattcttgtgatattgtaaagaaatatatatttggtctctataccccatttctgagacagagctcctaaaactcttgacaatagggatgctaggagaacttctgttctaatatttggtcttccacccagttcctcacgcagagatcctaagacctttataacttcctgagtgagaggaacaactgacatggaaatcccttggaatttcctgggtgatagaagcatcttttgttatcagatggttggaactttttttctttctttctttttttttttttttttttgacactgagtcttgctctgtcgcccaggctggagtggtgcagtgaggcaatctcggctcactgcagcctccaccttctgggttgaagcaattctcctgcctcagccttccaaatagctgggactacagttgcccaccaccacacctggcaaatttttgtatttttaatagagatgggtttcatcatgttggtcaggctggtctcgaactcctgacctcaagtgatccacccgccttggcctccaaaagtgctgggattataggcgtgagctgctgtgcccagctgagggttgaaactttcaatcccactatttgacctctggggaatggggagtggggctgatggttgagttgatcacatggccaaagatgcgatcaatcatgaagccttcataaaaacccaagaggatagggtttcgagagcttccagactgtggaacatgtgaaggtgcctggagggtgtggtgcctggagagggcatgggagctctgcacccctccttccatacctctccctatgcatctcttcatctggtgtttgtctctaccctttataataaatgggtaaatataactaaagtttccctgagttctgtgagccactcacagagttgaacccaaggagggtggcatgggaacccctgatttatagccagttggtcagaagtatagctgacaacttaccacttggaattggcatctgaagcagagagcagtcttgtggcactgagcccttaacctaaaaaatctaacactagattgacttgaattagagaacacccagttagtgtctgctggagaacaggttgttggtggggagaaatctccacccatttttgtggccagaggtgaagcactctctggtgagcggtgtgtatgagagtaggagaaacacactttgggtttttctgtctcttacaaccatcttctctgtcttcacatggtcttccttctgcgtgcctatatccaaatttcctcttcttataaagaaatcagtcatattggattagggccccccttaataacctcattttaacttaatcacctcaaaggtaacattctgaggtactgggggctagaacttcaacatatgcattttggagggacacaattcagcccataatagcaacaaaaggaaaaatatttgggatatggtaaattaaagtttaatattcgaaatagaggccaggtgtggtggctcacgcttgtaattccagcacttttggaggccaaggtgggcagatcacttaaggtcaggagttcgagattagcctggccaacatggtgaaaccccatccctactaaaattacaaaaattagccgggcatggtggcacacacctgtaatcccagctactcaggaggctgaggaacgagaatcgcttgaacccaggaggcggagattgcagtgagccgagatcgcgccactgcactccagcctgggtgacagagtgagactccatctcaaaaaaatttaaaaaaggaactgatatacatgtataaggtctctttgcagcattcactgtcagggctgctacaagcccattttcaatctgcatgcccctacagatagacacagccctgagctgttgctccccattctgtgtgtggagcatgggctggtattccttggccagatgcccttgtgcagtgaacaatgtggctaaccatactcagaggatgcagaactggtgatcacgaagtgatcagagaattgttaataaacccatgaaaaaaatgtgtctatatatagctgatagaattgtgtgaaactgatgcactcatatgttgccaagacaattccaaaatgtggtgagcagctgtgtgtggggactcacacacactaatttcccagatgacactctgataacccacagctttgacccaggcacaagaacccagcttgagaaatatcacagtgataaaaattaaaaatcaggccgggcacggtggctcacgcctgtaatcccagcactttgggaggccaaggcaggcggatcacaaggccaggagatcgagaccatcctggctaacatggtgaaaccccgtctctactaaaaaatttaaaaaaaattagccgggtgtggtggcgggcgtctgtagtcctagctactcagtaggctgaggcaggagaatggcgtgaacccaggaggtggagcttgcagtgagccaagatcgcgccactgcactccagcctgggcaacagaacgagactccatctcaaaaataaaaaataaaaaaaaaatcaatgtgtgcaaagttagtcacagacatgcaacatttagaaatgacagaaaatcagaaattggggatagcactgttaggagaggaaagagcatgataacaatcataaagtggcaaatgactgctgctaatgctgagaaacaagtgatgaatgctgagaggaagagaagaaccagacagaacacgcaacttagtcacagggctgcagaaatgcgtgagtacctgacgtcagacaagaagaggggcactaagaagtcactatcccaagaatgttagaaactgtctttcccaaagagatttttgatggaaagcaaaatagaaagatgatgccttccagcattatctgaggccctcgctatctgtcatgtgaggacagaagaaaatatccagccccatcatgttatctgaaactccctcacctggggggatgccccccaaatcagaggacaccttctactcttccagggtcaggccagggccagaagacaatcaccctcttaccctgccaaacacagaccagactgttgagtttcttagtgggtaggaggctgagctcaggacaccaggggcatggtcataggtacagaccattgagctgggtaggcgtgggcagcaccgagggcctaggaaaaatgacagagctgggcaccagcttccctgagatatgaatgcacaacactccacgtcaggatccttcatacgcacaccccacagacaactacacattgataccacccacatatacctcagacactcccatgtcccccgacatacctacacctcacggacagctcatacaaacatacctacaggtcccgcagacactagtagaatccatacataaacccacgcacacccacaaaatcctgcctacacaacgcccagagaaacacactcccccacatacagacacctcccacagaaaaactctacacacataaaccacccacacaactcacctacacacctacaaaccccccagacatataccaccaggagacctctccccactctcccacaccctcttatagacacacatatcccatacatgtcccctacagacatatatcacaagacctctccccgctcccccacaccctcatagagacacacacaccccacacacgtccccctacacacacacacacatgccgcatcacatctaatacacagataacttggaccaaacttggcctctccagtctcattcaccaaaatggtcagtggactcctagttgagatttttgatgataaatgtaggcttctaagatcaaatatatccagccccaagggtcctctgatcttctgaggagtcaccctgggatggcttttccctgggcttccgtggaaggagggccaagtttgcccaatctcctttaactctgggtattcccttcctcaccacacccacaaatgccacatgcgcctgtcaaatgcacacaccccagggcatcctccccacccagcctagtgagtacattccaggcccctgcaggagaaggggaatgaaagggggcaggaccactgggcctaaagcagccagcacaggtaagattgactgtcgaatatgcactgacacagaatatgcactgacacagaccgcagccaccacctgaggtgagaccgccctgggcctctcgtcctcactcccaccaacttctgttcccaagaggcagaggcagggactaaggcacaacaccctaaggccatgaaacattatctcccatagtcagatccccttacgctgctgcactcactctgacctgacccctagtctgacctagcctaagggactcttctgggggtggctggagccagccagggggcctggcatggcactgggggtcagtcatgctcacctcccttgatatacacctcgctgtcacctcttaccacctaagttccagtccactggcaggcagtggctggccaaaccctgtctgtgctgtatcctgtccccaaacctcgtccagagcccactccagtgggggcctgtggggagaaagaggtcaaggtgggacctcaaccctcaaatattttactatcctcctcccctcagagcctccagggagttaagcccctcatctctcctcactcataccctcagcccccatacggtgcccctgaccaccttctccgcccagcctggaccctaaatgccagcctaagcctccatcagaggaggtgggaccggaagaggtctgggctgagagtgcaactgcccatccctggccttcctggctgtgtgggtagggggttcctgtgggttcctctataccgtagtggctggctctggctctggctggcctctgggcaaggtccttccagagatgcttctggggtcgtgtcttcctcctgggcctgcagccaccgaagctcctcaggctccaaggcctggtaccggagtgggggcccaccttcgggagccagcacagggctagcagcctcttgatcagctccgcaggcccctctgaccccaggcctcaccacggcccccgggagctgcaggaatcgctgcatcaggttcttctccaggaatggactgagctggccagggcgctggggctcctgtcacagtcaccagatggcccgcccccaaaacttggtaaccggacactggcagggagggatgctccggtttcctcttcactgctcagagacaaggcctctagagggaaagaagggcagggacaggagaccaagcctacccctagtctctgggcaagggactagatggtcagtggagttgatagagaggtgagagatgccctcttcagctccaatcccactgccacaattagactgcagcctcctgagaaatctcatataccctcttctcactgaccctaggcatcttaatcctcacctgcctttccagagccaatacttgatttattccttcccatcaaccttctcttatctctacttcctcctagcaccctcccccgcaacccctgtgtctatccctccaactgctctcacatccttggccctcttgtcccactggtctccaatgccactggcctgccagtggtgggtggcttttttttttttttttttcagatggagtttcactcttattgcccaggctggagtgtaatggcgtgatctcggctcactgcaacctccgtctcctgggttcaagcaattctcctgcctcagcctcccaagtagctgggattacaggcatacaccaccacacctggctaatttttgtatttttagtagagacggggtttctccatgttggtcaggctggtctcaaactcccaaccttaggtgatatgcctgcctcagcctcccaaagtgctaggattacaggcgtgagccaccgcgcctggcctggttggctttcttcattgtatttgaaacccctttgaccctcaagtccccattcccagccttgcccttatggcttcaccacctggttcccgaaaaagggaaagtctttagatgaaatcccctgcagccccctgccccagactcccatccatctgcatttatttacttatttatttatttagagatggagtctcactccgttgcccaggctggagtgcagtggtgccatctcggctcactgtaatctccacctcccgggttcatgtgattctcctgcctcagcctcctgagtagctgggattatagacatgcgttaccacaactggctaatttttgtatttttagtagagacggggttttgacatgttggccaggttagtcttgaactcttgatttcaagtgacctgcccgcctcagcctcccaaagtgctgggattacaggcatgagccactgtacccagtctccatctgcatttatactctcctctcctcctgccctcttccctctgggcagagttggtcctccctgctcccaggctagtcctcccacccagctcagtaagcctcccctcccatcactcagtgttctgtacttcctttcttcccttcagcctctctcccaccaatcgctccttcccatcagcagttaaacttgctctaggctctcccgcctaatattaataataaacaaaaatatggagtcatacattttaagaaacaaaaaaaaaaacccaaaataacaaaatagacaaacttccttgaactgagtgaggttctcctccagcagctttctcttttacagtcaaatttcttgaaagcaaaatttccattcactgttttatctacttaccacctgtgtgctcctttattcattttaatctggctttagatgtcgacttagaatgtggggttgaagggtcatgatctctgcaacttaacatggttcaaccaaaaaaagtatacgaatagatggttagataaagcaaataaggtacgatgtcaatgacagttgaatctagatggatgatatacatgtgttcattgtattattcatttcatttttctgtatgttttaaatcatccacaacagaatgctgggaaagaaataatctagctcctgttctccttactttgccagaatttatctcccagggcaggaggtggggaatagagtagaaaggaattgagctcttctttgtcaaccaatggtcatgatttttttccttgtttgatttgaccttaatgggcattgaaactactgaccactccctccttcttgaaattacattgttttctttcagcctttagttcacctcttgggtaccttgaaacactttccactgttctctggtcacttctaatgttggtgtcttcagggttcagacttgtgcagtgtctgaactcattttatacctcctccctgagttatcttcacttctgtggctttaattaacatacatatgttaataattccctaatctctctcctggaacccaaatcgtaatatccagctacctaatagggtaatatgtccctcagagtttacaatctcaatatgtccaaagctgggctcaacattaattttccacaaatttgcttgtaacatctttatttccaattacactgaataacaccatcatccatccagttgcaggaactagtaacctgagtaacatccttgtcaggcctctgagcccaagctaaaccatcatatcccctgtgacctgcacgtatatatccagatggcctgaagtaattgaagaatcacaaaagaagtgaaaatggcctgttcctgccttaactgatgacattaccttgtgaaattccttctcctggctcatcctggctcaaaagctcccccactgagcaccttgtgtcccccgcccctgcccaccaaggaacacccccctttgactgtaattgtccactacctacccaaatcctataaaatggccccacccctatctcctttcgttgactcttttttcagactcagccggcctgcaaccaggtgattaaaaagctttattgctcacacaaagcctgttgggtggtctcttcacatggacgtgcgtgaaatttggtgccatgactcggatcgggggaccacccttggaagatcaatcccctgtcctcctgctctttgcttcatgataaagatccacctaatgacctcgggtcctcagaccaaccagcctgaggaacatctcaccaattttaaatcaggtaagcggcctctttttactctcttctccaacctctctcactatccctcaacctctttctcctttcaatcttggtgccatctttcaatctctcccttctcttaatttcggttcctttccttttctggtagagacaggaaatgcattttatctgtgaacccaaaactccggcgccgatcacggactcaggaagacagtcttcccttggtgtttaatcactgcggggacgcctgcttgattattcacccacgtttcagagttgtctgatcaccgcgaggatgcctgccttgatctttcacccttagtggcaaacaccactttttggggggcaagtaccccccaccccttctctccatgtttctaccctctcttttctctccacgttcctgggggacaagcacccccgactccttctctctgtgtctctaccctctcttttctctccactttcctggggggcaaagcaccccccaccccttctctccgtgtctctaccctctcttttctctgggcttgcctccttcactgtgggcaacattccaccctccattcctccttcttctctcttagcctgtgttctcaagaacttaaaacctcttcaactcacacctgacctaaaacctaaatgccttattttctttgcaatgccgcttaaccccaatacaaactcaacaatggttccaaatagccagaaaacggcactttcgatttttccatcctacaagatctagataattcttgttgtaaaatgggcaaacagtctgaggtgcctgatgtccaggcattcttttacacatcggtccctccctagtctctgttcccaatgcgactcatcccaaatcctccttctttccctcccgcctgtcccctcagtcccaaccccaagcgtcgctgcgtcttttcaatcttccaatcttccttttctaccgacccatctgacctctcacctaatccccagaatgctcctcaggtcactccccaccaggctgaatcagactccaattctttctcagcttctgctcctccaccctataatccttctatcacctcctctccccacacccagtccggcttacagttttgttctgcgactagccctccccaacctgcccaacaatttcctcttaaagaggtggctggagctaaaggcatagtcaaggttaacgctccttttcctttatccgacctctgccaaatcagttagtatttaggctctttttcatcaaatataaaaacccagcccagttcatggctcgttgggcagcaaccctgagacgctttacagccctagaccctaaaaggtcaaaaggcagtcttattctcaatatacattttattacccaatccactcccaacattaaataaaactccaaaaattaaattccggccctcaaaccccataacaggacttaattaacctcgccttcaaggtgtacaataatagagtaaaggcagccaagtagcaatgtatttctgagttgtagttccttgcctccactgtgagagaaaccccagccacatctccagtacacaagaacttcaaaatgcctaagctgcagcagtcaagcattcctacaggaccttctccatcaggatcttgcttcaagtgccagaaatctggccactgggccaaggaatgcccacagcccaggattcttcctaagccttgtcccatctgtgtggaaccccactggaaatcggactgtccaactcacctggcagccactcccagagcccctggaactctggcccaaggctgcctgactgactccttcccaaatcttctcggcttagcagctgaagactgacactgcccaatcgccttggaagcttcctggaccatcacagatgctttgggtaactcttacagtggagggtaagtccgtccccttcttaatcaatacggaggctaccaactccacattaccttcttttcaaaggcctgtttcctttgcctccataactgttgtgggtattgatggccaggcttctaaacctctcaaaactccccaactctgaggccaacttggacaatactcttttatgcactccttttcagttatccccacctgcgcagttcccttattaggccgagacactttaaattatctgcttccctgactattcctaggctacagccacacctcattgccaccttttcccccagttcaaagcctccttcacatcctccccttgtatctccccaccttaatcctcaagtataggacacctctattccctccttggcgactgatcatgcaccccttaccatcccattaaaacctaatcacccttaccgtgctcaatgtcaatatcccatcccccagcaggctttaaaaggattaaagcctgttatcactcgcctgttacagcatggccttttaaagcctataaactctccttacaattcccccattttacctgttcaaaaaccagacaagtcttacaattagttcaggatctgtgccttgtcagccaaattgttttgcctatccaccccgtggtgccaaactcatatactctcctcctcaatacctccctccacaacccctccacaacccatcattctcttctggatttcaaacatgctttctttactattcatttgcacccttcatctcagcctctcttcgctttcacttggactgtccctgacacccatcaggctcagcaaactacctaggctgtactgccgcaaggcttcacggacagcccccattacttcagtcaagcccaaatttcttcctcatccattacctatcttggcatagttctcatgaaaacacacgtgctctccctgctgatcatgtccggctaatctcccgaaccccaatcccttctacaaagcaacaactcctttcctttcaagggatggttaggtacttccacctttggatacctagttttaccatcctgactaaaccattatataaactcacaaaagcaaacctagctgaccccacagatcctaaatccttttgccactcctttccattccttaaaaacagccgtagaagctgctctcacactaggtctccctaattcatcccaaccctttttcatcacacacagccaaagtgcagggctgtgcggttggaattcttacacaagagctgggaccacgccctgtagcctttctgtccgaacaacttgaccttactgttttggcctagccctcatgtctgcgtgcagcggctgccgctgctttaatactttcagaggccctcaaaatcacaaactatgctcaactcactctctacagttctcataacttccaaaatctattttcttcctcacacctgacgcatatactttctgcccccctccactacctctcagaaagcttaactcattgccttaactcgagccctcagtcttgcaaaaggactatgtgtcaatatttatactgactctaaatatgccttccatatcctgtacctccatgctgttatatgggcaaaaagctttcctcattacacaagggtcctccatcattaattcctctttaataaaaactcttctcaaggccgctttacttccaaaggaagctggagtcattcactgcaagggccatcaaaaggcatcagatcccatcgctcagggcaacacttatgctgataaggtagctaaaaaagcagctagcattccaacttctgtccctcatggccagtttttctccttctcatcagtcactcctacctactcccccaatgaaacttacacctatgaatctcttcccacacaaggcaaatggttctcagaccaaggaaaatatctccttctagcctcacaggcccattctattctttcgtcatttcataacctcttccatgtaggttacaagccgctagcctgcctcttagaacctctcatttcctttccattgtggaaatctatcctcaaggaaatcacttctcagtgttccatctgctattctactactcctcagggattgttcaggccccctcccttccctacacatcaagcctggggatttgcctctgcccaggactggcaaattgactttactcacatgccccgagtcaggaaactaaaatacgtcttggtctgggtagatactttcactggatgggtagaggcctttcccacagggtctgagaaggccactgcggtcatttcttcccttctgtcagacataattcctcagtttggccttcccgcctctatatagtccaataacagaccagcctttactggtcaaatcacccaagcagtttctcaggctcctggtattcagtgaaaccttcataccccttaccatcctcaatcttcagaaaaggtagaacggactaatggtcttttaaaaacacacctcaccaagctcagccaccaacttaaaaaggactgacaatacttttaccacttgcccttctcagaatttgggcctgtcctcggaatgctgcagggtacagcccattcaagctcctgtatagatgctcctttttattaggccccagtctcattccagacaccagaccaacttggactgtgccccagaaaacttgtcatccctactatcttctgactagtcatactcctattcaccatactcaactactcatacatgccctgctcttgtttacactgccggtttacactgtttctccaaaccattacagctgatatctcctggtgctatccccaaactgccagtcttaactccctcttaaagtaaataaataatctttgctggcagggctatgctgaacctccttgggcactctctaattggatgtcctgggtcctcccaattcttagtcctttaatacctgtttttctccttctcttattccatttagtttttcaattcatacaaaaccgtatccaggccatcaccaataatcctatacaacaaatgtttcttctaacaaccccacaatatcatcccttaccacagaatctgccttcagcttaatctctcccactctaggttcccacgccaccccaatcccgctcgaagcagcccttcaaggctatggagaagcagtatctctccataccaccccccgccaaaatgtttgctgccccaacacttcaacactattttatgttatttttcttattaataaaagaagacaggaatgtcaggcctctgagcccaagctaagccatgatatcccctgtgacctgcacgtatacatccagatggcctgaagtaactgaagagtgaaaatggcctgtgcctgccttaactgatgacattatcttgtgaaattccttctcctggctcatcctggctcaaaagctcccccactgagcaccttgtgtccccccaccgccagagaacaaccccctttgactgtaattttccactacctacccaaatcctgtaaaacggtcccaccccatttcccttcgctgactcttttttcggactcagctggcctgcacccaagtgattaaaaagctttattgttcaaagcctgtttggtggtctcttcacatggacgtgcgtgaaaatcctcatcttctccccctgtccctctaaacccccacccaatatccaattaatcatcaggtctgaggcttccacctcttccacagcctcaaatcttctgcctctcccctggtctaggccacaatcatgccaggcctgtgaacttcaagacccacctcccttgtctcttgttcaatctggcccacctccaatctcttctccacaatgcagcagcctgacgtccttctaaaatataaatctgattatgtcgcctgcttagaatccttcaggagtcctccccaccctcttttctggtcagtccagtggctcacacagattgtggcctggctctcaaccttcctgaaagccctttcctctgcctggaacatacctcacgctcctgtcttccttctctccggcgccagagactaggtcctctccctgctcccactgcccccattacactcgactgtccctgactgcttcttcatctgtgctcccctctagagcatcgtgaggacaagaagggtctcatgttcacagttgtattccgtgactagttcaggactcgacacagttggcttttcataaatgcttgttgcagaatttacgaataaacaaatgaagaaacaaacgaacgaatcaaaggtgggggagggtgtgaaggtggagctgaactacaggggcaatgccaggagcagggatgtgagggtcagatggagatggggaccagagggaggggaaatgaatttgcagcagggccaagctgggaggctgtgcaagtacatccagggcccgccttcctgaagaggccccaggctcaagctcaagttcgctgactcagacccctcccccacatttttgggaagccaacccgcctagcacgaaaaaggaagggaacccctaacgcaacgccgcaaaccggagaaacacctggaaccggagggtttctcctctcgaaactgagctggcccatcccccgccagcccctatctgcccccctccgcgtcctaggccggcccctggagccggggtgccagcgctgcccgcgctgggccggggctccaggccgcaggagggggccgggcgggcttccggtcggcgcggccggggcggggccggcgctggggccgggcgctgtccatggtgcccgcgcgcctcgcccggtccccggccccaaccctcccgcgagcttcctggcgggctccctcaccgcttgtagtcggaggagaagatgccgccgctcgcggggtcgtggccgtactcgggctccccggggccagcggagccgcccttgtcttcgctgtaggcgggggcggccgacatggggcggccagggagacttcgccgaggaggaggttgcggggccggaggccggctggagcggaggaagggaaggcgggccggtccggtccgggctggcgaaggcggcggcgcggcaggggttcagcagaggctgcagtgtgcagcggcggaggctgcgcgcggatttctcaatcaggg

SEQ ID NO: 1528 - DNA, 50570 bp, Homo sapiens
tggaaatgcctgttttacaactttattggatcatcttgacacaaaatcatgacagcagcgtgatatgtctctctctttatacgggaatgtcgatagcaaataaattcttatgtaacacatcatacaatttcaaatcctggaatcactgcatgggattctgtaatggattacatgctaaagtgacagttttcatcaaaaggagaagataaaatgtcattatctctgaagaagggtcagtcctgtgcccacgctggccgtggggagtgagcggagtctccttgccctgcctggtgggggctctgcctgtgaggtggctctcacaggtcctgcccaagggcactgggcacactccttcaacacagaacagcccaggtccgctgcttccaggccctgcctgggccttcctaagggtgctgggaaggatgtggggaaaccttggtgcgcatagtggcaagcaggggatgcggaccaccccaaacccaagccgagatgcacttctgctgaccaggaagacgggtggcagagaggcctcaacccaccccgtccacggttctgactgcaacctctctttggcgtccctggccccgccctgcccacagcctggctggcgcgtggcctgggatcccaagacccagtcaccagcccacgagcacactgacaatggacaacgcctggcaagaccgctttcccactgtgggttctgggagagaaaaccttggcgacagcggcccttccttcccctcccccggacgcaaccgtcaggacctttgggtcaaaagcaggcgaccccagaggaggccacgtcagccccgccctgtccaccaagtgcccctcacgtggtgcccatcaggccctggcccaggacaggagcccctgaagccacattcaaggactcggcccccagcgcggggcagggcacagacccaggtgggggagtcccttgctggtttgggggcgagaaggggacttcttgccaaagagaatgggaagagtcacagtaaaaaaggatggtcagataattcaacgcaacaaatgacctcggatgtctacacggcggacaacatagagttaaattaacactcaggcttgggtacagtacacacgactgaggagaggcgagacacgtcagggctgcggtccctgggtacgtgctccgcggggtggtgcggggctcgcaggcagctctcaacacttggccagcgtcgccttcatctcttctaacaagttgctcagtagcgtggagtcactgcacttcccgtcgactgagacagagttctcaccctgtgtaaggaaaaaagatggatattttaaaagtgtgtgcaggggctaggcacggtggctcaagtctgtgatcccagcattttgggaggccaaggtgggtggatcacctgaggtcaggagttcaaaaccagcctggtcaacacggtgaaaccctgtctctactaaaaatacaaaaaatggccgggtgcggtggctcacgcctgtaatcccagcactttaggaggctgaggcaggcagatcaccaggtcaggatattgagaccatcctggctaacagggtgaaaccccgtctctactaaaaatataaaaaattagccaggcagggtggcgggtgcctgtagtcccagctacatgggaggctgaggcaggagaatggcgtgaacccgggaggtggaccttgcagtgagccgagatcgcgccactgcactccagcctgggcgacacagcgagactgtctcaaaaaataaataaataaataaataaataaataaataaataaataaataaataaataaaataaaaataaaaaatgtgccgggcatcgtggcaggacacctgtaatcccagctacttgggaggctgaagcaggagactctcttgaacccagggggtggaggttgcatgtgagttgagatcattccaccacactccagcctgggcaacaagagcaaaactccatctcaaaaataaataaataaaagtacatgcaggccaggccggatggctcatgcctgtggtcccagctatgcgggaggctgaggcgggagggtcgcttgagcccaggagggtgaagttgcagtgagccgtgtttgcaccactgcacaccagcctgggcgataagagtgagttcctacctcaaaaaaattaaaaaacaaacaaaaaaacactatgtgcaaatattgcctcgcagctgtatgtgttgtccttttaattttgcgaatttgctaattattaaaaaaaaaaatgggaagggctcgggtgagggagcggcccaaggcacctgggtctcccgtgggaggggctccagcctacatagaagtgggagccggcacctgagggccctgaggcagccagaggcagccggggatgaagaccagaatccgaagagctcctgagctagcagacagttgagcactgtctgtccttccgccctcctgccactgggcccctgaagtgactgtggaagaagccagtggagtggggtaaccagagcccccagagagggaggtacgcggggaaagccaccccgtgaagctgctcacgatctgctaggctcactccatgctgcggatcccgttccaaagagcaaccgaaggcactgagtccagaggccgctgccgggtcccaaggccagggacaagaggcagcactgacaggagaggctgggcaggtggtggtgtgcttggggccacagtccccagaaggcaggggggacttgcagctgggacctgaccacccacgtcctccacaggatggaacaaggcccagaggctcacagcactccacggaaaacgaccaggagaatccactcatacagagaggccctcggcagaccccagtgccaagaccccagtgccaaggcaccaacaccaagacaccagtgctaaggcactaatggcaaggccgtcggtagaccccaatgccaagatcacatcacccagatgccaacaccaaggcaccaatgccaaggccatcagcagaccaaacaccaagacactaacacccagaccctaatgctgaagcaccaatgccaagaccccacgctcaagaccccaacaccaaggccgtgagcagacaccaacaccaagacaccaacacccagaccccaacgccgaggcaccaactccaagacgccaacactcagaccccaacgccaagacaccaacactcagactccaacaccgagacaccaacgctgagaccgcaacaccgagacaccaacactgagactccaacaccgagatgccgaaacccagaccccaacaccgaggcaccaactccaagacgccaacacccagaccccaacgccaagacaccaacacgcagaccccaacacccagaccccaatgccgagaccgcaacactgagacgccaacacccagaccccaacgccaaggcaccaactccaagacgccaacacccagaccccaatgccgaggcaccaactccaagatgccaacacccagaccccaacgccaagacaccaatgcccagaccccaacaccaagacaccaatgcccagaccccaatgccaagacaccaacacccagaccccaacgccaagacaccaatgccaaggccattggcagaaaccaacacgaagaccccaacgtgcagaccccaacaccaaggccatcagcgtaccaaggtggacggacactaggactctctgacacaagtttttttttttttttttttttttggagtctcactctgttgcccaggctagagtacagtggcacaatcagggctcaccgtagccttaaactcctgggctcaagagatcctcccaccccagcctcccaagtagcagggactacaggctcactgtactaatttcttagtactggctaatttttttaattttttgtagacctggggtcttgccatgttcccaggctgatcttgacctccagggctcaagcgatcctcctgcctcagcctcccaagtagctgggaccacagtcacacaccaccatgcccagctggcctaagctttaaagtagctgttaggaaaatgctccaacagatcaccagggcatcagcaaagacatggaagatacaagaagggcccagtgggaatttcagacctgaaaaataagaccctccctgtgtgggctcaatggcagaacagctaggacgaggcagactggtgagcttggcaagagagcaacagccatgaacccatctgaatacggcctctggggcgtgaggggcagcagcccaggctggggaggtgttgggagcaggccccccaaaatctggccataaactgaccccaaaactggccataaacaaaatctctgcagcactgtgacatgttcataatggccctaacgcccacgctggaaggttgtgggttgatgggaatgagggcaaggaacacctggctggcccagggtggaaaaccacttaaaggcattcttaagccacaaacaatagcatgagcgagctgtgtcttcagggcgtgttcctgctgcagttaactagcccaacctattcctttaattcggcccatccattcgtttcccgtaggggatacttttagttaatttaatatctatagaaacaatgctaatgactggcttgctgttaataaatgtgggtaaatctctgttcggggctctcagctctgaagactgtgagatccctgatttcccacttcacacctctgtatttctgtgtgagtgtctttaattcctctagcgccactgggttagggtctccctgaccaagctggtctcggcagggaggaagtgtgcagcacccaaaaagcagcaacagatcagctccagccgcctcaggcccagcagaatggctgccgtcagccgggcgcgggggctcgtgcttctaataccagcactttgggagtctgaggcaggcggatcaggagtttgagaccagcctgaccaacatggtgaaaccctggaaaccccgtctctactaaagagacaaaaagattatccaggcgtggtcgtgggcacctgtaatcccaactactcaggaggctgaggcaggagaatcgcttgaacccgggaggagctgcagtgagctgagatcgcaccactgcactccagcctgggcgacagagcgagactccatctcaaaaaaaaagaatggctgctgtcagcacgatgacgacaggtgaagaaacagggcctcctgcacggcagcaggcgggaaacaaagtgcagcactggggaagacagtctggcagctcctcaaaacctcaaacgtggcattaccacaggacccagcaatcacactcccgggtgtatattcagaacaaatgggctcactcctgcaatcccagcactttgggaggccgaggcaggcagatcacccggggtcaggagttccacatcagtctggccaacctggcaaaaccccatctctactaaaaatacaaaaattagtggggcgaggtggcatgtgcctgtaatcccagctactcaggaggctgaggcagaagaactgcttgaacctgggaggcggaggttgtggtgagcccttggctccactgtactctagcctgggtaacagaacaagactctgtttccaaaacaaaaaaataaaaaaaaacaaaagtactgaaggcagggactccaacagttatttgtttaacaacaatgttgatagcagcacaattcacaacagccagaaggtgggagcagcgatggatgagtggacacacagcatggtccatctgtacaacaaaatatgattctgctgtgaaaaggaagggaatcctgacagaggctgcgatgtggatgcaccttaaggacatgaggtgtaataacagcagccagacacagaaggatacattccgtgtggttccactcctaggaggtccctagagccatcagattcacaaagacacaaagtagaatacatggtgccaggggctggggaggcaacggggagtgagtgtttcatgggaggcagtgaatcaggagaaaactgaacattaggaatgaaaagaacagcaatgacaggccggacgcagtggctcacacctgtaatcccagcactttgggaggccgaggcagacagatcatgaggtcagaagattgagaccatcctggctaacatggtgaaaccctgtctctactaaaaatacaaaaaattagccggatgtggtggcgggcgcttgtattcccagctactgcggaggctgaggcagaatggcatgagcccgggaggcggagcttgcagtgagccgagaccgcgccactgcagtccagcctgggcgacagagtgagactccatctcaaaaaaaaaaaaacaaagcaagggtatcaaaaccacaacagacctctaggaacggaatgctgagtagtgaacatgagccagaagaaggcagagaagcgaaagaaacacgtgcaaactggaaatcctcagtatgctcccagagggcactggaaccaaaccggacatcaagaaaaattggttgtttgaaaagtgcaataaaggccgggcgcggtggctcaagcctgtaatcctagcactttgggaggccgaggcgggcagatcatgaggtcaggagattgagaccatcctggctaacacggtgaaaccctgtctctactaaaaatacaaaaaattagccgggcgtggtggcaggtgcttgtagtcccagctacttgggaggctgaggcaggagaatggcgtgaaccagggaggcggagcttgcagtgagctgagactgcaccactgcactccagcctgggcgacagagcgagactccgtctcaaaaaaaaaaaaaaagaaaagtgcaataaaatggttctacccaggagaaccaggaaaaaagagacacaaaccgtgaccatcagaacggaaagtgacccggtatcatcacaaggagcagcgcgaatacggcacgcaccgccacgcgtcaactcagtgactgatgattccttgcgctaattctttgaaaagtacaaaactaccaaactcacccaacgtgaacggtaacttggggattcctacaactgttaaaacaaaaaactgaggatgtagctaaaagcctgcagaaaaggaactccccaggcccgatggttttctggtgaattctgtatacacatttctttctaaggaagaaatgccacttatcacacagtctgccccaaaacagagaggacacactctactgcacgtctgatgaagccactggatgacaaaaccaaagaagccaccagaaaagaaaactaaagacccaactcctcatatacagacacaaaagccctcaacaaaatattcacacactgcgtttggcagtcgacacactgcgaagacaaccaccctgcagtactcaggagagggaggcccggagcggagggagcgaggagtcattctagaagcgcagcagtgagaggtggagagtccgaccccagggccttggctgccttgtgcacaggggtggggtggtgggcaggagtgcagtgggagtggggcccctggagccatgtgtcagcctgcggtgagcagcgcagcaggaggcagaagccctgtcttgctgagggagagtctgtgctgctgagtggggctggcacaggtgaggggctcatggcagcagtgctgccatcactgtcctcgagccctctaagtcccaaagcgcgcctctggggatgaaggcctgggcatgaccccaggagaggtggcaggagccagggtgtgcacagcagcccgaggctcacctttttcaccaggaggcagacatggtggccctggatggagcggctgtacatggaggcgcaggagtccactcgctccacaactgcaacagagcgggcagtgttaggcttcccggacattgcatggctgcagccccacccccagagcaggggccaccttcttgggctgcccttggccacagcttcaggaggcctgtaggagcagggtgtggccctgagaggcctggggtgtggggaatgcagcccccgcaccagctcccaggcctcggggccaccagccacccgggatcccaaagggtgtgagtttgggtgggagggccacaggcccggctccaataggaagggacagctgccgcgtgcgtgaaagccccgtgcaatccatcagcccctcactctccttaccggaaaaatggtggtgaaaacagatcttcgccagaagattctggaaggacatccgaatgccatcgactttgattgagctcatgctcaagtccccagactccagcaacttagcaaaggcgtcactgtgggagggacagggaggctgactgcggtggggccgggctcctcaggcttcctggcacagaggccaacaaaacctgccacacacgctgcgcttggacaccctcctgtgtgtctgggccgggaggtcttgggggtcctggaaggtgtggctcattttcatgtgcggaagccgtcacacccagaaactgacaatgacttgtctttaaagaggtcacagaggtgcctgaagccatgggatgggccctcctccgacaaggacggatgtcctgtaggaagggactggggggataggctaggatgcaggcacgcagaggacggcctgtgaggactcaggggggagggggtgccgcacgccaagccgtgccgaggagaggcttcaggaggagcctgccctgctggctccttggtctcacccctccagccttcaggacttccaggggcctggacctctatgggtgacgctgcctggcctgtggcttcaactacacggccccggctggcgcagacaccaggcagcctgacctgcaccagtcacgagccagcgcctccaaatccgtctctaaagtcctgcccagaagcctcagtccccggggcacaggtgtctgcaaggtagaggggaggcggagggggttcggggacataggggagtgggcctgggccccacctgtagcagggagtggtgatcaagtaggagctgcagctgaagtgcagcctgaagtccagcttctcgtgggtcgcaccctcgtcattctgcggtggagtgaaggtggtgcagttgagaggggagtcgggcccagctcagggctcagggttccccaggcaggtggcccacttcccctagggacacctggacacccactgcgatggggcaggaggagcccctgcctgcagagtcggctcttcaacgccaagtggagccctgcataccttggcaatgaaggacagggtccccttgagcttctgcgccatgacgatgctctggatggtgaacacatactgggcttcgttggagacgcctggcgggggcgagagggagtggggcctgagacgctgcgggggctcagcatgggtggggcctccaggtctgtcctcagtcccaagtcctctgtggctgattaggaaactgagctcagcccccaagggagcaccaggggacaggagcagaaacaagaggctactggtgtccctaatttggcctggacttggtcccatccctgtttcagagggcagacttggccactggaaccgtggaacccaagaaggccccagaatccagcccccagcacaacccttgggactctagccaggtccatccgaggccattgcgcttctcagagagctgtggcgagaccccgacactcaggaggtactgaggtgcagcctggggacaaaggggacatggggaggaagcaacaagaaccagcggatccgggcagtcaccagctgccactgcgctcccacagtccccaggagaggccgtgagtggggcagggctcacctgggggcagctggaaaggcacggggacgccatcgtggacggaggagccctgcggccgggccatcctggcattgagtgagtccagcacgctgagctccatgcccttgaggatgctgctgctcctgttctccagcacgatggccacagtgacctggctgtcctcctgcagactgccccggatgtcacaggtctgcagggcatggccagtgttagcagggcaggcgggcccgccacagggaacaggcacagccacctgtctcttaatgaccacagaggcagcaggggtcccacaggcacaggaaggcacggagaggggcgccccctagccgcaggccaagcgcctcctatggctgctctttgagtgcatggcggggaccctcctgccagtccaagtctcagggcatgtctccaaccttaccccaagccagaggtgctgcccaagcaacgcccctgccaggaatcacaggccctgggtataccaacatccgggagctgtgggggctgcccgggttccgcgcgatcccatgccaaagagtgtgggctggcccaccctgcccctgggagcggctgccactcaccattttaacataggaattttcagcgaggagggagtagctggactcaggctggaaatagaaaaggcgcatcagccttgggggccccgagctccgtctcagcgaagactccagtatggcccaataccccaggtcgaatgccacgactccaagaatgcttggggcaaggggcttcaaaggagccgatgagggatccccggctcccaggaccacacagcccaccacgggggtgcctaatgtggggctgcgggccagggccagtcccctgcccccgccaggctcggcttcttctcgaatctgctcagttctctcccgcatggaggctgcaggagtggggagcagcgcacagcccgccaggaaccccggcgtggggcgggggcgctgaagtacccctcaccgggagctgctcctcctctggcgcgccattctgcaccggctcccccgctgcctcctcgctgcctggaggctgcttcttggacttcttcttgcctttggtccgctcctccttctccttcctgtgcttcttcttcttaggcttgggagatttctggagcaagaggagggtcgggttcagtgcccaggctgctccagcacgcccccatcacagtgtgaggtcaggatcacagcagggctgctcaggctgagggtcccacgtgcctgggtgggatggcaggaccagccacgcctcaggcctaccgggacaagctcaggccagaccaggcccagcggaggctggggccgtctctggttggcggcaagcgccaaagcagcccggggaacagtccccaccgaccagggagccatgcagggcaaaccagtgaggacaccacacttgacgcagcaaccccacgcccatgtgcacatccgagagggaacacacacatccacgcgcactgcgcagatgttcaaagcggcatactgtgtcaccacaaaggggaagcggcccaagtggctatcaacagatgagtgggtcagcacagtgtggcccatccgcggaggaacggggtcagcagagggtgacctgtccacgcactggaacatgacccggccacgaacaggaaccaggctctgacccaagccatagtgtggatgcaccttgaggacatcacactcagtgagacgccacacacaaaagaccacacggtgtatgaccccatttctatgaaatgtccaggacacactgatccacagagacaggaaggggatgcgtgggtgccagggcagggaagggagtgagaagtaacggctggtgggaatggagcttctttaggggtcatggaaagttctggaactagacagaggtgatgatggttgcacaactctgtgaatatacagaaaaccactgtatacatacttcaaatgaataaactctatgagacttatgaaccatgtgtgaataagaaggttattaaaaaaacacaagaccacaaccacaacaaaaggcccgtgagaacgccaacacaaatgcgagagcagggctgccctgggacctgggtggcggaagctgtgtccggccccacgttggggtgctggggctcatgcagccctccacagcccctgggggagtgacagcctcaccttgtcctggtcttgcccctcggcatcgtcctcctcgccctgcgcctccgtcttggcgtcctcacactcgtccttcggggtagtgacagtgttcacactgagctccccctgcagggagccagggcttggggctcatgctgggcaatgaggggccccactccactgcaccccagacagcctccatgccacacaccctcagcttgccctcacgcctgcctgagaggccacagtgccctccgagtgacagggagcctgtgagcacagaggccctggctgtcctccccttcccctggcccctgcttggcccactgggacccgggagcatgaccccggctccactcagtgctgggtcccacaggtgcacggtgctgaccgcgagagcacagggcctcaggagacccagggctcttccctgagtgccaggtatgacctctgcagacaccgaggctggcactggccagctgccagtctcttaccgtggatggaacgggggcgggggcgggggcgggggcaggcggtggggtggtagacagccagaagtccaggtcctcagcctgaaaccacaagacaggctgtcagcaaacgcagtgcaatggtcctgggaagaggggacggggacagcagggccaaggaggccccagctgccctcgctgcccccagggtcctggactagctgggccttgcagagcctgggaatccaggagctgaaggcgatgtcctcagccagccctgctggctctggctttcgctgccagaagagggccggggacaaagctgtgggtgggtgtgtgccattccagtggtcagaaggcccgtggcggcccatatgtcttatgtctgcctgggccacctgacgtgggtgtggacaggctcccaggccctgcaaacacatgctcctttgaaaaacccatttctttctctatgtgaaaatctgcacacagacactgcagaaacggttctggagctgcacgtgagggtggcatctggaccacgccgagctctgaccatgtccccccaacacaggtgaggacacggctcacccatgggatcgttgggtcctcctcagtctcccctgacacaagtgcacagtcagctcccctcagaagccacatgtcctcactccgccggggcacagggcgaggcggctggcactcgctgcctgactcagactcacagccatttcccctgagctcaccgctgtctcctgggagttcacggcaagggaggggaatggagaaggccgccgccctgggcactagccttaccttcttctccttctccttcttcttctccttgtctctctctttctctttgtgttttttctctttcttcttgggtttcttgctcttcttttctaccatgggaacgtccttctcaggggattttgaggtctcggtgtttctgtgtttctgaataggcagtttctcgctgtcggctaagggcctggaggaggaatgaccgggccacacatcagcaccactggccaccccccaggaccactcagtacatgccgtgtccaagcatgtggcagtgcgggacctgctcctccagcccctggccccagccatggcccaacatagatctactcaacacagcctgctggaggctctcatgggagggtctgtggtggccacaccctgccctgtcaaggcatggagacctcccgagcaccccaggcctggagacttcagagtccacacttaagagtcttggttgggagggccagccaagagcagtgcagtgaggacgtggtctggggaaggcccgcccgcaccccaccccagcctgcccaccctgcagagcccggccccacccggaagggaggacgagaggaagggaagcaaccacatgtggcctccaccctcaccctgaacccatatggactcacttatccaggtcaatatccagagccctgtaggggtcgttggggtctttgtcatcctcgtcgctgggcagagcattctgacaggaagagaggaaccccatcactggaacccgcccttgtggcctggtggaacgccatctatctgggacgcagtgggactgcccatgcgggccacacgcacaggtgggcagtgacgtggctccaccagaggctccgctcagcgtctaggcactaagggcggctgggccccaggacgcagccaacctgcatctgcctctgaagctgctggccctggggcggtgcgtcgggacgcgtgctcgaggacagagaggcctctcctcctatgctctccggggtggggcctcatcccagccaccaacgaagaccatggggagaggccactgtgcatggccccaggacacacacatgcggaaagatagacatcctaggaccgggacctccagcgaggctgacctcaggcatctcctctgtgacgatgtccacctgctgggcaggggcgatgtcctcgtcgctctccgtgggcagcgagctgtggcggcgcttgcccttcttctccttctccttcctctttttcctcctcttgtccttctccagcttctgccggtgccgccgctcctcctccagcttcacatactgatctgacataggcagccctgcgggccggcagcgggcagccactcagcactgcaccccaggggctcacggggagggcggcgggagcaccccacagcccatgtgacaaatgcggcgccgacacaccggagacacttgcctggaaccttcaaggggacggagaggtcaatctgcaccacgggaatgtgctccacgcccggggtgtcctggtaccgctgcaaaggcaacacccaggcgttaccggtgcaccgaggggtgacacacgtgcaagacaagcctcggggatgcagggagcgtgacgcagccccaacatcctaaggagctggggtcctgccagagccctgggccgcgaggagcgccgtgagcgagcgcatcccgaggacccgactctttaagacagtgaggactggaaagcttgtcacacgagtgaccccacaggcctatgagcagagagaagcaaatcctcgttcactttttttacgtgaatattctgttttctcctcaaatgagaaaagtaatgcggcctcaagcccagagtgaggcagcaggttgcccacgaccgtggggtcagggctggacagcagctgggctgccaggcgcagggaacagggccccccggctggaggctcgaatgaatggggcccacagggaggcgcctgcccctcaaaggctccgcacagtcaccgtgtggccccagctccattcccaggatcttcctgagggaacccgaaactcagatggatgccgcggggctcgggtggtgagggtagagggtgctgagggacaggcacccggggacgggcctcaccttctgtggcgatggcgagctcttgatgtagaaggggttgttggcctgctcctgcttccgggcctctcggcgctgtgggacacagcttggcatgagcccgagagaagcgggcaggatacccctctgtggacgtccaccaccagccacccagctggggaaggctggatctctggctattttcactactgagctttcactaacagggaaaccaaggcccgcaattgggaagagcacgtattgggggaaaaggaatcgctaacgctctgggaggcagggacgcccatgcctccactgccagggtcagggccaggacccacagaggccgctgacctgcctcaaagactccctgggacaggagggaggagacgagggctcgccaggggcagccagcagctcacccgagccagctcttcctcgtccgcctccgacggccggtgcttgggacgccgctgctcctcctcgtggaagacggccctgggcctctcgtcctctgactcgctgtccgagagtggctcattgatccaggcgtccaggtccaggctgcaccggacaggagggccacacaaggcagtgtgtgaccgagcacgcgcctgcaggcgtccgccctgagcaggctcaccacgtgcctggccatgtgatatcccaaacagtggggcctgccacccacacagggccagcgaggcaggtgtcactgccccttaagaggacgcagggacccaggaagactgcggcagggtcacagtggggcccccacggcaggctcaggctgcctcagagctttatggcaagggtgggagcaggcccacttcgcagggagcatccccaggcagaagccagatcccagaaccagtgagagacctggtgagtccgtgtgagggatatacccgcctgaggcctccaatcagccccacaccctcctggctgttcaggggtgcaggagcccccgctgtgccaccaggcatcaagggaccatgtcagggccatggttgcaatgcccccacccccgtatccttacccttcggggactggaaccttcttctgggccttgggggccactgggttcagctccccagcaaagagagcgctgacctcctctgccacaggcacgtccttggcctgaagcttctggatgtgcttgaccagctgcaggatgcaggacgcctgtgggggacacaggggtcactgctggcacctgcccggaaggccactcggccaccttcagggacacggggtggctcagcccctggcacagtgacgtgtgggccccctggtacagccacatagccacagagagcccagccttcatgccgtctctgtcgtcatcatcctcgccaggaagcggcagaaacagaccagtccggaaacagaacagagatgggggcacaacagggagctttgcccactgcagaaatgcctcccatcaggtcagtgccccgacaccagaagcaccacctccctcggcccccgcgggctccccgcctctgtgctggctccaactcagacacagccaggctgggcagctccaacagtgaccatgggccaaggatcatggccagccccgagctaatgccaccgcacagaggagcccggggccacgccccatgcagccttgaagctgggtctcctcagccattggacaggctgacgccactcccgacctctctcacagatggccaggtgcgatggttcacacccgtaatccttgcactttgggaggctgtggagtgtggatcacctgacgtcaggagtttgagaccagcctggccaacaaggtgaaactccgtctttactaaaaatacaaaaattagccgggcgtggtggcgggtacctataatcccagctactagggaggctgaggcagaagaatcccttgaacccaggggatggaggttgtcatgagctgagatcgcaccacttgactccagcctgggcaaaggagtgaaactccatctcgaaaaatcaaaacaaaacaaaaaacaagcagaaaaacagacacctgggaagtggtgggcaccgcctggcacaggtgtacagtctgctcaacctagaacccacgtcacctgcagccaccagaaagagccactgccagccccaggctctcacacctgctgtctcgccgcatgtgaaacaacctcttcctgtggccaggagcagcaccctcacatacccagcaccccagagacctgccccagtcctactgacggatcccccgtcctgctgacctccaggtcccactgactaaccccaaaccccagctggcacaagtggcaacaaaagaatctcagtgagtggcttcggaagaggaagcgaggccccgtcgacctggccgccactggacagaaaggcactgagggctccctgaggctcggcccaacacggagtgttggatcttacccgctcctgcacctccaggtctgcgctctgcacaaactggggcagccggtccaccatgagctgggtgacggcctgagcgccctctgcctccccggcctgctccttctgctgcaggatggaggcgtagagcttgaccacgttctgcacatacacggcctggatgtggcctggcagcgtggtgactctgggccgcagcatggcctccaaagtgtggtgtggttcctgcagatgcctgaggacaggaaacactgtgagcccccaggatgccaatcccggggctcctctctagcaggtgaggacctaggaggcctgggctcgtcaccaacaaggtgactctgggcccttcccattccctgagcggtctccaggggctgagacacgaagtagaagaaaccacaggccgtcaacagcccgtaacacaaacaaggcagagatgtggagatgacagagccactgaatggaggaaaggtcagaagaggaaaaaggacaacggggtcaactgtgcagctggccctgggaggataagcaggatgggcagggaacagacggaaccgggagaccctgatctgtgggacagtggggcctcggggtgcgcctcactggcgtctgacacaatgccttgggacttgaatatgtttctagtccacttttttcccaataagaaaatgatagaagtggccgggtgtggtggctcacgcctataatcccagcactctgggaggccgaggcaggcagatcacgaggtcaggagtttgagaccagcctggccaacacggtgaaaccccatctctactaaaaatacagaaagtgagggcgggcacggtggctaacgcctgtaatcccagcactttgggacgccgaggcgggcggatcatgaggtcaacagatcgagaccatcctggctaacacggtgaaaccccatctctactaaaaaatgcaaaaaaaattagcagggcatggtggcgggcgcctgtagtcccagctacttgcgaggctgaggcaggagaatggcgtgaacccaggaggcagagcttgcagtgagccgagatcatgccactgcactccagcctggaaaacagatagagcaagactctgtctcaaaaaaaaaaaaaaaaaaaaaaaaagagttaagagaccagcctggccaacatggtgaaaccccatctctaataagaatacaaaaaaattagccaggcttgagcttggtggcaggtgcctgtaatcccagctactcgggaagctgaagcaggacaatcacttgaacccgagaggcagaagttgcagtgagccgagatcacgccactgcactccagcctgggcaaagcttgggagatagccagactctgtctcggggcgaggggaaaaaaagaaaatgacagaagtgctcatctccaggatgcaggctggctggggaccctttcgggatcccagaagtcaggcgccttcctgagccggggcaggcccagggtggggagtgctcggtgtggccgtgatgagcagcaggtagcggccagtggtggtgatggggccgggcccgaggcagtgaggcatagcagcaaatctcataaatttccaagagagcctggaaatccagactgctgtgagaaccgtgagtctcagcaacacattcccacctccaggcaggcccggtgacccgagcctgcccagcagtggctgtgatctgtcctcttggccagggagaacctgacattcctggagacggcaggggcagtgtcgataagacccatccctgcggcccacctggaacctggcactgagacccctgtgcctccagaggggcctggcgcaggcaggctggggctgagcaggtgcctccctgggccacctaactgccacacggagctcccacctcacctacagcaaacagggctcagaagggctgccacgcgcccagctggaactgagccttgcagatgcccagggccagccccccgtctgcagcccaccccatggatcctcccacctcccagtcctagtgcccacgggatctacaatctcctgggaacgccacagatgcccgagggcagagggcagacagggcagcacagactcgcctctgtaaagggggaatgggcccgaccattgtcaggggacaggtgctggaaacccacggacctgcaagacggccggggtggcagggcgatgggagacggtaggaaggatctgccaggcacatccctggtccctacccctcagaagcttggagaagctgccagcccagaggcccagcgcccactcactctgagaactccccgcagatccaggcggcagcgtacagcacctcacagatcccgttccgctgggtgctgctggccagcaggtgtgcactgtcaagcagcgcagacatctgggacacggcgaacttgcggatggccttcacgcggatggccacgtccagcatttgggcggcgatgaggtggccgtgccgtgtgccctccagccgggtcagctccaccaggatgctgatgtacctgtggggcagaggcggtgagtgagcggcgccacggaacccccggccacacccctgggagcgggacgcaccactcgaagttggtgatgtactggtagttggactggctgcagatgtcaatgatcttggtgagcagctcgtcacggtaggtggtaccctctgccttgtctacgtgggtcatcagcttcttcacgatctccatcaggttcttcttggacacctgggcaaaagtgtacagacagtggtgagagcggacccagcctggggcctgcttggtgagacacccaacacctgctcctgagacagaatccacgggacacaggcggacccggattcacagatcgatgccagggaggcagcaggcccctgcgatgtgggctgggttagaggcacacgaccccagccagggagcaacaactggcccagcacagtctgttctgcaggctcggccccgccccctccacacaggccctggaagacaggcatggaccaggactggcgcccctctgccctgccccaccacactaactgatggccgagtgtgaggggactccatgcattccacgtggctctgcacctgacacttaatgtcccttagagaactaaggccaggcgggcgggcggcggacagagggcacgcaccatcccatagagcaggtccagggcccgcagccggatggactcgtccttgtcgtccaggcactgcaggatgaggtccttgtgggactgcacggacttggggtgggtcttcaggatcttggacattgccagcagccccaggtacttcactgcagagagaggccagagccgggtcactgggacggacacaggcagcagggtgcaggcagggcccacggctctccgggccgggtctccacctcgggaggctgcctggccttggcaacctgggggtggacagagcaagtatcccagctggagctcaccacgagggatgtcgccctagcagagccccctccctgggagccggggtgcaggctgcccccatgccggctccctcaggaaggcctcccctacctactaccacgttgtagtagctgctgtcagctctcctcttcccacccagccagtgcagggaagaacgcagagaagactttccagcagcagcagcagatacccttggcccaaggcagggtctcacctgtacccagtactcactgttcacccgactagcccaaaccagctcacggacagctaagggtggctgggcatgaggcacagatgccacaacctaagccagggccaccccagccacagggcacacagctgaacccattcacatactgccatccacggtggctttcaggccacggggcagcactgagcagagacagacaccgtgaggtccacggagaaaacgcagtagtccccacctacccgtgggggatgggcccatgaccccagtggaaggctgacacggcgggcggtactgagacccgcgtgtgggtgtttttctgacacgtctgtgcctatggcgaagttcagtgtgtacattaggcacaataagaaatgaacaactaatagtaactaagaacagaacaaccataaaacacggtcacgaaaggtatgtgatcgcggtctctcttgcaatacccgactgtggggtgcttgcctatttttggactgtgttgggggtacctgaaacctcagataaggagggccactccactatctgggctgttgcaggcgagtttgccaactcctgctctcaacaaaaagacctggcttcaaaatgagcatccaaaacaccgcccaggtacaaggtaccaggcaggggccgctaattctgattcctcaacagagcagcacgggggcacccacatgcaggcaggcacctgggcaagggtgctgtgtgctgctctatctcacaacgcaaagcctcacgcacccccgcaaaaacatgcagaggctgaaatatccagaaatttcggaccaaggtgctcagtgagtggcatctgtccaactgccaggatctccccagtgggggcctttgccatgccccctgcatctcccctgggactggggctcagaggagctggtgtttcccagccaccccacgcagataggtcggggtgcaagggcgccacagggcactggcagagggctgcctctgaggcagagtgccatccatcagggagacagctggggttgcagatgccgtgtccacttcctcctcacactaggaggacccctaacttcacagagctggggacacgaaaatgacagcactggggaggggatgactcacagttctgatcggagtcctcgatcaatatccttaatttctgaacacaaagctgaaaagaagaaaaaaacgatgctggttacatcctctaaaccaagggtgagtcccacaggtaccctccagattcaacctcaacctggcctaaggcccggcgtcagccccacccaccaatcaaagcccaggagggaaacaagcatggcccacatggggcactggagacaagggaggccctgcttcccacgggcgctctcccccactcctcagtgccccatgcatccaccccacagacacatgatggggatcccaagcaggctcgggtaggtagtgcacacaggacgcggctgtgccctcccaagccgcaagatggcgtggggggaccagcaccttggtcacagggtgggcaagctcccgcctgtggaaaggtgtggcctctgcagtgtgggaccccatgggccccgcccagtgcgggacgtacctggatgctggcgctgtggttgggcatgccggaggacagcgagatgagcactgcaacagacagcttggtcagcaccacggtcagcaccatggccagcgccgacaccaactcagggccacggggcaccagcaccccctcgccgggaggagggatgggagggaggacagaaatgccactgagtttgggaccacgcagcccaactgtgtttgcaaaaacctagctccatcacaggcctgaggataggaacctgcaggggcccccaccctcactgacaggatggctcggggcctcagctgttcctgcaaacactggttcactcgcaacccctgcttccctctggagtctggaatcccggcaggggccaggccccgaggccacaggaccagaccctgtaggaacccaggcgctgggtctctgggagcctccatggtgacacttcacaaattatcatcacagctcactgctgggggatgaagcacatccggcaggactccactgaaagaaggctctagaagctgggcctggcctccccaacatccccggagccattcccctttgctgactctgctgcgtcctttgggcagggacaggcaggcagcgagaagccgaccctcagagccccagctctaacagctttaaaagaaagacatgaagccaggggaccgccaggcacatgcagggacagagactcattttccaccaagccagtggcatggaatgaaggtgtacaggagaccgtgtgtgcgtgtgcgtgtgcatgtgttttctttttaagacatgggttcttggaagctaagctatgaggacgcaaaagcataacaatgatctaggccaggcgcggtggctcatgcctgtaatcccagcgctttgggaggctgaggcgggcagatgacctgaggtcaggagttcaagaccagcctgaccaacatggagaaactctgtctctactaaaaatacaaaaataagcgggagtggtggagcatgtctgtaaccccagctactctggaggctgaggcaggagaatcgcttgacctgggaggcagaggttgcggtgagccaagattgtgccattgaactccagcctgggcaacaagagagaaactccgcgatcccccccaccgccccaaaaaagaatgatctaatggactccagggacttgtgggaggtggggggtgagggataagagactgcacatggggtgcagtgtacactgcctgggtgttggtgcacataaatctcagaaatcaccgctaaagaactgatccctgtaaccaaataccaccaaatgccgcccaaaaactactgaaataataatttttttaatacaaaaaatacaaatatctggaaatgaataaccctggacagaaagtctacatataaatgtaaatacgaacgaagaaatgtggcaaaataaatgcatattcacgcatgcaagatttcagaaatgtcacacccaatctttgtaggagtgttgtttttttgttttgttttgtttcgttttttgagaagaagtttcgctcttgttgcccaggctggagtgcaacggcacaatcttggctcactgcaacctctgcctccctggttcaagcaattctcctgcttcagcctcccaagtagtcgggattacaggcgcccgacaccaagccctgctaatttttgtattttttaggtagagatggggtttcaccattattggctaggctggtcttgaactcctaacctcaggtgatccacctgcctcggcctcccaaagtgctgggattacaggcgtgagccaccacgcccggccaggagtgttatgtgaatataaaagtagatggtaatttttttttcttaaaataggtgtatagattacccaggtaggaacaaatgtattttaaacagaaatgtaggccgggcgcggtgtgtagatgtgttaattatctgaattgtgctatttgacaatctagaggtgtaccttaaaaatataccatttttaattgtcaactatacctaagtaaagctagaaaaaaaaaaacaaaagagatggggtgctggctgagtacagtaactcaggcctgtaatcccatcactttgagaggtcaaggcaggaggatggcttgagcccaggagttcaagaacagcctgggcaacatagtgagaccttgtctctaccaaaaattcaaaaaattacctgggtggggtggcatgcgcctgtagaagcaagaggactgcttaagcccgggaggtcaaggctgcagtgagctatgatcgcaccactgcacaccagcctcaagagagacggggtctcactctgtctgcagcctggaactcccgggctcaagtgatgctcttgcctcggcctcctgaatagctgggccctcctactggtgagaagcttctgctttatcaaccataaggaagtccaccgcccaatgccccgtgaggctttggctgacttggagcagcttggcagagaccactggggacattggtcgttggcccttgtgccctggcccagccggaggtgtggattctgactctgccttagaaaatatttttgtgggccaggcgcagtggctcaggcctgtaatcccagcactttgggaggccgaggcaggcggatcaagaggtcaggagttcgagaccagcctgatcaatgtagtgaaaccccgtgtctactaaaaatacaaaaattagccaggcgtggtggcgggcgcctatagtccctgctactcgggaggctgaggtaggagaatggcgtgaacctgggaggcggaggttgcagtaagccaagttgcgccactgccctccagcctgggcaacagagtgagactctgcctcaaaaaaaaaaaaaaaaaaagaaagaaaaagaaaatatttttgtggtagatgctgctatttaagtatccacgggtgaaacgatatgctgtctcaggagtgctttaaagtctcagaaaaaatgcagtgtactgtgagagcggatggcaggccctgagcagcaggggccggcatctgtggaagcaggtatgaggaggggctttatctgcaggtgaatctttcatacccaaggggactccagagtggctgggccaccaggcagcttaagaagcaaacacccagcaccaatggcggtggaagaccaggcagacgcatggccaccttgacagcagaggcctgggacggactcccagccagccccaggccccaccagccagctttccttctcagttccagcaggggtggcgctcggagacaccaggcctggcgccctcctgtccccacctgagaccccagcctggcagtgccagcccttccagatggggagagtgccagttctcacctgcaatcacggtgttcacacattcatagaggagagacatggcagacgtgctaaggaaaggaacacagggaagcggcatgaggactgggggcctcgtcagatgcagtgacccagtgccggcagctcagctggagacggcctccgccccacggctcagggagtgtgccccaggagggagcccgtgccttgctctccaaggcctgtggtgctcggctggtcatcgtctcatcttcccagaaagggcaggtgagcaatccctctgcaactgcaggcccgtgacagcatccacgcagggacggaccacgcacccccggcggcctgtgagatggcaataccgccttcctactgcatcttttctagagttttttttgttttgttttttgtcttttctgagacggagtctcgctctgttgcccaggccggagtgcaatggcgcggcctcggctcactgcgacctccgcctctcaggttcaagcggttctcctgcctcagcctcccgtgcagctgggattgcaagcgtgcaccaccacgcccggctaatttttgtattttttaggtagagacggggtttcaccatgttgcctagactggtcttgaactcctgacctcaagtgatctactcgccttggcctcccaaagcgctgggatcacaggcgtgagccacagctcccagcccttttcggtgtttcgatgtgttcagacacacagataatcaccatggagtcgcagctgcttacagctttacagtcacctgcagcgtagggccgcagccaggagaatggccacgcgccatagcctaggagtgtggcgagcttcagcagtgaagtccgtgtgcgcgtatgctacactgctcacatggtgaaatgtactaatgacacccttctgtgaatgtgtccttgttgccgacacatgactgcatctgaaagtcatggcgatgacgcctctgcctgcggcccactgcacccctccccttccctgcagtgggggccggggaggggtcctggctccgcctcagcacttggtctgaggaattaaagtgtccccttctagcaaccaaaggcagcctggcctgaaaaggctcctaacataggatcccattccacaaccttgcagtgcggagacccacaaagaaaacccaaactccccaaacgtctctaagcagcatggagaagagtctagtggccgggaatgccactacaggcttccagtctaggacggacagtcatctttcagctgcttcacgcccagcccccgctgtaccgcactggggccgggcttgcagccactccagcactgcaccccgtggagccggcccgcccccgccgctccgacactgcaccccgtggagccggcccgccccacagctccgacactgcaccccgtggagccggcccgccccacagctccgacactgcaccccgtggagccggcccgcccccgccgctccgacactgcaccccgtggagccggcccgcccccgccgctccgacactgcaccccgtggagccggcccgccccacagctccgacactgcaccccgtggagccggcccgcccccgccgctccgacactgcaccccgtggagccggcccgccccacagctccgacactgcaccccgtggagccggcccgcccccgccgctccgacactgcaccccgtggagccggcccgccccacagctccgacactgcaccccgtggagccggcccgcccccgccgctccgacactgcaccccgtggagccggcccgcccccgccgctccaacactgcaccccgtggagccggcccgcccccgccgctccgacactgcaccccgtggagccggcccgcccccgccgctccgacactgcaccccgtggagccggcccgcccccgccgctccgacactgcaccccgtggagccggcccgcccccaccgcgcatggcctgcactcacctgtggatgagattggtgaggggctcgatcagcttcttgcccagccgcggttccaaaggagtaagagcaccgaactgtggggacagcagggcctcggtcacccgcagggaatgccccacgcagggtgagggacagggggggcctcggtcacccgcagggaatgccccacacagggtgagggaatgccccacacagggtgaggaggccacattcccgggcagtacttgccagcttgatgatcttgatgaggacccagttgttggtggaggacgtcatcagcttgaaaaagagcggggccagggacaggtagttcttagggttgcgtctggccagctcgcagatgacattgacggcagccgactgaacccctggggaacaaggggttctcatcagcatgcctgtccttccacctagaaaaccatcctactgtcttcctggcccgcgaggaagttctggggcctgcagcagctcccactgaacatggccctggctctgccacctcctcctggtgacagggacagcagccacagacctgatcctccagggaacaggccacagcagccagctcctggcgctgagaaagcattgctcggcactgttgccaggaacaagtgcgcacaagcgtcaccaagctcaggacagcctgacagcggccctctgagtgggggtttcagcatgagggctccagaaacagctgcccagccatcggggctcagggagtcttcctgctgcatccatgcccaccactccagggagaagctcgcccatcgggtcccgggcttagggctggggtctcccctcctgcacacagggccttgggattcctgtgggctggctttggggtccaccgacccacgcctgccacacgccagaggcttcacacaccagcccagggaaactcagtgaaactgaatctgcagccgcgtcccgcagtcaccacaccacaaatacacaacagctacactaggtggaggcagctcctgcacgggacatatggtctagaccatcccctgccctgtggaaggtgcctcctggtggcactggtcctaagaggggctggcgggggtgggtacacctctgctcagggacacgccagactcaccgccagctgccacattggatcttactgcccccaccaccagcacctccctcctggctgccccagcaaggggaggcccagccacctccaacaggcatgttcctggactgagcccttcaccactccccgcagcaccccccaaaacacgccaccacctcttcccagggcaccggctgagcccccaccctcaaccctgaggcttaactcaaatccacaaaccggggtcggggtcctccagcttctccttcagccggggaaaggcagggcgcagcgactcggggtacttcaggaacaccttgtacatgatcagcacagccttcttcctgatgtagggcttggtgtgtgacatctgcggggcagcgggcttcagcctgcgcgggctttctgcgcctcatccctgctctcgcccctcccagccgcctcctccacagagaggagatgccctccagcccgacgctgtggctgcacaccagtcccaggggccacagaccagcatcttggatggcatggaagccagcctcactgtgcccctgactcaggcctgccctccagagagagccctcttcccttgtggccttcctgccccagggtcctgggtcccacagtgggaggaaggctggagaggaaagtcacacagggaacgagggtgtgctgggaacacagcctacagcccagctcctcacggctgtgccctgcgactgctcaaattccccagcgggagccctcccatctaacaggcccagggagtcgcctcgaactgcctggtcctgacagagccaatccatgatggggcactgacatccaccctctcgtgggctccccactgctttactctagaggagccggcactctgtgaaggccagcagtcagtgttttcagcttcatgggccagacagcctctgtcatgaccacacagctgtgccttcacaaccaaggccaccagagacaacacaacacgtgaaaagaaggtgcagccggctggatttggccctgtgccgcagcctgctgatccctgatctagaagcttagcaggctgtgctgacaatctccaagaccatcagccacgatctagacacctccaggtggacaggcagccacatggggacggcgcccatcggccacgatctagacaccaggtggacaggcagccacgtggggacagtgcccatcggccacgatctagacaccaggtggacaggcagccacgcggggacagcgcccatcggccacgatctagacaccgggtggacaggcagccacgaggggacagggcccatcggccacgatctagacacccggtggacaggcagccacgaggggacagggcccatcggccacgatctaggcacccggtggacaggcagccacgcggggacagcgcccatcggccacgatctagacaccaggtggacaggcagccacgcggggacagcgcccatcggccacgatctagacacctccaggcggacaggcagccacgcggggactgcgcccatcggccacgatctagacacctccgggcggacaggcagccacgcggggaccgcgcccatcggccacgatctagacacctccgggcggacaggcagccacacggggaccgcgcccatcggccacgatctagacacctccgggcggacaggcagccacgcggggacagcgcccatcggccacgatctagacacctccgggcggacaggcagccatgtgaggacagtgcttcccagggaggaaagcatgcccgctccacactgttaatctggctactgtgttttaaatgaaaaggaacaaaggtcccctcatgagctggaggttaagtcaggcacaaaacagatgtttctggggccaaaatttccaggggcttcccaggttttagactgtcacagccgggggcgtagcctttgacaagcagagtggcaaggaggagtcaagctgtggccagggatggaggaaagaggaccacacagaagcccactggcagctcagacaggagccactgtcagacctcagggcaaacatcccccaccgtgcctggcctgtcagggacaccctgttgctcctctcggcaagatgatttcaaatatcaacttaagacacgcaggaaccaaagcggcccaagagccgctccaccagctgacagtgatttggttcccatttcaggcaggccacgcaccggggaccccggccggtttccgcatagccaagcttcccaggcatgccactttgaccgagtttttcccagagcagacatgcaggggtggtgggcaggcttacaaactcaccagtgtcatgatgtcatttgccaggtctctggcaaggtctggggtgacgaagcaggacagacccgtcagtgcaacacctgtgtcgtactggctggggctgctcaagtcctggaaagtgagagaaaggggccgtggccaggatgccctgggtggcacatccgacgcctgggtcaccaggagcagcaggagcgaaattctcccaggatgccccaggactcggcatatcctcttggggtgcagctgtgccttagcacccctgctgctgaggggtctgaagctgaactcggacaaggaggaagaatttacagcccatgggagactctgtcaccaagagaggagccgggatgggcgcggctgggaacagtgaggtctgaggcacaggctgaaacgctctgtgggtgggaatcaaccaagtttcttggctcctcctggatgggcagggctggggacagagaggtctgaggcacaggctgaagcactctgcgtgggaatcaaccgagtttcctggcacctcctgggacagaggcgcctgtcacaagtcactccaagtgtggggaagggccaccccgggtgcaagagcagagcgttccaggcctaaaaccagggcttccctcacgtatcactggcagctcccagcttgcagagacggcggtgctgggcctggcacagaatgggcaggaaagccccacaggatggggtcctcagagaccctgctcccatttggggtccctttccgcaacaactgaggggaagggcccaggaacagctcccatgggtccctctcaaagttcagctggcagctgcccacgccctcccatgaactctgccccagctcttcactcccgcagctctcactaaaacacggaatctgccccagctcctgtgtcagcacttggggaaataaatcctctcttgatatcacaaacctgctcttggggagagatcttcttaaggaaactcccgagacttcatctatatatgcatctaccaagatccgttttcagggttaatattctgtggtcaaaatatgacaaggccagcttttttttttttgagacgagtctcactctgtcccccaggctggaatgcagtggtgcgatctcagctcactgcaacctccacctcccaagttcaagcaattctctgcctcagcctcccaagtagctgggattacaggtgcgtgtcaccacgcctggctaatttttgtatttttagtacagatggggttttaccatgttggccaggctggtcttgaactcttgatctcatgatccgcccgccatggcctcccaaagtgctgggattacaggcgtgagccacagtgcggggccaactggttcttttaaaaggacacagtggccgtgcgcggtggctcacgcctgtaatcccagcactttgggagtctgaggcgggaagatcacgaggtcaggagatcgagaccatcctgaccaacatggtgaaaccctgtctctcctaaaataaaaaaaattagtcggacacggtggtgcacacttgtagttccagctacttgagaggctgaggcaggagaattgcttgaacccaggaggcagaggttgcagtgagccgacattgtactccagatggcgacagagtgagactctgtctcaaaaaataaataaaataaaataaaataacacagtgagctgaagtggtggcacacacttctaatcctaccactttggaaggccgaagcaggaggatcacttgagcccaggggtttgagaccagcctaggcaacgcagtgaaaccctccctgcctctacaaaaaatacaaaaaaaatcagccaggtgtggtggtgtatgcctgcagtcccagctactcaggaggctaaggtggggagatcgcttgagcctaggaggtcgaggctgcagtgagctgcaattgcgctactgctctccagcctgggtgacagagcaaaaccctgtctcaaaaaaaaaaaagtaagaaaataattttttttagggctgggcgtggtggctcacgcctttaattccagcactttgggaggccgaggcaggcagatcatgaggtcaggagttcaagactagcctgaccaacatggtgaaatcctgtctgtactaaaaataccctaaaaaaaaaaaagaaagaaaataattttttttttttgagacggagtctcgctctgtcacccaggctggagtgcaatggcacaatcttggctcaccacaacctccgcctcctgggttcaaacaattctcctgcctcagcctcctgagtagctgggattataggcacgcaccaccacgcccggctaattttgtatttttagtacagacggggtttcaccatgttggtcaggctagtctcaaactcccaacctcagaagatccacccgcctcagcttcccaaaatgctgggattacaggcatgagccaccgcacccggcccaggaaataattttttttattaaaaaacaagccaggcgcagtaatcccagcacttggtgaggctgaggtgggcagatcacctgaggtcaggagttccagaccagcctggccaacatggtgaaaccctgtctctattaaaaacacaaaaaaattagccgggtgtggtggcacatgcgtgtactcccagctacttgggaggctgacgcaggagaattgcttgaacctgggaggcagaggttgcagtgagccaagatcacgccattgcactccagcctggacgacagagcaagactccatctcaaaaacaaaataaaacaaaacaaaacaaaaaaataaaataaaaaacaaaatgaggccaggcacagtggctcatgcctgtaatcccagcactttgggaagccaaggcgggcagatcacttgaggctgggagttcaagaccagcctggccaacatggtgaaaccccatctctactaaaaatacaaaaattagccaggcatggtggcgggcacctgtaattccagctactcgggaggctgaggcagtagaatcgcttgaacccaggaggcagaggttgcggtgagccgacatcacgccactgctctccagcctgggcaatagagtgagactcagtctcaaaacaaaacaaaacaaaacaaacaaatgacacactggactgcaaacatcggaagcacgtgatcctacacagaggaagcaggtgctaactggctgagccagggcccacctgcgtccgaggccaggccaggggcaggcaccaggtcagagccgcgcccgacacacagggtctaacagccctgagcacctcgcaaggcagcggcggatctaagtccccagtgaggtgctcacacagggaccggccgtgccgagcccatcagcaagagacacaaagctgggcacgacacgtggccctccttgctgggcagctgccacctgggtacctagggcggctggagccctccaccctcctccctcccagttaccacctgcaaaacccgcccccatcctcctcttagcgggccagactcccgcccaggccccacctgctacacggccacgacccaaggagactcccgcccaggcccctcccgctacacggccacgacccaagaagactcccgcccaggcccctcccgctacacggccacgacccaagaagactcccgcccaggtccctcctgctacatggccatgacccaagagccccacggcatctagggcgcatgtcgcccgcggcccaggcgggacgcccagctctataaccttgcccacaacggtgagcccagcagagccaacagtcccaggacctgcaccacaccctgtgccggacatcagtcacagccagtgcccccacacctgtccctcggcgtgctgggagcccccagcccaggacttcaggtcacactgtggggtcgacaacacagccacagggtcccgcccttgcacatggacattggagagccgggaccgtggcctctgacgtgcggtctggggccagaaaggggccagctgcccatgaaaagggtgggcctgattctccaacaccccaacccctctattgagaggcgggaaccaaaggtgttcagagctcggggccaataaggacctttactactacccagtggcctccgtgaccatttcaaaatgcaacatttacatggtgctgaaaaatgcacctcgtgggactcaaaaaaagccgcgggcaggaagcaccccacatgggcagggaagggcccacagctacaccaggcactaccatgaggggagaagggaagaaagtgggtgaccgcagaggccagctgcgagtggaccctggagccccattcgccggcccctccaggtggtgagcgagggaagggggcaccgcaccactcagcatccctccacctcacaagcccaccagggagcgcaggctcagacccgccgggcctcctctctgcgtctgctgggaggactgtggctccggaagccccgctcgcactcaagggggccacaggcacctgctgcccacaggaagacgcgtgtgggaaccagacgctccggcaagggcagactgcactcagcacagagcggccccggcccgggaacacccaccttacggatctgattggtggtcagcatgatgacgtcggtgccttcgtgaaagctctgggaagcagcgaggtagccaattcgctgggagagaacagatgagcacatcagaggcaggacacccgcagcctccaggagctccagctctgctctgcagcgaccacaccaggcagcgccagcccagaagcaacaccctgcagcctggacgctggggccaccagcaagtgggaaccaacccgcatttgaaaaccaacgcagatttcttcaaaattccatgaggaaattcccagtttggaatatgtatgtgtttttttttttttcttggagacaaagtctcgctctgttgcccaggctggagtgcaatggcacgatctcagctcactgcaacttccacctcccgggttcaagcaattctcctgtctgagcctcccaagtagctaggattatagccgcgtgcgccaccacgccccactaaattttgtatttttagtagagatggggtttcaccatgttggccagcctggtctccaactcccaacctcaggtgatccgcctgtctcagcctcccaaagtgctgggattacaggccactgaatccaccttgggtaacagagctagactctgtctcaagaataataataataaaaattggccagtcacggtgcctcacacctgtaatcactccccaccccaccagccttgccgtcccagaacctcaccttgaaggtgaacttggaggcactcatcacttctatgatgttgaaggcggcccagctgatgtcgtatcccaacatctgtaactgttaagggacgcacaggaaattgcactcacaagccaaagcagagagaaaggttttgagccgcggcatcaagcgctccctcccagcacacggtgctggaacagactcattcactgtcagcaaaccacccaatacgtacccctggggcctttaatttcttcttttgacaaacgactctgacatttaaaagctacagggacaagttagtaacaggcactaaaaagagactcaatgtctgcaattggttaactggcgcttacgggtactggctacattcccctaccaacccttggcgaatcggctccttgaaatagttacgagacgagcagcagcatgggggaccctggacgagccctttgtctcgtcctcccacggggaaacgggccagagggaggagtgcctgtccccagctcacgcactgacctggaactgcagccaggaaaggagccagccctggaaggtccagggccctagctctccccactaggtgtcctggcccagcctgtggtgggagggagccgagactgcaggcgaggggcgtccccagtgaatcccacccagaagaggaccccatggggctccctcagggctaccaccagggcctgtgggttgccaccctctggcctgtttgccagccatgtgaccaacatggctttctgctccaggactctgggttggccctgagtggctcaccgacagcaggtggtaccaatgactgacaggtggacagacaggctgatgaataggggacacgtgctgagtggagaagcagcccgacagtgctgggcgctggccactgggaggcacttacatacgtcagcttgcagaccgcgttcgccttcaccgctatgttgtcctgcttcagctcctgcttgatctcatcaatgcactgagatatgtattttgcctataatgggggataaacacagagattacaaacatccagctaagagggctggaataatgatttcgggccaggcacagtggctcacgcctgtaatcccagcactttgggaggccgaggcaggcagatcacgaggtcgggagtttgagatcatcctggccaacatggtgaaaccccgcctctactaaaaatacaaaaattagctgggcgtggtggcgggcgcctgtaatcccagctactcaggaggctaaggcaggagaatcgtttaaacctgggaggcagaggttgcactgagccaagatgacaccactgcattccagcccaggtgagagagccagactccgtctcaaaaaaaaaaaaaaaaaaaaaaaaaaaggaaagaagccaggcataagagagagcacaccgtgtaatccatttctatgaaatgtccagatcaggccaatccagagacaggaaggggattcgtgggtgccacaggctgggagaggagacgggagggttcgctttctttctaggctgataatgttctggaacttggccgtggtggtggcgcacagcattccgctatacacgccccaccgtttgccaactccttggtggacgaacatgtggggccttcccaccttcagccagggtgactctcactgctgtgaaaaccacactcaggttttgaggggatgtgtctggtgtgtctggatccccctgggcctgctcactaactgcgcgtgtctccagaacaccatcaaggacaattctgacccaagcgaactcaggcacgaggtccagaatggcagacaaggttcccaagggacaggcagacgtgaggcgcccaacatagcaccagagacaagccgagtcgatgccatgctggccccagagacaacccaccccacctggaaggagaggagggagcagcagaggcttggagtgcctccatcagtgaacgatgaggcacccacaagccctcctaatgcacaggagcccctctccatcatccgacaggtcaggagtgacggctgcccgggccccgtcctgccagcccctacgtcgggatgcaatgttcctcctgctgtgcccaccagaggcaaggatggcaagcccaccccatcacgcttctgtcctcagccccactgtagctggcctcgaagcagccccaggagtacccaccactcatgtgtcacccaggaccacaccccaacctcggctgccagctgcaccgggctggggaaggagacacagctgtgggggagtgggggggtgggggagggcacagacacataatattttcctccatgctttatgatccaactttgtacaatggaaagagtgccacccgatcctccagacgggcttcaaattactacacctcaccccaggactgtgctcccatccccggagcaaggataacccactcctcctgctcaaagggtcaggactgttgatttaaaaggaaaagaacaaaaagaccatcccaggcgtggagaggtcagaccctcacgagggcaaaggggatgtcaaacggcgcggctgctgtggaaagcagcctggggttcctccacggttccatgtggagttaccgccccagcaattccacttctgggcgtgcacccgaggggatggaaaacaggtgtccaaacaaaaacaagcacacgaacacacagggcagcaccatttctagtggcctgaaacaggaacagcccccacgctcgccgctgatgaatggatacacaccatgtggtgggtctgctccagtcaacttgcttgactttttttttttttgagacagggtctcactctgtcgcccaggctggagtgcagtggtgagatcactgctcactgcagcctccacaccccagactcaagtgatcctccccgctagcctcccaaagcactgggaccacaggtgtgcgccaccacgcccagccactagtcagctttctaggaactcggcagtgggtcacaaccctgggactccctcttggcttttaacttctgataaagtccaagtagctcctctcagaccaagcctcacacaaacgtcttttttttttttttttttttttgagacggagtctcgctctgatgccaggctggagtgcagtggcacaatctcggctcactgcaaccttcacctcccaggttcaagtgattctcctggctcagcctcctgagtagctaggattacaggggcacaccaccatgcccagctaattcttgtatttttggtagagacggggtttcgccacgttggccaggctggtctcgaattcctgacctcaggtgatctgctcgcctcagcctcccaaagtgccaggataacaggcatgagccactgcgcccggcctgaattagaaaaaaaatgtattagttggggtagggagacatgacctagacccaaaagattatattataaacatagatgtaaattagctgaagctataatgtggctatacatcattgacactttctacaaaaacaccgggaaatcagaggagcaacatggtgaaatttctcaaacacctcagctagttccacactaaattcacacttcaccacacagcaagtgagatactaaaacaatgatgctggtctcagcatctatttaattctgggatgtaatttagaacacagggtgcgtatttcctttatacactaagtcctcaggactgcagtaagacaggccatttaaaccctagatacacaggaaaactccctggggtacttttttttttttttttttaatggagtcttgctctgtcaccaggctggagtgcagtggtacgatctcggctcactgcaacctccgcctctcggttcaagtgattcaagtgattctcctgcctcagcctcccgagtggctacgattacaggtacacaccaccacgcccagctaatttttgcatttttagcagagacaggatttcaccattttggccatgacggtctcgatctcttgacctcatgatccacctgtctcagcctaccaaagtgctgggattacaggcgtgagccaccatgcccggccttttttttttcttttattgagatagggtcttcctctattgcacaggctaaagtgcagtggcctaaccatggctaactgcagcctcaacctcccaggctcaagagattctcccacctcagtatttgggagtacagtaaatagctgggattacagggccatgccaccatattgggcgaatttttaaaattatatatatttatatatatttatttttgcatatatttatgtatatacttgtttacatatatatacatttatttacatatatgtttatttatatatatatatgtatcttttgagacagagttttgctcgtcgcccatgctggagtgcagtggtgtgatctcggctcactgtaacctccgcctcccgggttcaagcaattctcctgcctcagccttcccagtagctggggttacaagcaggtactaccacgcctggctaatttctatatttttagagggggtttagccatgttggccaggctggtcttgaactcctgacctcaagtaattcgccagcctcagcctcccaaagtgctgggatttacaggtgtgagctactgcacccgacctaacattttttacttttgtagagttggggtctcactatgttgcccaggctggtcttgaactcctggcctcaagtgatcctcccaccttggcctcccacagtgctgggattaaaggtgtgagccaccgcacctggctggcgctttttctagttttaaacttccgattctcagtccttcgcctccaatgaattaagtcagcatcttgagaccagggaggccacatggtcacaacctcagcagctgattctcaggtgctgtccagttcaaagaccaacgagctgagcccttggcacatcccacggtgctttccacgtggccgcctggctgaggggagccgggccgctgagccgcatgcaggctgagggcctgggagctcacccagctcatgagagcaaagcccggtccccctcaccccaatgggggctctgaggggttttttctgttttttttttttctttttttatttgagacagagtttcactcttgttgcccaggctggagtacaatggtgtgatcttggctcaccacaacctccgcctcccaagctcaagtgtgattctcctgtctcagcctcccaagtagctgggattacaggcacgagccaccacgccaagctaattttatatttttagtagagacagggtttctccatgttggccaggctgatctcgaactcccgacctcaggtgatctgcccacctcggcctcccaaagtgcggggattacaggagtgagccaccacgcccagcctctttttcttttttttctgagatggagtctcactctatcgtccaagttggagtgcagtggtatgatctctgctcactgcaaactccacctcccaggttgaagtgattctcctgcctcagctttccaagcagctaggactacaggcacgtgccaccatgcctgcctaattttttttttttttttttttttttttttgagacagagtcctgctctgtcgcccaggctggagtgcagcagcgcgatctcagctcactgcaagctccacctcctgggttcatgccattctcctgcctcagcctcccaagtagctgggactacaggcgcccgcgaccatgcctggctaattttttgtatttttagtagagacgggatttcgccgtgttagccaggatggtctcgatctcctgaccttgtgatccgcccaccttggcctctcaaagtgctgggattacaggcgtgagccaccgtgccaggccaagcctgcctaatttttgtatttttgtgtagagaggaggtttttgaagccctgtttcaaaaaaatcaaaaaataaaaaattagctgggcgtggtggcacatcgtgtagtcacagctacttgcaaggttgaggtaagaggattgattaagcccaggaagtcaatgctgtagggggccgcgatcgcaccactgcactccagcctgggcaacagagcaagactgcctcaaaaaaaaaataaaaaaggaaataaatgaaagtgctgcctcggccaggtgcggtggctcacgcctgtaatcccagcactttgggaggccgaggcgggtgcatcgcctgaggttgggagttcgagaccagtctgaccaacgtggagaaaccccatctccgctaaaaatacaaaattagccggggtggtggctcgcacctgtaatcccagctactcgggaggctgaggcaagagaatcgcttgcacccgggaggcagacgttgcggtgagccgagatcgcgccattgcacttcagcctgggcaacaagagtgaaactccgtctcaaaaaaaaaaaaaaagaattccaagtcccaacagtaactgagtcaggaaaggggacgcgccggcgaagtggtccatcctgcccaggataagttactatccacaatcaccatcacttcgaattcaaacagaaaagccaccaaaccccagaaccccagaagcagcatgaaaggagcttctcctgcggagcgctctgctctttcaacagcccgggacaccgtcctgctttattctcttgttgtggacaggctcaacgccctctgcacccaggagcagagcggccgcggccaccctgaggcagcatggaaccgaggcccccacaccgggacctacctccactcccacaactgaggctggtgcagcacactaacacgcaacagggcagaaaccagaaacagccccatccaggaccagaccccggccagccctgcctagtccagccccagcccgtctctgtgctcagtcctgtaacttgcggcccctcagctcagcctggatgtctgtggggtggcacggtcaccattaaaaccctctgagtcaaggcggggcacaatggctcacacctgtaatcccagcactttgggaggccgagcagatcacttgaggtcaggggtttgagaccagcttggtcaacatggtgaaacaccgtctccactaaaaatacaaaaattagcttggtatggtggtgcatgcctgtaatcccagctactcaggaggctgaggcaggagaattgcttgaacctgggaggaagaggctgcagtgagccaagatcgcaccactgcactccagcctgggcgacagagggagactatgtctccaaaaacaaacaaacaaacaaacaaaacaaaaacgcttctggctcaaatccacagagacagcaggtcagtggtcgccagggcataggtttctctgttctgaacgtattgtgctgaatcactgcacgtttgtaaatatactgaaatctacttcatttcatgcctagaacaggcagattttgtggcatgtaaattatatctcaactgttcaaagaaaggaaccaccttggctcagcagcatcacaggacaggacaaaacaccaggaaggacgtgaggctccatctggaccgcagctccctgagggctggaggcctgggcagagcagaggagggtcctcaggccccagtcacagatgagcaggagcattagggaccactcagcacagagtgggccacatggtggatgcccagcaggccacccggggtccccacatccctccgcctgtctcactgccacgtggacaaatcagccaccagccagtccaagaactcctaaggcagtggttcccagcaggtgactctgcccctccaggggacactgggcgatgtatgcagcatctgtggttgccacgacttgcagatatctaggcatggagtgggtggaggccgggtacgctgctcagtgccctgcagtgccccaacacccccaccccaagaacaatccagcctgatgtccacagtgccacggctgggccagagcacacccagggctggcgtcgccgctcctgccctctggtcttcctggctctccaaagctcaacgcaagtgagcatcacccagaagctggttacaagggcagaactcacccccacccacatgcccctccaggacccacatgcctcggccttgaagccacctccacacacacacaccaagccttctgcccagagattgccttttgaaaacccctgcaaaggagtaaaatagacaaagaggcccaagcctctttgaagagagagcttcaggaagaacgcaagcggctaaacgcctgtgaatgagtgaaccgcactcataagcagggcagctgacactacagctgcaccccccaaacaccccagccctgctggtggtgcgggaggcgaggctgcggctttcatgcttgctgctgggagaagctctgtggggagcgggcgctttcctgagggcctctacggcttgagtccattcataaaacgaccccacatggaaaccacccacatgtccgactatgtatggaagctgtgtgtaaacaacagagcacagccacccacgtcaaggaccgaggacagctccctccccaccatgacggctgcaaagcacacacaccttaggcaatcacgcctatggttcagggacacaaatttaagtgataaaactacaagcaagtcaaggaaattaaacttacagaagtcaggatcattaccataataattagctgtacaggccgggcacactggctcacgcctgccatcccagcactttgggaggccaaggtgggtgggttacttgaggtcaggagtttgagaccagcctggccgatacagtgaaaccccgtctctgctaaaaatacaaaaattagccaggtgtgatggcggccacctgtaatcccagctacttcggaggctgaggcaggagaatcacttgaacccaggaggcagaggttgcagtgagccaagattgtgccgctgcattccagcctgggtgacagacggagcaagaccctgtctcaaaaaaaaaaaaaaaaaaaagccgtacaatgtcctatgcactgcatattttgcaatcaaagcagctcagagggaaaacaaagcacatttagaatccacgccctctggtccaccaccaccgtgacagcacgggggacgagggcacctggacaacagggacgcattcgggaattctgggagacttttcttaccatcaaggggggtcaggggcttttaatttggggttgattctacctccaagagacattctggtctgggcacacctgtggctggcatgaccagaggagcccctggcacggagtgggtgggggcggggatgctgctcagcaccctgtagtgcccagaatagctctacccagagaatgatccagccccaacatccacagtggtgaggggcagacgctgatctagtggaatgactgacgttattaaaaggagagaaaacccgctcagttcggctgggcgtggtggctcacgcctgtcatcccagctctttgggaggccgaggctggtggatcacctgaggtcgggagttcaagaccagcctgaccaacatggagaaaccccgtctctactaaaaatacaaaaaattagccggggtggtggcacatgcctgtaatcccagctactagggaggctgaggcaggagaattgcttgaacctgggaggcggaggttgcggtgagccgagatcgcgccattgcactccagcctgggcaacaagagcaaaactctgtctcaaaaaaaaaaaaaaaaaaagaaaagaaaacacactcagttcaaatttaatctctttatatcttttcctttcttttttttttttttttagttggagtccgctggggaggctgaggcagggagaactgcttgaacccaggaggcggaacttgcagtgagccaagattgtgccactgcactccagcctgggcaacacagcgagactctgacttggaaaaaaaacaagaagaagaaaaaaaaaacaaaaaagaaaaaagaaaaagaatatatgggctgggcacagtggctcaccctgtaatcccagcactttgggaggcaaaggtgggcagatcacgaggtcaagagattgagaccatactggccaacatggggaaaccccatctctactaaaaatacaaaaattagctggatgtggtggcactcgcctgttgtcccagctgcttgggaggttgagtcacttgaacctgggaggtggaggttgcagtgagccgagatcgtgccactgcactccagcctggcgacagagcgagacttagtctcaaaaaaaaaaagaaaaaaaggctgggcaccgtggctcacacctgtaatccagcactttgggaggccgaggcgggaggatcacgaggacaggagattgagaccacggtgaaagcccatctctactaaaaatacaaaaaattagacgggcgtggtggcgggaggctgaggcaggagaatggcgtgaacccgggaggcacagcttgcagtgagcccagatcgcaccactgcactgcagcctgggggacagagcaagactccgtctcaaaaaaaaaaaaaaaaagaaaaagaaaaaatggagaaaactttcccaaaactatgaaaaggacttgtgagaacaaaatattaaaagtcgtttgttttttgtgccaattctatcgagctttagaagctgaggacactcccaagtggaccaagacacatacacatgagaccactacttctcacgctttttggactcatcttaataggttttgcatgggaacccgatacgtttacacgtacacacaagtatcacatgcagaaatcaaagtttcaggacaggacggttactgtatgtgcctgcactctggtctcttctagtttcttttcctttttcttacctagcataaccattaaattgaattcacaacccacaaagaggtcacagcctgaggactggaaaacagtgaactagacaacctcagcgctctggcgcttccagaaaaccgcgtgtcactgcagcatcctccgcatcatccagcaaggagggaggtgactgtcatccccatttacaagggaggagacagagcagggggctctagatgggccgccccatgaagtcagccagtcagcccaagcacctggactcggatctcccaaacctcatgcgatttctactccatcgcactgcctttccacgtggctttcaaagtcattgctaagccttgtttccatgatgccacactcaagttttaggtgaaaatctattacgaaatggaaactttttttggaaactatactgctgcagaaaatgcgcacactgtctagagtctttgttccgggtgcagtgggcgggagggaagaacctacaacatacggtctataggatagctgctttttcaaagtgagtgggggtgctggaggtacaactagaactgtcattgaacagtcatttgctgctctccaatcaggagactccagcagctgcagagaacatccagaatcagacatgaacacctgagttaccaccctctggaccataacaatcgtcttccagtgagaaagccagggtccccagacactgcgtgtcctgcctgaaatcacccacccgccaatggcagggccaatgaggaagcctgggactttcaaggacaaccctgcgccgttttaaaaatgtttcccagccgggtgcagtggctcacgcctgtaattctaacactctgggaggctaaggcgggtggatcactgaggtcaggagtttgagaccagcccgaccaacatggtgaaaccctgtctctactaaaaatacaaaattagctgggtgtggtggtgcatgcctgtaatcccagctactcaggagctggggcaggagaatcgcttgaacctgggaggtgaaggttgtggtgagccaagatcatgcctctgcactccggcctgggcaacaagagtgaaactccgtctcaaaaaaaaaaaaaaaaagtttccaccaccaagacccccttgaaggggcccagacttgtggggaaggcgctatcaactcacaccaattccaaaggaagaaaaccaggctcaggggcttcccagtgaagacaggcacatccccctgaaaaccatgccccagactagaggtgtggtcctccactggacagaccccctggcccatcgtcagggtcccagaacaggctgctcagtgacatgcgctgaagggagcagggacgggcgctgggagatcctgcctgtgcagaaaaagtcctctcgggaagtgaaccacatttccaatctgaaccaagctcagtaaaaaccaggcccatcagcgatgctttcaactcacaaagaatctgaacattactccagttagttacacgttgtaaccaaagcagttagggagagcttctgagatgaagaaaaccaaggaggccgaagggaagtggggtggagaagaacaaaaatgacctcattaaggtgggggcaggcgaagccacaccacttccaggaaagtgtaaaggtgtaacaatacggcaagagctcgggttcccagagagagggacatgggctgagggacatggtgccaggaagcaagtcccttaacttccctgccctcctgggcacctcgtcctggacacagcctctggtactgggactggtgcggtatcagacggcggctctctttcaggcctgccttgctgtccacgcagggaagcaggcaggcagtcgctcaagtaggacactttctaaggctcccactgcccaagggctgcacgggtatccttaatgaagccagacacgtggtggccactctgcccattcttcttcaatctaggtcacaggttgggggaagggaggagcgggaaggaaacgatccccacggttgtaattttacttctggaaaactatttcctcgccctggctttcaggttcctacttgaagtcagcttccccattccagcttcccgcaagctgctacctcactggggatcaggatgccgctgtccttcctccctcctggcagcagccccaccttcctgggaacgggggcactggaggcaacgccccaagaccctgcctggttccgagccaggcctcagggagcgacctggacacgcatttacacgacccagaaggaagaaggagtttctccagggacggcccaggaccccctgcctcggtctcccggggagggtccgggggcggggcccgggcccctgcatttttaatcggtgattcggaaacacactcaggttgaagaagctctgcccagagacctcgcaagtctcctgggagggtggcccgagacgggggcaggtgggcccgaatctccctctgagagagtaaactgagggtccagggggagggcacctataggcggggcccagggcattgcattttgaacagcgcttcccccaggtgatccgatgaggcgaggatccgagatgtgctgctccaaggccttcgcccctcgtggggaaactgatgctgggggaccgaggaggtgggcggcgccccaggcccaggccaggcagggccggagccctaagcgggacctccaactaagacagagcccgggcgggcggcaggccgagcaggcccagtgagcagggctgggccctgggccggggctgtgaccaggccgagcagccccttggcgcgccgggctcacctcgtcctccttgtggttacggatgccgcggaccaagtcctgcagattcttgtcgaacatgcggtcgatgctgcccttcaccatcttgagggccatcgcggcggcccacgggcttttgcctcgggaggcccgcggctgggcgccgtgagggggcccggggcccgtgcctgccgcccgcggagcgccgcgctgccggccgctgcggcggggcaagctcccaggccagggcggcggcggggtccaaggaccgcggcagaggcggcgacccgctcggcaggtgccgcgatcccgctccgggccccttgcaaatggcggacaa

SEQ ID NO: 1529 - DNA, 50570 bp, Homo sapiens; identical to SEQ ID NO: 1528

SEQ ID NO: 1530 - DNA, 14461 bp, Homo sapiens
gactttcactttccctttcgaattcctcggtatatcttggggactggaggacctgtctggttattatacagacgcataactggaggtgggatccacacagctcagaacagctggatcttgctcagtctctgccaggggaagattccttggtaagttggggacagttgacctgcctccatcttattctcacagcttttgtagataagctgggagaggttaggtgactggttcagatagacaggaaagtagcggcaaagcctggatttgcacccaggcttgagtctgattgcttcccctctcctgctgggctcttaaactatagagggttggggaaacagctcagatgggttcacaaagctccctgggctcagccctggttttgactgctgagacacgactgagtgaacccagaaggaaggtttgtgttgggggtgcccatctctttgggaaatttgaaggaaccaaagaaggtggaggagaggaggtgacccagatcccagcctgttcttatggccaggccacaccaaggctggccccagggtgctgctgctgaggcccaatgggggcaacagaattttttttcaggtacaaggagttcagaggtcatctcacccaccctgagtctgagcaccaacttgtgccaggccctgtggggaaactgaggccctgggagcggaatgacttgcccagggtcccgtgtcaggaggctgagcaggtagatcataggactccacgtctctggccctcacctctgtccctctgttcagacttctggggtgatggagaagaaacaggctgtgctgtgtccctaatgggaaacgtggctgagacaggggagtgagaagggtgcgttgcagaatggtgcctgtggcatgatgccagctttgcaatcatgagattcaaaagccacactgtggaattgtgagtataactacaggagtgagagcttagatctctgtgttcatagaaggagaatcaaacctggaaacttttggattattaaaatcaaacatttttgcttcaatattagagtcacaagggcagatgttggcctcccctctgccctccaagagctgtgtgactctgggaaattcacctcccctcccagcctgagtattttcccctgtaaaaaacctgatagagctgccaaaagtccatgaaatcaggggggtaatttctgtgaaatctgagtcatggtcttatttgttcttcaccaaaaagagatgatgaagcctgtaaccccagtgctgtgggaggcagaggcgggaggatgacttgaggccaggagttcaagacagcctgggaaacacaggagatgctgtctctatgaaatcaaaaattaacaaattagcccagcatggtagtgtgtacctgtagtcccagctactcagaaggttgaaggaggcggatcacttgagcccaacagatctaggctgcaatgagctaggatggtgtcaaagccctgcagcctgggtgacagagcaaaactgtttattaaaaactaaacgaaaggccgggcgcggtggctcacgcctgtaatcccagcactttgggaggccaagacaggtggtcacgaggtcaggatatcgagaccatcctggctaacatggtgaaaccctgtctctactaaaaatacaaaaaaattagccgggtgtcgtggcgggcacctgtagtcccagctactcgggaggctgaggcaggagaatggcgtgaacccgggaggcagagcttgtagcgagcctagatcgccccactgcactccagcctgggtgatagagcgagactccatttcaaaaaaaaaatgaaatgaaaatggtgatttctcaggaggagcacactgtctcaacccctcttttcctgctcaaggaggaggccctgcagcgacatggagggagctgctttgctgagagtctctgtcctctgcatctggtgagcttggctcagagccctgaggcgggagggagggctccctgtctgggctgcacaattggactgggcttgggctgggccagggccatctgggcttcttctaggaaccaaagtcacttcccggaattgaccaaccggcagactcgcccagggaggacccgctgtatcctagttgaggctaacggtcaatatccggcctcaatattcagcagaggctccaggtcagggtctgagccaggccaacaatgaccaaggaggatgggatccagggtgcagctcctcacaagtgtcgggggaatccgaggcaccagctctctctaccctcctgctcctctgctctctcctggtcctcctgtgtcctcatggctcatgagatggtgttgagatggctcccctggcctaggggatcacacagtgaacaaagcaggaagaaggcgaagggatgcccctctcctgtcacccttgtcccttacagcaagaagggcccagacgcccctctgcatactcccctggtgaactgctgcccaggactgggtcccccttttacccttgctgcatggagtccccagaagacaaacatctgtgtgtctgaaccctgagacaaaggcaggaaagggaaagagggaggcgagtggcttttgaggagggggctttagtatgagagctggaggatggaaccccatcagggggcccgggaaccactgagctgttaaaataaagtctgcaaacaaagaccagctgctggaagtgggtgtgccagggagtgcgcagagacacacggtgagaaaagaacaatggtaatgcttggagccgcccctaactgggatgggcctgaaatggtattgttattatttatagtatcattattagtcattttcatcttatttgtaccctccctctatctctcctctccaccttttcctaacattctatcaccagttttatgtcttccattagcaactttgtagctgtaaataatttacttacaactttcatataccctcagttgtacccagtatttcttaacttccctctttaaaaaaatgataatattaatcctccttctccttcgttcagtgcttcacatcccaactgctacctttgtgctttaaattttgtactaattggtgttgataacaagtatatttagttctcatatttatatgttgtgtatatgttttggtttttttttgtcttaaacaagagactactgagagccagtaagactgaaagaaagggcatcttcatatactgctagtttgagtgtgaattggtacaatttgcctgcagtgtggctctaggtataaagccttttgagttgttgatagcctctgacctgctcattctactcctacaaatatcttaaggaaataatctcaaatgtgggcaaagttttatgcgaagaaggatgttctttgtagcataatttatatgaggaattagaaacaccctgaggtccatcagctagggaaagacagcagaggggacagggcagcaccaggagggcttggcagccacagcaggggctgggctggcatctggcaagatccaggtctttgtgggacaaagaatcttagagaagcaacggggacacaggctgtccagtgcagcaccagtgaattcaccaagatgaagagttgagcacagagtgtgagacaaggatttgcaatgaggagtcatttaccatgagcgtgtatacatgactcaatattgtatatttaagggagtagagcacagtcattgaaaacatggggttgaagcagaagtcctggctctagcactattgtaaaaacactggcaagttccctaacttttgtggattcctctgtgtttgaatgggaaagtggtacccatctcctggcctgtgtgtgatcatcgaatgagacacatgtaagaggctctgcacatcgcagacatgcaatacacactggctatcaccagctagttatcacacatgctcccaggccctggtcattgtcagaaccttcctccccatctctatttctgtgtatagactctgtagtttctgtaatgatcagatggctgcccgtcctctgattatcttctcctcataccccaacaggatgagtgcacttttccttggtgtgggagtgagggcagaggaagctggagcgaggtgagtgtctgcaaatagcagatgatgggggctcagtgatagacaaacaatctggtttaggttggtcttggtgtttgcttccaccccagagagatttgcagagccccggctgctcaagcaagcctccctctgtccactggtggctcacatttgatcccacaatttgttttctcctcctcaagggtgcaacaaaacgttccaagtgggacagatactggagatcctcaaagtaagcccctcggtgactgggctgctggcaccatggacccaggtaggctcacctcctcttccctgctggttcctactcgcacttagaatggagggtggcacctccacagctgagtgagccccagaagaacccggatggactaggaggccaatgagtctgcccaaagcagcagaagaggtcacgtggagtcccccgacccaggggtctgggggtcatctgcatcctgacctctccttagggtgacacggcccaggtgcccacttcctccctaccctggcacctagcaaatgactcaagtggggcaggacatccttggggaagtggaatcagcgggggggggggggagtgtggggagagcagggtccaggaggagaggagggctgggagaggaggttgaccagcagccccgacctgtcacctcccgctctgctccaagctgaccctggggtgtttccacctgaggctggtcccctccctccagctcttgccctgccctagcccctttgctctgagtggccctgtgggaatgtatcgggcctgattcagcttccagcttaactggaccccggtctgtcctttgccacatcccctctgtgtgacctggcgctccttacctcccttctcctgtaccatgagaataatatttccccatgttgtcttgaggatcaaatataacacggctacctggcctggccagtgcctgccacacaatagggcctccctaagggctggttcccatcccctctactggtcccctgttgattccaggtggaagccaccccgtccccccccagctgtgttagggcacccgccctgccctgcccatcacaagcacctgcttaccagggatgactgcctcaggcaggggctgagttcagtcatctaaaatacccccggtcaaagaaaaatctgaggcccaatagaattttaaagagttaattgagtaagaaaggattgctgaattgggaaacagcaaactggaggaggcttcgtgctatggtgaaaaagtgtcggagacaaggtttatcgggtgaatatgaaactgcagtaaggacattatttgattggttgcacttacaaaactgcctgtttgggtttaccttgttggaaaatccctggtcacgttggtgccagtgtgagtttagggaggtctccgaatacaggtgagaccggaacttagccttgcccaggtttttgatgctgaagagagaaaaaagtcaaagcaaaagcaaatcagcttttagtgcaaaacagaagtgcaggctcaggggtgggagtgcaggcggactcagaagagccagtcgggcccagtggagtttggggttcttgtctttgctggtttattaaattaaggtgtggagtaagcataaggatttctgggaagaggtggggatttcttggaattgggagggcaatgcagttttgtaccaaacatgggcatacatggaacggctgtggtgcgggtgggtgtggggtttagtgagacaaggagggtatgattgagtgtgaggcaaaacgtgggtcagacccagcgccgagttggatctcactggtcttagctgaattggccacttcctgtttgtcaggatcctgtgggcccatcccctccccctgtccctacaggtggtttcagcaactccttctgtgtctgtcatgtgaacctgctgcctggagttcttgtttcttctgtgacctcccagtatccacatctcagcatggccctctgtcagctggctttaagttttgtttgtatctaacagaagtacccatctgatatgaccccagttgagtttcccatagcttgcagtttcagggggttacagctgttctaaaggcctcgtaggtattgcctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgccacggcaaccaagtcagctctgctcaggagccgccctggacagcaaactgggctgtgctgagtcctgtccaagacgaggggagggcagggaagattagaagccgagagcactcagccgaccccggaatccttacgaagggctgggctgggggactgaggaaaaactctccccccaaaacaagatgatctgtggtttaataacaggcccagctgggtccagaggtgacagtggagagccgtgtaccctgagaccagcctgcagaggacagaggcaacatggaggtgcctcaaggatcagtgctgagggtcccgcccccatgccccgtcgaagaaccccctccactgcccatctgagagtgcccaagaccagcaggaggaatctcctttgcatggtagttgtactcaatgctgtggagtttgagacattatttttaaactttaaatagccccacaggtaagctataagggagaatgcagagaccacaggcattttcaaaacataaggagttttaatgttaaggagtttaaggagaatgtcaaagaaacattggccttggagtcaaatcctgagcttcctgcttgatggttttgggcggtgactctcgctgtctggattttactttcttcatctgtgaattaagaatgaggtggccgggcactgtggctcacgcctgtaatcccaacatttgggaggccgaggcgggcagatcacaaggtcaggagatcgagacgatcctgtctaacacgatgaaaccctgtctctactaaaaatacaaaaaaaattaccaggcctggtggcaggcgcctgtagtcccagctactcaggaggctgaggcaggagaatggcatgaacccaggaggcagagcttgcagtgagccaagatcgcaccactgcactccagcctgggtgagagagcaagactccatccccccaaaaaaaagaatgaggtctcttgtgtgtgcacggcaagaaacaattttacatcatgcctcagtgcacacacaaatacatactggtccccagttccttatctgcaattccataattcccagatccctgcaaaccacacgttttggtggcagctgacttcaggagtaatcctgctctgtactgacttgagttctttgtagacctaccattattttttacatttaatgtgaatatttgcttgtttcactgttgaaacatgtgtgggtgtgattacagggagcagtccagcctctgctgggaatggtcaggaatataccatatgcaccccgtgtcctttctaaaatagtggaaattctgaatgcctaaacacatctggattccaggaatttacattaagggatatatatttgaaataacccacaaaaacaatactcacccctgctacgcttggtacactctgatattttcaaattgattttctttttaaaatgctgcttttgaaccaataatttcataacccaatgatgtgttgatattcacattttgaagacactggtataaagtgtttgacccaacaggcatgtggcagatggaagtgatcactgggatgtttccacttccttggcctggaaggctcacttcatgttggtgctgagctgaaaaggattcattcctctccaaagcaccatggcactcccctggtgtttcaatgttctcaggctgccatagtaaaatatcacaggctgggtgacttcaacatctggcttttattttctcacagatccagaggcaagaagtccaaggtgaaggtgccaaaagggttggagtctggggaggactctcttgctggcttatggaagctgcctttgcactgtgtgctcacacagtcttcttgtgtccctttctgttcttacaataggacactagccctctaatagaattagagccctacccttgtgatctcattcagtcttaattgcttccttaaaggccagatctccaaatgtagtcacctgagtttaaagcttcagcatatgaattttgggggcacacaattccctctatagcactaatgactccataaaacaagtcccacatcacagctgtccaggaaaattaacatgtagtcatctcttatgcaatggctgttatgcactcccacactttcctccaaccttatcctttcttctttccaactagagagcagtatctttattgaggatgccattaagtatttcaaggaaaaagtgagcacacagaatctgctactcctgctgactgataatgaggcctggaacggattcgtggctgctgctgaactgcccaggtaagctccatggggttacctccattgggcactccggcgatgccacccagctctcccctgggctagttttccctgacaggcacacctcctccaggcagccccctctgctgggcttgaggatgaccttcttggcactccaggaagaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattgtgagaaaaatgagatcgtgcatgtaaagtgcttagcataatgactgacacacagtaggtgcacagttaacgttaacatcttacaagcttggtggaaacagaaccagggttaaggatcttcttcttgaagatgggagcccagcaggacttgacctttgggacaagtcagaaaaatcctgacctaaccaatgtgtgttcctggggatgctggctggagccctttttctcatctgaggaattccataaacacggcaggacccttctgctggtccaggatgccgagaggctggagtggagttgcacagcgctgggtctctttccagctctgtctgtgtccagtccctgggctctgggcttatgtcagagactggaaactgtcatcagtctaataggaatagcaactcaatgtgataggagtgtggtgaaggccttagaggcaactccaggtcaaaggtggggaaccaacaccaagatcctgcccaaaggcccagagagaccgggatcagcgtcagagcctggagtcaggatggagcaagagtcagccttggttgtaggacaagcaggaaggctggggcaccagggctgggactagggtgtggaaagagaggcaccaagggcttgaaacttaaggaggtcatgaacttgcagaggacatgtgagtgggagagggatatttcttccctgtctggatgatcccaacactcatgggcatatagggtcatggttgcctgtgtctctcacaccacgccttggaactggcaagttctgggctaccctttgagaccttcttctcttctacacagagaaacccctgacattgacaagcagtatgtcttagtgaccattttcatagtagaattagttgctgccaatttgtgtaatttcagggatactgagcagactcacaacttcccaaccaaggaggaaaacacttcctctaccatcttgtccaaattcaggtcttttcagcattagcaatttatataggtggttctgaaagtgttttgaatcttctagaggttccataaaattgcaaatggccttggtgtgcacacaggtgaagctgtcactactaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagaaccagtagccttcagccaggtgaaagggcatgaggcattggaagggagcagatgccaggcaaagtgaactcctgtctctccggggttttgtttttgtttgaattcaaagtactcagagatagccagactgcaatgtctgagggcacccttacctttgacaccacctgcaaatttaaggggatttctaaatccatcctttgattttgtaattcactggaaggactcacataactcactgaaaactgctatttcacaattgtggttgatcacacggaaagaacacagattaaaatcagcctaagaaagagacacacggggcagagtttgggagggttttaagtgtgaagcttcattgtcctcaggacgctgtgttctcctgtgtgaatgtgggacaaaacacatgcggtgttgccaaccagggaagctcacccagttaaggaaaaattcctgtgaatcacattaaaccagaaatgaagccttttttcaggattgttgttacaggggagggagactgagcccagctccaaatatagtaaagacagagggggagtcacagccaacaccagggtgggggcgggagatggaacaggactgataggagacaccagagtggggggttcctgctaaattggcctaacaggattctcactaaaggcaggtcagacactcacccatcaatggtgggggtgaagagcataatcagatagcaaagcgtaatcagacagcaaggggggaagaccctccctaaactgacttggggagattcttgctgagctgggtggtgcaggtccagcaagcagtgggtggctgtggaaggccaaggtcggcgcctagtggagaagaggctcagaagagcccagctggagttggtcaaggagaaagtccttctttctcaacccatgccttagtgtccagagtatctgctggggctggatcacaagctgccctcatggctgacctggagtctccagcccctccctgaggtctaacccctttagtccccgggtcctctgggatcaggaaagacaccaaatagccccaaaccccatcatccatcagattcctatacggtcccgtggccaaatcaccaggcaaagacagatgttcctaccaggcaggacattccaggggcctggagatcacttcccaggagctgaggacaaagggaaggcctctctttgggtaaagttcatgcttcactttcctgccatcctgggaataaggtctctttgtctcactctcactgctctttgttcatctgcagagttttccctctccaaacactttggcagtcacggtgttgacctgcccttgaatgaggaggcatctttatcaaacacctaccatgaaagagcatctgagatgcctttaagatatttatttccatatggaataaatattgaggagtatctatgatgaacaaaatgtgtttgagtttgaaagataattaattccatttgtaaaatttgtttctatttgatcgatagtgaaagctctgcaatttacacaggatagagatcacatggagctcatttcacagacagggaaactgcatttcttttttttttttttttttttgagttggagtcttgctctgtcgcccaagctggagtgcagtggcgcgatctcggctcactgcaagctctgcctcccggttcaagcaattctcctgcctcagcctcctgagtagctgggactacaggcgcccaccaccacgcccggctaattttttgaatttttggtagagacagggtttcaccgtattagtcaggatggtctcaatctcctgaccttgtgatccacccgccttggcctcccaaagtgctgggattacaggtgtgagccaccacaccgagccaaaactgcatttcttaatcctttaacctttccttgtgcaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctgga

SEQ ID NO: 1531 - DNA, 14461 bp, Homo sapiens; identical to SEQ ID NO: 1530

SEQ ID NO: 1532 - DNA, 14461 bp, Homo sapiens; identical to SEQ ID NO: 1530

SEQ ID NO: 1533 - DNA, 14461 bp, Homo sapiens; identical to SEQ ID NO: 1530

SEQ ID NO: 1534 - DNA, 227273 bp, Homo sapiens
tccacagttaggaaaagttttttccatttaatactagactttcaaggattgagatgcaagctttgtatgcaattacatccaatgttaaaattggtaatacataatttacaaagattaacatcaaaacaatcatctatttagatatgcttttgtaaaaaggaaatatattagcagcatttatattttccgcaatcacacagcctacagacatgcagactaactctgtatctatttgcagtgatgtagtgctttgccccgcatttcaaacaccaaaacccgcctggcagctggggggttctttttatttcgttattataaaataactgaaaaataaaaaaaggcattaatttctacaccagtaagaaaaaacaagtttttgcacttacctaacatttgattgtctaaaaaacatttcagtttttttttagtctttcaacaaaagaaagataaaatgacagagcgtagtgtcttttgcttctgttctcgcattttacaaagtttttttttctttttcatcttttttaaaattttagtgtttaacactataaaggaaacattgaattttaatctctttcttgtcattttctcgcttttgactaaaaggagacccccaaagtgcccctagtcccacctccctcccacccactccctgcaatgaaaaacaaaagaaaccactcaaacgggcttggacatgcgatttttccagctccacatgtgagtatcttatacccaggtctcttagtaatgtacagtgcttctctacagtaagaaaatactccaaactattttcttaattctcttttttctttaataaaatatttattttgctttttctctgctcaaggggatcattggcatcccctctctcttttgttttttcctcaagaatgacacagaaaggggaaaaaggaaaaaatatttaatggaatggaaggtggtcaatgtgtctacctaaacgagtcagagcatcgtcaccataaggggaaatgtacaattaggacagcattggtccaatattagaaaaaagtaatggggacatgtttactattgtattgcttaccaatcacacagcaggtgtgtgtgtgtgtgtgtatatatatacacacacacatatatatatacacacacatacacacatatatatacacacacacacacaacttggcacatttaaaaaccatcttttctcttataagaacatctaaaacatatatgcatatgtatgtctgaaaagacaacaaagctttttaaattttatttttaaagagacagtatagtctgttaacttctggtcaagagagtaggaaggaaggagacaccctggatatacctcctgatgtcattcaggagggtgagggaagatgggctaggggtgaagagaaatatactgtctctttaagaaagggacattgaaaactgtacaattaagaaaacaagagtagtgttttcaattgataatctatactcacaacaaatactctgataggtgaatactgctgaacagtttatgtagtgacttttgttgcaggggtgggtttagagttctttttatgtaggtttttaaatgattttattttgaactgaatctccatttgcacagcacagcagacacacaagaactacagcgcattaaaaacagcatgtgtgctggcgggggcctggctttctcattagaaaaaaatatgtttgacaggttatgaagggtaaaacaaaaataattgcaagaactaccgtgcccttctgaccccatgggggccttccctatcccatgattccattttggggagtagaggtagggagggggcagcagttacaagtgctttgagctgtcaactcacattttactttgacctggttgggcaagaaaggagagacaaacttccctagtcaggtatctaggaagaagcctcagctactgtttctgtttaaggtctctggggtagctcttggagccaacagagaatagatggggtaggaatagggatcctggccctatccctttggattttgagttatacctgggtataggaagcagcttcttcgcaatgcctgtgggatctgaggatgacagaaaaacctaagctgtggggtggggcaaatgctataaagtaccagtaggttctggtcatcaatgtggtcctccctcctctctacattattaacccttaaggtgaagcaatggagaagaaaattaattaacctgaactgtcttggacagaaccctttcctctccctctccactagctccaaggcttattaagtacctaatgtcaacaacatggccccattccccttgcccagatggacccttcccacccctgtctatacccagagagcaggaggcaggactgattagctccactggatcccagatgcttgaggttctcattctttgagggtcactttcgaaagctgttttctgggataaacaaagtacgccttcgcagtttcctgcctgatccttcctccagcaagtaggtcacatcaatggctgaaaacagaaccaaggaggctcatcaaaataccaatctcctactccttattccagatttgagctctaaggagagcacacgaactcaatgattccttttctgacctataagcaatttagcccatcctccaaccctacgtgaaaaaggtggttctttagaggagatcatctcaccttccagtttcactaccaagatacaactaaaagcaagcctataaaagaactataccattttcttagaatactttggatgctgaaccagtaattacaatttttttccattccctctcatttcgcatttatcttaaaccctagatatgaacctgattcttcttaccattttttccagggattttttcaaggagattgagcaagatctggttgagtcgttcccgttggttatgccgtcgttcctcaggggtacaggttgactggggttcttgactactttcctctgtttttttttcaccctcactgacgttagcagtggccccttcccgttctggctcctccaggctgggtatctcattggctgcttgctcttgactggctagaacctcttcaatcaagggtagagcatcatcctcctggcccaagtcttttaggggtggctttgagcgctcagacttccaggatgatctgccagaaggatatctgaatttagtgtaagacacttgaggaggaaaaggggatgaagggtaggaggcctcaagatggcttgagatcctggagtccagcagttagagccttagcttgaggtaagaaacttgactctcgttttcactttatattatttgaataaaacactacctttaccagaaatttatttgtaaaattcaacttttattatttctcttaggaatattcacaaatggtataggaatccataaaatatacaagggctaataaaattgcttagctggttctaaatgactgcttcatgactagagaagcacggcacaaccttgtgatgccaataatccaactacaataataaatatttaaatggagttttaaattttcgtgcttccctttttcatatcaatagtctaatattttctcccttatggtaagctattggtgtaggtaaagcagttgttatgcccccattcaacagatgaggagactgaagaaaaagccttctgtcatctttcttcaggaataatcctcacgtacaaaataagcaaaaataaaaactatgaacccatagttcatagctcagtgaaaactgtactggctacatctgttccttgatagaggtaccaagagctgatataccttgaggtaatggggaaagcttacagacatctaaaagaaacttttctgagtctggagttctgttccaaatctctgtctctactccctgcacatctctctgttgctccaattaaggctccataatgggaccacatctactgaaatttagttcttccatagtgctggcactacactgggctactctgcagagaatacccagtcctagaagtggagctgagtgggtagttgtttgttttcttgatccattcaagctcttagtcaatcccttaggatcctcatatccccccatgggacttaccgtcctccattcctcttgtagttgtctgggacgtaatgaggctgcagagaagaaaaggaagaggtaagcatattgtagaagctgggagagctagctcttctctggggccagtcaggataaggaacacagtagggcagtagacaagttgggtgactttgttttaagatgagaaatttagtacttctatgaatatgcaggccacaatgattatcagcattttgtgctcccaggatgacaatgggagggataagtgcacaattttctctatcccatttcaccttttaaatacagtcatatgtcgcttggggtcatacggggatatgttctgagaaatatgtcatcacgtgatttgattgttatgtaaacatcataaagcatccttacgcaaacctagatagtatagcctactatacacctaggctatttagtatagcctattgctcctaggctacaagcctatatatacagcacaatactgtactgaatactgtaggcagttgtaataccatggtaagtattgtgtatctaaacatagaaaaggtattacattgcagtatgttacgacagctatgacatcactagatgataggaaggaattcttcagctccattataatcttacgggatcaccgttgtatatgcagtccaatgttgactgaaacatgttgcacatgactgtagttaaggctggggtttcaaagctagtcagtaagctattgattgagcaagcaaaaccaaataagtctagatgcgaggaaagacctggtggtgggcagagaatacaaaagacggtctggaaaattaaaaaaaaaaaatagggaaaataggaacatattgctttgttttctggttagcttatttttctttctttttattttttgagagtcttgtcctgttgccaggctggagtacagtggtgcgatcttggctcactgcaatctctgcctctgggttcaagcgattcttctgcctcagcctcctgagtaactgggattacaggtgcatgccaccatgcccggctaatttttgtatttttagtagagatggggtttcaccatgtcgaccaggctggtctcaatctcctgactttgtgatccacccgcctcagcctcccaaagttctgggattacaggtgtgagccaccgcgcctggccctggttagattattgctaaggattccagggtgacagctatgacttttgacaggcccactaaaagaagactcaaagatgaggagctcagccagggttttattagagcaaacagatgaatggatgatcaaaatctttatggaatgatgaatgacaaaacgtataattggcacacggttctcaacaatttgaaagaaaaaataccaggaaaaagcctgacaatgaaaatgttaataatggttattttctggatagtggagtatatatataacttttttcctcttatgcttctatacttaattttttttttttttttgagacagggtctctgtcactcaggctggagtgcagtggcacaatcagcttactgtaacctcaaactcctgggctcaagtgatcctcctgtctcagcctcccaaggtgctgagattacacacgtgagccaccatgatgtttatacaataaacaccaccaccacaaattttgttttgttgttgttgttgttttgttttgagatggagtctcgctctgtcacccaagctggagtgcaatggcgcgatcttggctcactgcaatctctgcctcccaggttcaagcgattctcctgcctcagtctcctgagtagctaggattacaggtgcgcgccaccacacctggctaatttttgtatttttagtagagacggggtttcaatgttcacaatttttttttttttttgagacggagtctcgctctgtcacccaggctggagtgcagtggcgtgatcttggctcactgcaagctctgcctcctgggttcacgctattctcctgcctcagcctcccgagtagctgggaccacaggcacctgccaccacacctggctaatttgttgtatttttagtagagagggggtttcaccgtgttagccaggatggtcttgatctcctgacctcatgatccgcccaccttggcctcccaaagtgctgggattacaggcgtgagccaccgcgcctggctcacaaattttatataatgatcgtgtcttccatttttaatgcaggcataaaaagaaaaagcactgaattattttctgtgaaggttcttcttttacgggtgtgttctcaatgagagagaggaaaaaaaggagtttttcagggttcttgcttcttaaaattatgggtgtgaaagacaaaacaaaacaaaaatctacagaatggggctcgccagcaaaggttaaacagacgaaagagaaaagaggaaaggtataacactatatcaacaattttctgagatacagtctatgtgaggaaatgtacttatgctgttcaaatgtcccaaatagagacagagatatccatagtttgggatggaatttggatgaagaagcagagaactacgtgaagattttcgctcagtgaatttcatgcatgaaccagattgtcctaacatgtagtgttaagaaaggaaggagactcaccgagaaatcttttttgggagtgagcttcttggggaagtgatcaaaagcatagggtttggtgcagacaggatagcggttccggtggatcttgtaaaacaggtgtgctgacttgtcaagccgataatcacagatgtacacatcttgctcctttactcctttgggtctccctatgggtccaaccagtgttaaggaatcctatttagccatttctccccctgagctgcccaaagaccccatacacaccaatgggagagcagctagacccttaaaaccctacatggtagctatgtagagaggcaggacaactaagcatttggtagttgctggacaaagagttctcagacactagtgtcaacaaaggataaagtaaatatacagcagaatggatggaaataaaccagaaatgtaaactgagtgctgcagggatgtgtgagggagtattttgagggaaaaactgagcaggttacgaggagttacaagaaaagaacagaggcataaatttgagggaagcacatttgtacatgaacactttttaactgagacaaggaggactcatcagtatcacacagaactgcaagcagtctgtcagttttggaatggaatacgtagtcttttagactattttgctatgattctgagagaacagtctaggcaactgaactctgctaatagtgacaaataacatatattgagcttttactctaagccataaactaggctgagtgcttttgtagattattttatataatcttttaagaactctttaaaatagatagtccttattttcaatgggaaactgatacttagattaagtaaattccacaaaggaacatagataaaatgtggtagagctggaatttgaaattagtacacagtattaacaaaattaactaaatttaataaaaaagaataaacttttattgagtactaagccctaggtaaaagaaaggaaaaaatatagtagagctctctgaagtttcatagctagccttggagaatctttcatcatatacaggcaatcatatacaggcaacaagaatggggtgggcaatgaacaggagacatgaggtcattgaagtcttttttttttttttgaggcagggtttcattctgttgcacaggttggagtgcagtggtgcgatcttggctcactgcaacctctgcctcccaggctcagcaatcctcccagtagttgggactacaggcctacactgccatgcccagctacagaggcagagttttgccacgttggccaggctggtctcacactcctgggcttaagcaatctgcctgcctcggcctcccacaccgctgggattatcagcgtgagccactgcacttggccgaggtcattttttaactagcccagatcacttacctttacaatacgtataaaggtccaacacacagcaggtccccactacagcctccaagggaatgatctcatagagtggcacccgaaatagttcattatgatagaaccgacgggatggagagtggtgtgtttcgtggggacggaaataatggtgaccaaaggcaaaccgttcctctctaaaacaatggaaaagtgagaagggagaggtttagctgattagcaagatcctagtgaacattcagctccactggtacagcacggctggaagaaaaggacaggacctcagcacgtacttttcattcttccaaagcttctcaatgcgaaagatgtcaagtttatctcggttaatgtgagataacagtcgataggactgacggaccgggtggccatcaggggtgcgccgactatccctcatcagatacacacagtcacctaggaagacccagaacacagaagaaacataaaacaattcttgtatgaattctgttaggcatctgtttatctgactcagggtctacatagaactcataatctgaaacagtataaatacagagagctaaaagcagcagtgttaagtgatgataatcaattctagactatgacaataatataagggaggcattccatttcttgagcttcctatatgtttttcccagtcttaaaattagctttgtaacatgtctatcatttcaaattagtattatttggtggagaggtgatgcatgtaagcacaaggactacagatataaaaacttatattctattgctattcgaggccgtatggagacaatgactatgatggagacagcagagacttcctactattcagaaaggtcacctctgacaagtaggattagctcctgtatacataccctgacgaagcagcaagtcatctcggagcaaacagatgaagtagacacagccaggttgggcatagtggggccgagggatcatgggaacctcctgataggagcagaaagccaatgtataagggctggaattactacattcagcctacttatttctcaacctagaattctcaatcaaaacttactgtttagtcatttcaatataccacagatatacaaaaaagatgaaagcaactagagctgttaaacctggaaaagtgaaggtagaggacaaaactgataggctaagtatctcaatctatgttttatgaagcactaattgtgtagttgctctacgtaatctaggggccatatgaaaatgtgtgaagggagactaattattacaatgattggggtatgctactggtatttaatgcccagggtccaaggaagccaaacattctgaaatgcatccctcacaacaagaactattcacctaaacatgacaacagcaacattgttaagaaatactgcctaaatctcttctttttttaaaaatgacttgcccaaaatcacacatataaagatagcagagccaagcacagaacccacttaatgacttaggcaagccacttaccctctctcctatgaagtgagcctaacactaacctttgctgattctgagtccagtgctcttttcacttaaaccactgtctaacataaatgacgttaagggtaccaagttctggattttgtaagctattcctttcatggacatctgatagtgtttataaaaacctcagttttgtttttttttgaaatggagtctcgctctgttggcaggctggggtgcagtggtgcgatctcgacccactgcaacttccgcctccagattcaagtgaattctcctgccttagcctcccgagtagctgggactacaggcacgcaacaccacgcccagctaatttttgtatttttagtagagacggggtttcaccatgttagccaggatggtctttttttttttttttttttttttggagactgagtctcactccgtcacccgggctagagtgcagtggcgtgatcttggctcattgcaacctctgccgcccaggttcaagtgattcccctgcctcagactcccaagtagatgggattacaggcgcctgccactgcacccggctaattttttttgcagtttttagtagagatggggtttcaccatattggccaggctggtcttgaactcctaaccccatgatccacccgccttagcctctcaaaatgctgggattgcagccgtgagccactgcgcccggccgaggatggtctttatctcttgaccttgtgatctgcccgcctcggcctcccaaagtgctgggattataggtgtgagccaccatgcccagctttttttttttttttttttttgagacagtgtcttgctctgttgcccaggctagaatgcagtgatgcgatcttggctcactgcaacctctgcctcctgggttcaagtgatttgcctgcctcagactcctgagtagctgggattacaggcacctgccactgtgcctggctaagttttgaatttttagtagagacagggtttcaccatcttggccaggctggtctcaaactcctgacctcatgatccactgcacccggcctttttttttttttttttctaagagatggggtcttgctctgtcgcccaggctggagtgcactggcatgatcttggcttactgcaacatctgcctcccgggttctagcagttctcttgcctcagccacccaagtacctgagacttcaggtgcacgcctccatgcccggctaattttttttgtattttagtagagatggggtttcaccgtgttgcccaggctggtctcgaactcctgagctcaggcaatccatccgccttagcctcccagtgtgctaggattacaggcatgagcgaccgtgcccggccaaaaaccttagttttatatagtgccattccttccacagatttctaagtattttattttccctttggtcatactcctgaaatagggaagaacagaattatgacccttaatgtaaagtttaagaaaccaaggcccagagaggctgaacaacctattaaaggaaattctgcaaagcaggagcaggacaggtgagataccatgtgctacctctcctacttatagatcagagttttatcagaggttcagcttaccctgtccacaggccttgggtcacactgctcacaaaggtagtgctccacatctgagttcactcccatacaatcacagtgctgccatacctgtagaaaaacatacagtttggggaacatggaggctatgacttattgagagtgtcctgggagcccagaataaaaaattagcaataggtcagggtaaagtaaaagaggaactaagggataactgggtgaatgataaattagagataaatggtaaaataggaggaaaacaaaataatgactgttctaagcaaaagtataccgattgactcataatctatagatctgggcaaataaaatggggagatggacagagaataggaaaacaaatagactactgaactattactaagtaatttaagtaaatgctacagctattctgctttcagaatacagctacaaaatgttttatttactcctgtctaactttagcctcccaacaatcctgtgcgttacttacagccactttacacataaagttatgcattcacatatattagtggggacactaaggctcaaatccaggctttgacttcttcatcaggagccctacatgtattaacatatttcactctatcagaggattcaattaatagagtgtattatcactaatgattcaaaaggcaaagcactatatgaaatactgtcattttccttgatccagattatgtgagaagtgtacagtggaaagtgggcagaaagaaggaaagagccaggcgtggtggctcatgcctgtaatcccaacgctctgggaggccgaggtgggcagatcacttgagctcaggagttcaagaccagcctgggcaacatggtgacaccccatctctacaaaaagtacaaaaaattagccgggcatggtggcacgtggcacatgcctataatcccagctactcgagaggctgaggtgggaggattgcttgagcctgggaggcagaggttgcagagagctgagatcgtgccaccacactccagtgtggatgacagagcaagatcctatcttataaacaaaacaaaacaaaaaaacaagaagagaggagagaaggaaagaaaaagaagggaaggataaagtgaaagaaagataaaaggagaaaggcaatatagtaaacacagaaacctaacagaaaccaaggctaagttacagttcataaacagtctttcaagccaatccaaaagaggcatgggcttcttctttgaatatggtcaccgtgttcatcaggaccaagcttctgcttcatttcctgaccctcaccatgcacttgtcacactggatcatgagaccttcatccttgtagaggccacagatacagcgaataacatcgtcgtccttctcatgcccattctccttttcagagactgaggtctcactgctgtctgcctcacttgctgtctctcccacaatctcatcaatctgggctgatgcctcatgccgggcattgtaataggcctttcgtagacgacaaacatctctcccaactggggatttacgcccatagtacttctgaagaaagcaaataaagaaatcatgtttggttctctcaatgtggcttaacaatttacctaaagaggtagcaaggtagcatgactttctttaccctcccattttggttaacagattttcaatagtatcaaatatatggccagatagttggtaacaacttaaactgaactaaaatgaattcaagttagaatctgcatgttatttttccatttgctcaactgatctgtcattcaattcctgtcacgggccttcttgtccccagatcaaatacacagagatcatgaaatatgaattgatatcacaagcataatgtactgtagaagttcaacatacacctttgtcttgtggatatctgtgacagatctacaggtgttgaatctatgtggaagctgggtttcagtaggaagaatgttacaatttaagattgctctaactcttctcccgcttgtctatttttctttctcattttgtctttcaacttctattattcctttatctagtaggatcttttgtcttccaaacacctctccaaggcatgtcaaaattactgaataatttcctctcttctatgcaccatacaatagtccatcctgtcctttaaatcagttcaaggccactttctctccaatgagcttcagctattccataatctatcactgtgatactcctcaattccatcctcaagatatattactggccaggagccgtggctcacgcctgtaatcccaacactctgggaggccaaggcaggcagatcacctgaggtcaggagttcaagaccagcctggccaacatggtgaaaccctgtctctactaaaaatacaaaattagccaggcatggtggcaggcgcctataatcccagctactcaggaggctgaggcaggagaatcgcttgaacccgggaggtggaggttgcagtgagctgagatcacgctattgcgctccagcctgggtgacagagcaagattctgtctcatttaaaaaaaaaaaaaaaatatatatatatacacacacacacacacacacacacacacacacacatataaacatttacctatgcatatttctgtatatttcacatgtacttattttcttgaggaaagaaactacagatattagttaaatgtattaaaatatctatataacgcagtcataaaggtttaatactaaattagttttttacaaaaattatttttttgggggggaatgatttaaccttccattctagtcctatcaatgtcttcatagatagccttctataatatttagtatactgtaacacataccccaaggatactcaaaaatgactggcttttccaaccagaaatatggctgatagaggagggtaaaaatcttaaacttctagactaattcttttcagaacaaacttgtgaaatctgtttgaagtcagtgaaaaatacctcagcattccgaaagactttgagcatgtcagcatcaaaagcttccactgtcttatagtaaccagtgaggatctgcttctctatggtgataagatctaggggatcagagatcttctcataataatcagcattcctggaacacaaagccagggtgtcaatctggcacacttagcactttttaaaaactcagatgattcccacaaatgtgaacctactttttctttgggggaaggttcaaaagtggagctgccagtgcttgccgggaagaatctgcaaaagaatgtgaggtttagtagaaagattccaccatacaagggaggcaagcatctcctaactggaagaatagaatccctcaaattaaaagtgagagaaaaatccaagtctttttttttttttttttttttttttgagacagagtctcactcttgtcgcccaggctggtgtgcaatggcatgatctcagctcactgcaacctccacctcctgagttcaagcgattctcctgcctcagcctcccgagcagctgggactacaggcgtgtaccaccacgccaagctacttttttttttttttttttttttgagacaagagtttcgctctgttgcccaggctggagtgcagtggcgtgatctttgctcactgcaagctccacctcccgggttcatgccattctcctgcctcagcctcccgagtagctgggactacaggtacccgccaccatgcccggctaattttttgtatttttagtagagacgaggtttcaccatgttagccaggctggtctcgatctgacctcgtgatctgcccgcctcagcctcccaaagtgctgggattacaggcgtgagccaccgtgtccggccaatttttgtatttttaatagagacagggtttcaccatgttggccaggatagtctcgaactcctgaccctcaggtgattcacctgcctcggcctcccaaagtgctgggattacaggcatgagccactgcgcctggccaaaaatccaagtctttttaaggcctgtgaaaaagccactttttcagatatgtagataaaggcagggatcaaatgacaattctaagattgtctaggatatgaaagatatagttgcatctgcttgaaaggtagcacaatgttagttgggtaatgagaagaacttcctgtgaagaatgagagatgggaacttattgagggtaatctgcttagggcaaattactactcaacaaatcttataatagcaaaaagaatatcttatccaaaaagtgctttctagttctcattaactgcccttaattaatagtaatttgtttggctgggaatgggtgcggtggctcacacctgtaatcccagcactttgagaggtcaaggcgggcagatcatgaggtcaggagatcaagaccatcctggctaacatggggaaactccatctctgctataaataaaaaaattagccgggcgtggtggcatgcacctgtagtcccagctactcggcaggctgaggcaggagagttgcttgaagccgggaggcggaggttgcagtgaacagagattgtgccactgcactccagcctgggcgacagaacaggactccgtcctaaaaaaaaaaagaaaaagaaaaagaaaaaaaaaaagaccgggcgcgatggcacacgcctataatcccagcactttgggaggctgaggtgggcagatcacgaggtcaagagattgagaccatcctggccaacatggtgaaaccctgtctctactaaaaacacacacacacacaaaattagctggccgtggtggcacacgcctgcaatcccagctacttgggaggctgaggcaggagaattgcttgaacctgggaggcagaggttgcagtgagccaagattgtgccactgcactccagcctgggcaacagaatgagactctgtctcaaaaaaaaaaaaaaaattagtttggcggggcacagtggctcacgcctgtaatcccagcactttgggaggctgaggtgggcagagaacttgaggtcaggagttcgaaaacggcttggctaacatgttgaaaccccgtctcactaccaaaaaatacaaaatttagctgggcatagtggcgcacacctggagtcccagctactcaggaggctgaggtgggagaatcatctgaacccttgaggcggaggatgtggtgagccaagattgcaccactgaactccaacctgggcgacagactgagaccctgtctaaaacaataaaaataaaggccgggcatgctggctcacgcctgtaatcccatcactttgggaggccgaggcaggtggatcacgaggtcaggagttcaagaccagcctggccaatatggtgaaacactgtctctactaaaaaatacaaaacttaggcaggtgtggtggtgtgcgcctgtagtcccagctactcaagaaggctgaggcaggagaatcgctggaacccaggaggtggaggttgcagtgagccgagatcatgccactgcactccagcctgcgtgacagagtgagactttgtctcaaaaaaaaaaaagtaaaataaaataaataaataaataaattaattactattactctgttgggtatggatccaattaaattccagatattgaataatttagtactgtactgtgaatattttctgtaattgatttttcctgtaacagttactctgtattatgaaaatggaatttacggtgaggggccacttctcatttgctaccatacttaatttctggcaatttcactagcagagtaaaagagcccgtgtttcatgctcagaatgcagtgacatggtagacatacttactgcagtttcatgttcggtgagatgagcctacttgagaatgcaagacagacatggtggctcatgcttataatcccagaactttgggaggtcgaggcagaaggatcgcttgaggccaggagttcaagaccagcctgggcaacatagcgagacctccatctcaaaaaaaaaaaaaaaaaaaaaaaagacagaatgcagagagtgtgatttattttgggaatgtaaatggaataggtgcctcaaaattcaaaactttacatcttacatcttagggcagtttggtccccatttttctctttatatccttaggttaagaaaactgcaaaaagccactataatatcaaagataatcaggagacagaaaaagaaatgaaaaagaaaagaaatgcccacgagcagtagctcatacctgtaatcccagcactttgggaggcctagacagaaggatcacttgagcccaggagtctgagactagcctgggcaatatagcaagaccctatctctatttatttaaaaaaaaaagaaaaagaaaaagaaaaaaagaacgaatttgaaggtggttatagtcacctttataagagatgataccatcacaaatttctttgaagatctgggctaggcgggctgcccgagccacttcaatattttcctctgcagctgccaaccgtcttgttcgaacagatcgagctgtctgcagggcagagaactgggtcatgaagacatctggaaaaataaagtgaaaattaagttacaggaaacaaggagctctacatgtctttctctttcccaatggattcctgccatttgctctattttcccctgaagtgattaggtagattagtgggcacagagttctttctatcttctgtaatgaaaaatcaggaaacactggaatttactggagacaaaatgctgcaagagggaccttagcttagtgctcaaatgcaatacagtatagcagttgtaagtctgggcttcaaaatgaatctatcagcatctgaattctggtgtcactgcttattagttgtgtgatcttgggcaagttatttaacccatgggtcagcttctcaaacataaaatgagaacaatggtagtacttccctcataaggaaataatgcaggttaaatgagataatgcttttaatgtgttttgctcagtgcctgacatgtaagcactctgtaaatgatatctgttattattagaagaagtaaactagttaggatataacttcaaagaatttatgccaatcaaatcattgacaggatgtaagattatgggcaaatttttaaatctatctagttagcattcagcatatccctcacacatcacatagaattgcttctaccttttgaggggaagaaggaaaggattaaaaaaaagagcatgatcttttgaacactctgttttcagttagaaaggatgcttggacatgctagttcctctgctttcagtctcttctggataatatctgaactcaggagtgctgttattgaaggttacagaaaggaaatctgatggtttgtgagtacagtgctaatctgaatgtgagaaaaaaaggtcttcaaactgataatgacccgtcccccactgaatctgaatgtgagaaatgacccgtccccagctgaatctgaatgtgagataaaaaggtcttcaaactgataatgacctgtccacccactgataattacccgtcccccaccccaatttccccagtggatttggtatcactatttactctgtctgcaagttattttcaaggtaggaagtaacaaagagggcccactatctatctgatacctaatgactatttcagactacaggtcatgtttgaaaggctgtaggaggtttctttctattccctaaagagaggaaagctgaagaactgggatggataggttattactgactgatgtgtacatatttggatcataacttttttggtcaatactaaaaggagttgttaaatagattatctgctggaaagcaactaaaataaattaatagaaattcggctgagtgtggtggcttacgcctgtaatcccaacactttgggaggccaaggcaggcgaatcaccttgattccaaggcaggaggtcaggagttcgagaccagcctggccaacatggcaaaaccccctctctactaaaaatacaaaaattagccgggcatggtggcgggcgcctgtaatcccagctactcaggaggctgaggcaggataattgcttgaacccaggaggcagaggttgcagtgagcctagatcatgccattgcactccagtctgggcaacaagagtgaaactctgtctcaaaaaaaagaaatgtttcaaatgccttaccagacttgatattcccatcatctcggcagatcccattccaacgggtatataatgatgctgagtgaatattatcactggtgtgctttacttcctcctgtttttgacgaatcttctcccagtttcggaccaagaatacatgatgctttaacacaaagttcctgcaaggaaggaaaaaaaatcttcctttattcattaattaaataagcatgtattacatgtctactctatggaagccattgttagacgatatacgtgaattgagctgttgtaaagagaattatatgggcaaagcattactcaattttgtatcttcaatttttttacattacataaaacacataatatttacatacatctggcaaacaacaattaaaggctgcaaaaatgctggcaagtgaaacagcctgaccagaaggcagagatttatttgtacaaattctaaatatagttgtcaagatgaagtagggtctcaggatcagctataacaaggagaactggactggcaaatgaaggcaaagacacgtaagatggatacgcactgggcaaactatgttaggtgcagtgctgccatatggttccctaaacttactactttttttttgagtcgacgtctccctctgttgcctaggctggagtacagtggcatgatctcagctcactgcaacctctgcttcccgggttcaagcgattctctcagcctcctgaatagctggggttataggtgcctgccaccacgcccagctaatttttgtatttttagtagagacggggtttccccatgttggccaggctggtcttgaactcctgacatcaggtgatccacccgccttggcctcccaaagtgctgggattacagtggtggcgtgagccaccgtgcctggccctggttccctaaacttaaatgaattatgtgtatcttgactgatcctatacaattttgatgattccattattcaatttccacaacaggacatatgtaaatagatgtgatcttggataaatctcaaggtatgggtctcacttctcacttaaatgaagattagactaattttctagttcctgcacattggaatcccctgggagactttaaaaactactgatacctgggttctacctctgcaaattctcatttaagtggtctagggtgtggcctgggccttgggagtttttcaaagttccccatgctaataggcagccaaagtagagaaccactggactggtttttccgaaatttaaaatttctacaactcaaagggaaatagaatgaaaggggctaaaattacacaatggttataaataaagataaactttcaacaaataggacatactcacttgtttgcttctgaaagagacaattcttatctgaatacagggaacagcagaaattaccactaaagatcctttctattgctctgttaatatgtcaacaaagcaggtattctgtttttttttttttttgctttttgtttttttttgttttttgagacggagttttgctcttgctgcccaggctagagtgcaatggcgtgatcttggttcactgcaacctccacctcctgggttcaagcaattctcctgcctcagcctcctgagtagctgagatgacaggcatgcaccaccatgcctggctaattttgtatttttagtagagacagggtttctccatgttggccaggctggcctcaaactcccgacctcaggtgatccgcctgccttggcctcccaaagtggtaggattacaggtgtgagccactgcgccctgccaaagcaggtattcttaattttttctctactgcggactcctttgacagtctgatgaagcctatggaaccattctctgaacaattatttttaaattacttcaaaaaatttaaattattggccaggtgtggaggctcacgcctgtaatcccagcacttggggaggctgaggcaggtggatcacaaggtcaggagatcgagaccatcctggctaacatggtgaaaccctgtctctactaaaaagtataaaaaattagccaggcgtggtggcacgtgcctgtagtcccagctactcgggaggctgaggcaggagaatggtgtgaacccaggaggcggagcttgcagtgagccgagattgcaccactgcactactgcactccagcctgggcgacacagcgagactccgtctcaaaaaaaaaaaaaaaacaacaaaaaaccaaggtctttccatgttgccgaagatggtcttgaattcctgggctcaagtaattttcctgcctcagcctcctgagtagatgggtctacagggatatgtggaaatgttatttcatttagaaattagggaacataagatggtttggtgtgctggctcgtatctgtaatcccaatgccttgggagatcggggcaggaggatagcttgagcccaggagtttaggaccaacctgggcaacatagtgagaccttgtctctacaaaaaatttaaaaaaaaaaaattagccaggtgtggtggcatgtgcctgcagccccagctacttgggaggatgatgcagggggatcacttaagcccaggagttgagccaggcctctgtattccagcctgggtgacagagtaagatcccagctctacacacacacacacacacacacacacacacacacacacacaaaagggtaagacttaaaaaaaaaaaaaaaaaaaaaaaaaagattgtatttcttccatccaggttcatagatcccctgaaccctttggcttaagacaaaagaaagtggatcaacaatatagaagtttcataattttttacacagataagcaatcatgtaacttacaaagaacatggataaggatatttcctttttacctttcacgattggacattggcttcatctgtaattggggggtcaatctagttggggtgttgatattttcactgggttcctcagagagatggcctctctgaaaaagagatggatcagattagagatttaaaaaaatatcagtcagaaataatctccaagaatattaaaaccactcttaagatgccaccctctggtaattcccttattccagcaattgcctcaaagcatctcatgaacagcttttggggaaagtcattagataattattcacccttttcttcagcttgtgcttagactttctcttctcttttgaccgtccagattttttgtgtgtggccatgggctggctgtttttgctgctggtgagtccattcacacgctgactcttgcctccgatgattcctcgacatttctcaaagccacacttacaaagttgctttgaagggagagaataatttttttatttttatttttttaaggcagggtctttcctgtcactcaggctgaagtacaatagtatgatcatggctcactgcagtctcaacctcctgggctcaactgatcctcctatctcagcctccccagtagctgacattacaggtgcgtgccactatgccaggctaatttttgtattttgtgtagagacagggtttcgccatgttgaccaggctggtctcgaactccagggctcgagcaactctcccaccttggcctcccaaagtgctgggattacaggtgtgagccactgtgaccagctgagaataatttttttttagcttgcagtctcatttactagcttaaagaggattcctgagcatttggacacacattaagtataaatcaagaaatttgcatataggggaaaacaactgattgagagtataaatagaaatgggtttccactggaatagaaatgatggattaaattttaggaaaacttcttccccagaaaagttaactgagtggagaccaaaaatcacagggcaatctctttcttcaaagtaattgggcactatgtatctcagaaaggtggagtacagagtaaaaaactgtcctctcctatatacttctttaaaaaaaaattttaaaaaggccaggcatggtggctcatgcctgtaatccagcactttgggaggccaaggcgggcggatcacaaggtcagcagatcgagaccatcctggctaacatggtaaaacccagtctctactaaaaaaaatacaaaaaattagctgggtgtggtgacaggcacctgtagtcccagctactcggtaggctgaggcaggagaatggcgtgaacctgggaggcggagcttgcagcaagccgagatcacgccactgcactctagcctgggagacagagtgagactccacctcaaaaaaaaattaataaaaaaaaaaaaaaacatgaaatgcttcagtaatctgtttgtcatccttgcacaggggccatgctaatcttctctgtatcattccaattttagtatatatgctgtcaaagcaagcacttaattaaaaaatttggctgggcatggtggctcaggtctgtagtcccagcactgtgggaggctgaggtgggaggatcgcttaagtccaggagtctgtgaccagccctgacaaaagagggagaccccatctctacaaaaaatttaaaaaaaaattagcgacgcacagtggtacacgcctgcggtcccagctactcagaaggttatggtgggaagattgcttaagcccaggagattaaggctgcagtgagccatgatcacatcactgcattctagtgtgggccacagaacgagatcctgtcttaataacaaaaaactttaaacattttagagaaggggtcccgttctgtggcccaggttggccttgaactcctgggctcaagtgatactcctgtctcagcctcttgagtatgtgggactgtaggtaggtatgcactactgtgcccaggctcccatgtacttcttttctcccttttttctttttttgagctgaagtctcgctctgtcgcccaggatggagtgcattggcgcgatctctgcaacctccacctcctgggttcaagcgattctcctgcctcagcctcctgagtagctgggactacaagcatgtaacaccatgcccagctgatttttgtatttttagtagagagagggtttcactatattggtcaggctaatctcgaactcccgaccttgtgatctgcctgccttggcctcccaaagtgccgggattacaggcgcgagccaccatgcccagactttttctttttttgtgtttgagacagggtcttgctctgttccacaggctgcagtgcattggcgtggtcctggctcactgcaacctccacctcccgggctcaagcaatcttcccacctcagcctcccaagtagctgggaccacaggcacatgcgaccacacttggctagtttttgcatttttttggtagagacagggttgcaccatgttacccaggcgggtcttgaactcccagactacaagtaatccgcttgcctcagcctcacaaagtgctgggattacaggaataagccattgcgcctgacctcccatatactttttttttttttgagacagagtcagtcttgctttgtcgcccaggctggagcacagtggtgcaatctcggctcaacgtaacgcaacctccgcctccaaggttgaagcaattctcctgccttagcctccaataaactgggattacaggtgcgcgccaccacatccagctaatctttgtatttttgatagacagggttttgtcatgttggccaggctggtcttgaaattctgagctcaagtgatctgcccacatcagcctcacaaagtgctgggattaaaggtgtgaaccactgtgtccagcctcccacatacttcttaatggctccaagtcaatcatgtttacagaaagctcatgttattacagcattgtaagggataaagttcaatctccctctaggatttattattcttacctgtttttccacattgaaggaatgaaagttataatcataagtgagttcagtcccagctggcatgtctttaagagcatagagtccaatccggtatactccattaacagacctgtaaagagagaaaacagagttataaaggctggaaatttttttttttttttgagacggagtctccctctgttgcctaggctggagtgcagtggtgcgatcttggctcaccgcaacctccgcttcccggattcaagcgattctcctgcctcagcctcctgagtagctgggactacaggtgtaagccaccacgcctggctaatttttgtatttttagtagagatggggtttcaccatgttggccaggctggtcttgaactcctgacctcaggtgatctgcccgcctcggcctcccaagtgctagaattataggtatgagccaccacgcctggcctccacttttaatctcttttctatccttggcagcctgtataatactgccagagtaagaatcctaaataatttttcttgaaaacatgttctatgttgtcaattaggcttcaacttttcctgcttggtattcaaagtcctaaaatatggcttgcctgtattccccgcactttgggaggttgaggtgggaggatcacctgaggccaagagttcaagaccagaccaggcgccgtagctcacgcctgtaatcccagcactttgggagtccgaggcaggtggatcacctgaggtcgggagtttgagaccagcgtggccaacagggcaaaaccgtctctactaaaaatataaaaattagccaggcgaggccacatgcagtggctcacacctgtaatcccagcattttgggaggccgaggagggcagatcatgaggtcaggagttcaagaccagccaggccaacatagtgaaaccccgtctctactaaaaatacaaaaattaaggccgggtatggtggctcacacctgtaatatcagcactttgggaggctgaggcaggcagatcacgaagtcaggagttcgagaccagcctgaccaatatggtgaaaccccatctctactaaaaacacaaaaattagccgggcatggtggtgtgcacctgtaatcccagctacttaggaggttgaggcaggagaatagcttgaacctgggaggcggaggttgcagtgagtcaagattgcaccactgcactccagcctgggtgacagagtgagactccatctcacaaaaaaaaaaaaaaaaaaaaaaaaaaaaaaattagccaggcatggtggcatgtgcctatactcccagctactcgggaggctgaggcaggagaatcgcttgaacccgggaggcggaggttgcggtgagccaagatcctgccactgcactctagcctagcctgggcaacaggacgagactccatctcaaaaaacaaacaaacaaaaactagacaggtgtggtggcgcatgtctgcaatcccagctacttgggaggctgaggcaggagaatgacttgaacccctgaggcagaggttgcagtgagctgagatcatgccactgcattccagcctaggcaacagagcgagactccgtctcaaaaaaaaaaaaaaaaaaaaggcttagttcacttattaaatgagttaaaattactttttatggcttacctatacaaatcttccagttctaccaatctctatcacatgagtgcctctcttgttctattatatgtaaggtaatgatcatttaggattttaggtgtttttttgtttattgtttttgagacatagtcttgctctgtccccaggctggagtgcagtggcagaatctcggctcactgcaacctccaactcccgggttcaagagattctcctacctcagcttcctgagtagctggaatataggcacgtgccaccacgcccagctactttttcatatttttagtagagacagggtttcatcatgttggccagtacggtctcaatctcctgagctcgtgatccgcccgccttggcctcccaaagtgctgagattacaggcatgagccaccgtgcttgactttgttttaggtgttcaggagtttgtgactcgcctgggcaacatagtgagaccttatcttaatatattaaaaaaaaaaaaagaatatagtcattatcattatagctaacatttactgaatgctttttataacattttatattatttcatcctcctaacaattatataaaaatatgtaatattattagttattataaccctcatactacaaataaggcaactgaggcacacagggagccacttgcccaaagttacacagctgataacttagggaatcaagtttcaaattgacattgtggcttcaaaatcttaactaccatgccatactgataacaagttatatcatcaattctcaaaacaatcctatagaaaaaaccccaatcctgtaagataggcattatgatatctattttatatatgaagtatatacgcctcagagtttgtttagttatatagcaattaagtggcattcaaacccaggggattaaaacccaggctgtttgactcagcctttttcttcttgtctccttaccaatgtggaacacattaagggttagcttagatactgccctattacatgtaaccttgcctaaaatttttaatttttagtatttttccatcctgaattcagaaagcatttaaaaatttttatttatttatttattttttgaaatggagttttgctcttgttgcccaggctggagtgtaatggcgggaacttggctcactgcaacctccgcctcctgtgttcaagcgattctcctgcctcagcctcccaagtagctgggattacaggcacatgccaccacgcctggctaattttgtatttttagtacagacgggatttctccacgttggtcaggctggtctcgaactcctgacctctcgtgatccgcctgccttggcctcccaaaatgctgggattataggcgtgagccaccgcgcctggctaattttttatttttaaacagtatctcactcttgtataggctggagtacagtggcgcaatctcagctccctgcaacctctgcctcctgggctgaagtgatcctcccacctcgccaccacgactagctaatttttgtatttttagtaaagacagggtttagccatgttgcccaggctggtctcaaactcctgagctcagatgatctgcttgcctcggcctcccaaagtgctgcgattacaggcatgacccacggagcctggctgcagaaagcattttaaatgtataccaggagttggcaaactgctccacaggccactgctcccatctttgtgaatagttttataggtgcaaagccaacaagtttgctgatatatactgtaacttttctttttttttgagacagagtcttgatctgtcacctaccttcatgcctgtaatcccagcactttgggaggcctaggtgggcagatcacttgaggccaggagttcgagaccagcctggacaacatggcgaaacactgtctctactaaaaatataaaaattagccgggtgtagggacgcatgcctttagttacagctactcaggaggctgaggcacgagaatcgcttgaacccaggaggcggaagttgtggtgagccaaaatggtgccactgcattccagcctgggcgacagagcaagactctgtctcaaaaaaacaaaaacaaaaaaccaaaaaaaggtatcttctggccgggtgttgtggctcatacctgtaatcccagcactttgggagactgagcaatgaggatcgcttgagcccaagagtttgagaccagcctgggcaacatggcaaaactccatccctatcaaaaaatacaaaaattagccgggcagggtggcatgcacctgtggtcccagctacttgggaagctgaggttgcagtgagtcaagatcgtcccactgtacttcaaccctggtgacagagtgagaccttgtctccaaaagaaggggagaaaaagatatcttctagttgacattcttgcacaagtctagcacaaacactaatttccgctggggacatacttaggattagagttgctggtttaccggttatgtttagctttggtaggttgtgccattttttgaaagtggttataccaatttacacttctaccagcaaatctaagagcatttatgctgctctacctttgccaatactgtcagtctttaattttttacattttggagggtatgtagtggttttccaatttagtttaatatttcccctaataactgtatctaacatattaagcgctgttgtatatttattgaccactttgatattcttttttaaagtacccattcttttacctattttaaaaactggcttgtcaggcccggcatggtggctcacacttgcaatcccaacactttggaaggctgaagcgggctgacttattgagcccaggagttcaagaccagcctggacaacatggcacaaccctgtctctacaaaaaatacaaaaaaattaaccaggcatggtggtgtgtgcctgtagtctcagctactcaggaggctgaggcaggtgaacggcttgaacctgggaggaggaggctgcagtgagccaagatcataccactgtactccagctctgtcttaaaaaaaaaaaaaaaaaaaaaggctgctctgcgcctatggagtagccattcttttattcctttactttcttaataaacttgctttcactttattctatggactcaccttgaattctttcttgtgttctttcttgtgcgagatccaagaaccctcccttggagtctggatcagaacccctttctggcatctttctggcgatcacgaagggatgatacttaagagacccacaacccaaaggaaatagactgcaacactgattggctgaaacttttgagttactgacagctttgtttttttttgagatggagttttgctcttgtcgctcaggctggagtgcagtggcacaatctcagctcactgcaacctccacctcctgggttcaagcgattctcctgcctcagcctcctgagtagctgggactacaggtgtatgccactatgcccggctgattttttttttttttttttttttgtatttttagtagagatggggtttcaccattttggccaggctagtctcgaactcctgacctcaggtgatcaacctgcctcagcctcccaaagtgctgggattacaggcatgagccaccatgcctggcatattgacagttcttaacaattgagtaaaactcctgtgaacaaaatttaaaggatgtttgtttccctctacctcatttctccaaaatctggaaaccagatgatacaattggagaaactggttattttaccaaggctttgattggaatggagtgctttctattaaggaaccaaacttggcttagagagccaataaaagccccttgggaaaactggcctcataccttttccacaaagtccctgtatagggttcctgacccgtgatatcaccttttgtcagaactatgaatggcccttaccatactgacactttctgactgatctcttctctaccttggatacaagagaccctaataggcaggaatatcatcaccgctattcaacctgaagaaattactaaagatggatcttcatccctgtttacccctaaggattaagggttctcttataaaagggagggggaaaatgtcagaagcgtttaaaccagagcgactccatcttgtatagaggttgggtaaaattaggctgagatctgctgggttgcattcccaataggttaggcattcttagttacaggataagacaggaggttggcacaaaatacaggtcataaagaccttgctgacaaaacaggctgcagtaaagacgctagccaaaacccatcaaaactaagatggcaacgagagtgacatctgggcgtcctcactactacactcccatcagtgccatgacagttaacaaacactatggcaacgtcagaaagttactctatatggtctaaaaagtggaggaacccttaggtctgcgaattgtccaccactttcccagaaaactcatgcataatccaacccgtgtttagcatataatctataaagaaccataaagatgggcaaccagcagccctcggggctgctctgtttatggaatagcctttcttttcttttattcctttactttcttaataaacttcctttcacttaaaaaaaactgccaacactcaacccttgaacattgtgtatttttccattaatttaggtcatctttattttttcccaacttctgacagcttctagtatagaggtcctacaaactttcataagatttattcttagggactagtcttttatgaagctattgtaaattgtattggtttttatttatttatttattttgacacggagtcttggtgtgtcacacaggctggagtgcagtggcacgatctcggctcactgcaaactctgcctccggagttgaagcaattctcctgccccagcctccaatagctgggactataggcgtgtgccaccacaaccagctaatttttgtattttaagtagagacagggtttcagtcatcatgttggctagggtggtctcgaactcctgacctcaggcaatctgtgcatcttggcctctgaaagtgctgagattacaggcgtgagccattgcaactagcctgtaatgggtttggttttttttttttttttttttttgagatggagtcttgctctgtcacacaggctggagtgcattggtgcaatctcagttcactacaacctccgcctcccaggttcaagtgattctcttgcctcagcctcccaagtagctgggactacaggtgcatgccaccatgcccggctaatttttatatttttagtagagacagggtttcaccatgttggtcagactggtctcaaactcctgacctcatgatccgctcgccttggcctcccaaagtgctgggattataggcgtaagccactgcacctggccttgtaatggtttttaaatttcactttctacttggttgttgctaatatattaaaatgtactcaatacattaatttttatatactgaccatctttccattaatcttgctaaattcacttatgtctgtagaaatttcccatgtgtataataatgtcatctgcgaataatggtagttaaattttttttcatttctaatctttatacttttttccttttcttattgtattggttagactcttcaaatgtagatatgacagtggatatccttatttatgtataatggtagctaaagattttttaaaaatggatttcctttggcagatttgttagttcctttttattcctagtttgctgagttttaattatcaatgagtgttgaatactgtttaatgctttttctgcttctattgagacaatatatgattttttgtctttagtccattattgtgataaaattacattggtttacactgatttttgaatgttaaaccaaacaatcttttattcctggaataaaccccacatagtcatgatgtattaagctttttatttattgttaaattttatttgttgatattttatttaggatttttgtgtctatgttcatggaacacactggcctatattttttcctggttagattttagaagaaggtaatgctagttttatagaagcaaagagtttataagtggtactgccattatttcttcttcttcgtcttcatttttttaaatagacacagggtctctgtcacccaggctggagtgcagttgcatgatcacaggaaactacagcctcgaacttctgggctcaggcgatcctaccacctcagtctcccaagtagcaccatcacacccagctaatatttaaattttatctttaaatttttgttgagacaggtctcaccatcttgcctaggctggtcttgaactcctgggctcaagcaatcctcccacctctacctcccaaagtgctgggattgcaggtgtgagccactgcacccagcctatttgttctttaagtatgtggaagaattatcagtgaagacatctggttctccaggttcttttgttagatattttagttacattttcaattttgggggtacatgtgcagattttctattttgtcttatgtcagttttggaaaggtatgtttttctttttctttcttcttttttttttttgagactgagtctcactctgttgcccaggctggggtgtagtggcaccatcttggctcactgcaacctccgcctcgcgggttcaagcaattctctgccacagcctcctgagcagctgggattacaagcgcctaccaccacgcccggctaatttttgtatttttggtagagatggggtttcaccgtcttggccaggctggtcttgaactcctgaccttgtgatccacccacctcggcctcccaaagtgctgggattataggcgtgagccactgtgcccggctggaatgtttttcaaaggatttgttcatttcatctaacttttcaaatataaagttgttcacagtaattgataaacaaactggtaaattcacacaaagaagtattactccacattaaaaagtaacaaaccactaatgcattcaacatggatgaactgcaaaaacatgtttttaacaaaaaagacgccagacacaaaagaatacattcacatgaagttctggaataggtaaaactcatctgtggcaatggaaatcagatcagtgcttgctttgggggattgggagattgacttaaaaggtaactttctgaaatgacaaagtatgtcatattttcataggggtgttggttatatgggtgtatacatttgaaaaaattaatggaaatgtacacttaagatctatgtatttctagacgggcgcggtggctcacgcctgtaatcccagcactttgggaggccgaggcgggcggatcacaaggtcaggagatcgagaccatcctggctaacacagtgaaaccccgtctctactaaaaatacaaaaaagaaattagccgggcgtggtggcaggtgcctgtagtcccagctactgggcaggctgaggcaggagagtggcatgaacccaggaggcagagcttgcagtgagctgagatcgcgccactgcactccagcctgggcaacagagcgagactccgtctcaaaaaaaaaaaaaagtctatgtatttctctgtatatgaattacactttaatttttaaaaacttaacaaaaaaccccaaagttgttcatactatcctcatattatctttttaaaattattttttaggtgtgacttttttccttctcaattagatgctaatctatttgaggggaagggacctccagattcactttttttatttctctttgtgagaaatgcaccaggtatttaataagcatgcagtagagtggctgaatgaactgatatgagatgatccatgtaacacagtgcctagcacatagtaagaactcaataaatattaggtattattattatttttttgagatggagtcttgctctgtcacccagattggagtacactggtgtgatctcagctcactgcaacctcggcctcccgggttcaagtaattctcctgcctcagcctcccaagtagctgggattataggtgcacgctaccatgagtggctaatttttgtatgtttagtagagatgggtttcaccatgttggtcaggctggtctcaaactcttgacctcgtgatccgcccaccttggcctcccaaagtgctgggattacaggcatgagccaacacacccggcctattatcattattttttgtttttgattttttcttgctatgttgcccagactggcctgaaactcctgggctcaagtgatcctctcacctcaacctctcaaatagctgggactacaggtgtgtaccaccaccctggctatcatcatcatcattattatatttttctaggacatagatcctgaaactacttgcatgccaaacaaaaaaaccaaaaaagcaaaacaaaaaaacagaacacaaataaaaacaaaaatatctgtctgggagtgagaagttagggtgaaaacgaagcagcttactctgcccgtgggatctggggtaatggggaacagcctgagctgctttgtgtaagctgactgacactggaaagatcaatcccttgctgcactcaatgcttattctgctggattcttgtcttcaccttcttttgcttccttaccatttctgcatttcacaatttgggtcacagctatggttgatgaatcgggcctcatttcccatgcggtaactgtcaatcaccatcccactatccaggttcaggcagtagtggtcactgtgattatgatactgctcaatcatcctgttcctaaagagaagataaatgattgaaagacaattaaagagtagctgaaagtaaatttcacatcttccattctccattctaatcttataccttggcattttattagagtatcatcatttaccaccgtacctgaactcctgttcactgacgacctcccctaggtattcaatgatgaactgcccagcttttaggggctctttggttctgattccccaacctttttcctcagctcgaaatcgttctagacattgcacccattcatgcctctgtatcctctggttacagcattgctcgccacatgggcaagtgttgggggaacactcagcaaagatcattctagaaaaaaaaggaataactgtacatcaacttacatgatacataccttgatgcatccatttttaaattttacaaacatttaaaaatgaatacatgaaatcaatttttatttaataaaagtacccgaatcactaagattaaaataataaatgtcaaaaattaataatattcagaatttccaagtcgggctgcaaatcctgaatgcttcttgtaaatgattaagctaactgtccactcagcatcctgggtaaacattatcatatttatctattccaagaataaggctgggcaaggtggctcatgcctgtaatcccagcactttgggaggctgaggtgggtggattacctgaggtcaggagttcaagactagcctggccaacatggtgaaaccctgtctctactaaaaatacaaaaattagctgggtgtggtggtgtgcacctgtaatcccagctacttgggaggctgaggcaggagagtcccttgaacctgtgaggtggaggtcgcagtaagcagagatcgcaccactgcgctccagcctgggcgacagagtgagactccgtctcaaaataaataaataaaataaataaataaataactgtgatccaaagaagaatcagtaatttgatgatgatttcactgtactcttattttgaagcactcatgcccatttactgatttaaaaaaaaattgtggtagaatacctaatttactttttttttttttttttgagatggaatctggctctgttgcccaggctggagtatattggcacaatctcggctcactgcaaactccgcttcccaggttcaagagattctcctgcctcagcctcccgagtagctgggattacagatgtgtgtcaccacacccggctattttttgtattttcagtagagacagggttttaccatgttggccaggctggtctcaaactcccaacctcaggtgatccgcctgcctcggcctcccaaagtgctaggattacaagcttgtgaaccactgcacccggccgctaatttactcttatttatttttttgagacggagtctcactccattgcccaggctggagtgcagtggcatgatctcagctcactgcaacctctgtcctctgggttcaagcaattctactgccttatctgggattacaggcgcataccacaacacccgggtaatttttgtatttttagtagagatggggtttcaccatgttggccaggctggtttcgaactcctgaccccaaatgatccacccacctcagcctcccaaaatgctgggattactggcatgagccactgtgcccagccagttttttttttttttaatttatttttatttttttgaggcaaagtctcgctctgtcacccaggctggagtgcagtggctaaatttcagctcactacaacctctgcctcctggattcaagggattctcctgcctcagcttcccaagtagctgggattacagacatgcaccactacgcccagctaattttcgtatttgtagtagagacgaggttttgccatgttggccaggctggtctcgaactcctggcctcaagtgatccgcccacctcagcctctcaaagttctgggattacaggcgtgagccattgtgcctggccttttttttttttaattaaagagggggaagtctccctctgtcacccagactggggtgcagtggcctgatcacagcctactgtagcctcgaactccttggctcaagggatccatcctgcctcggcctcctgagtaggtgggattacaggcatgaactaccacacccagccttaaccatttttaagagtacagttcagtgacattaggtatatttgctgctgttgtattacaggaattttatattacattaattgaaatgacatttccaggctatatgactagctgaacccatagtagttagggaattaacaagttaaaaattctagatgggtgcagtggctcatgcctgtaatcccagcactttagggggcagaggcaggaggatcatgtgaggtcaggagttcaagaccagcctgaccaaggtggcgaaaccccatctctactaaaaatacaaaaattagctgggcgtggtggtatgtgcctatagtcccagctactcgggaggctgagacaggagaattgcttgaacttgtccggcggacgttgccgtgagctgagattgcaccactgtactccagcctgggcaaaagagtgaggctctgtctaaaaaaaaaacaaaaaaaaaacaaaaaaaaactgaacatagaagacaaaagaagtcacacacatcttgtcactgctttctttactttttttttggagacagggtctcgctctgtcacccaggttgaagtacagtggcacaataatggctcgctgcagctctgaccacctgggctcaagcaattctcccacctcagcttcctgggtagctgggaacacaggcgcgcaccaccgcatctgactacttaaaaaaaaaattatttgtagaggtgaggtcttgctgctatgttgcttaggctggtctcaaattcctgggggtcatgggatcctccctcatcggcctcccaaaatgctagggattacagcattttgtgagccaatgcacctggctgttttaatgggagctgtttagttttggtgtatggtttgaaatctcatctaggctgttaagcattattttttggtttgttttttggatacagggtctcattctggttgcccaggctggagtgcagtggcatgatcttggctcactgcagcctcgacctcctgggctcaggtgattttctcacctcagcctccagaatagctgggactataggcacacgccaccatgcccagttgatgttttgtatttttagtaaagatggggtttttccatgttgcccaggctggtcacaaactcctggactcaagtgatccgcccaccctggccttccaaaatgctggattacaggcgtaagccaacatgcctggccttaagcatgactaaaacaaggaatgatcaagaaaataatcgtcaaaatatcatgttatatttataataataattttaaaggccgggcacggtggctcatgcctgtaatcccagcactttggggggcagaggcgggaggatcacgtgaggtcaggagttcgagatcagcctggccaacacggcgaaacctcgtctctattaaaaatacaaaaattagccaggcgtggtggcaactgtaatcccagctacttgggaggcggaggtaggagaatcgcttgaacctgggaggcagaggctgcagtgagccgagatggtgccactgcactccagcctgggtgacagagcgagactgtctcaaaaaaaggaaaaaaaaaagtgaaaagttttgtaaagaaaatatataacagtttataccttaaagtactttcagagtaatctgacttactctaaacaaaaataccaccacgattctaaagggcacacggcacacagtgtcaaatcatgtaaataggagcagagaaagtatcgactggattattcttcaatttaagataatcagcttcagctgtaaagaagacagtgccttaacatcaaattcaaccacctttactcttccgtttgctgacttctttggtacatgaatattattgaatacccctcttgaaatgccttccttttttggctttcctcattttttatgatactggatttcccaccttgccaataccaattcctgtcttttctggtagaaatccttttttcctctaccatattcctttttctagagagctgatctataatcatggcttcaaatgtaacctctagttcataatattccacacctatattttcttcttttctttttttgacacagggtctcactctgtcacccagcctggagtacagtggcgtgatcacagcttactgtagcctcaacctccaggctcaagcgatcctcccacctcagcctcccaagtagctgggactgcaggcatgcaccactatgcctgctaacttttgtattttttgtagaggtggggttttgccatgttgcccaggctggtctcaaactcctgacctcaagtgatctgcctacctcagcctcccaaagtgttgggattacagacgtgagccactgtgcttggctggcaccaagtattttcataatacctaataacacatactataaactgcatccggatttaaaaaaaccctgaagtataaataaaagagtgctcagataagagagatttaaattttaaaagatttcttccagggaacaatcattcagaggttactgaaaatttgtagtttctagagttcaaggcattgaaatatattccccatttgttttgacaaccagaataagtccttaaattatataaaaccaaaacatgtttctatttgttgtgtctggaaaccaaactaaatttaccaaaatctgaaattagatgctgtaaactacaatgtgaggtctttgatttagtacaatttgtcattatctttagccagataatgcccttgaaaaacgagagttgggctggatgcagtggctcacacctgtaatcccagcactttgggaggctgaggcaagaggatcacctgaggtcaggagttcgagaccagcgtggtcaacatggcaaaaccctgtctctactaaaaatacaaaaattattagccgggtgcagtggcaggtgcctgtaaatcccagctactcgcaaggatgaaggatgaggcaggagaatcgcttgaacccgggaggtggaggctgcagtgagctgagattgtgccattgcactccagcctgggcaacgagaatgaaacttcgtctcaaaaaaaaaaaagaaaaatgagacagtcgcaccccagccagctactaaacgtagatctaggttgtccttcatatagtgagatttaagggttcaggaccggcctcggctaagtatcgagatcccgtctctactttaaaaataaataaaataaataaattagccaggcgtggtgacacgcgtctttagtctcagctactcaggaggctaacatgggaggattgcttgagtccggaaggtagaagttgtagtgagctgtgatggcgacactgcactccagcctgggcaacagagtgatatcctgtgtcataaataaataaaaatactgagcttgtggaccacactgtttaataaaagtgtgcatttaaaatatttgtgagtaaagaaaatcagtatgcaaaacactatgtgaacctgtatgtacataaaatgataaggtgtgaatttacagtgatgcaggtaaggtagaatttcccaactggcatgctgaagcaggaagaactaaaacattgattcccttcagaccacatggacagctgactagagatcaaagaagctacttttggccatgagaactatccagaacaggaaatactgatgtaaaattcactgattcttttttattttgctgcacatgtgcattgttactaaaacaacaaattctatatccactcctttgtctattagacatttctattttgaaatttcagtgccgtttaaaattatatactctcttggccaggtgtggtggctcatgcctgtagtcccagctactcgggaggctgaggtaggagaatcacttgaacctgggaagtggaggttgcagtgagctgagatcgtgccaccgcactccagcctggcgacagagcgcgactctgtctcaaaaaaataaattaaaaaaatacaaaaattagccaggcatggtggggggcacctgtaatcccagctacttgggaggctgaggcaggagaatctcttgaacccgggaggcagaggttgcagtgagccaagatcgcgccactgcactccagcctgggtaacagagctagactccatctcagaaaaagaaaaaaaaaaaattacagactcaaatcaaagtcataactcataattctttttttttgggggggagatggagtttccctcttgttgcccaggctggagtgcaatggcaggaccttggctcactgcaacctctgcctcccaggttcaagcaattttcctgcctcagcctcccacgtagctgggattataggcatgagccaccatgcccggctaattctgtatttttagtagagatggggtttctccatgttggtcaggctggtcttgaactcccgacctcaggtgacctgcctgcctcagcctcccaaagtgcttggattataggcatgagccaccatgccagccaaattcataattcttatctccaattcagttagattccacactttattttcagagagagaatatatccccatatgaagagcatatcccctatatgccgatggtttatcaacatacttttcttctaaaatatattatgcccttcctcttcactctcactgccactgtcctattctgcttcctcattgtggcaaccatatattgagagctaggaaggtacctaggactgtgcttaatgttttatgagctgggcacagtatcacatacctatagttccagctactcaggaggttgaggtaggaggactacttgagcccaggagtttgaatccagcctgggcaacacagtgagaccctatctctaaaaaaaacaaaacaaaacaaaacaaaaaccccaaaacaagaaagccaaaacttcacaaacattgtttatcaacagtctcatataatctccacaaaccctccatagagaaggtaaggtattacttttattagatgcattaaataacttttctcaggtctcataaatagtaaaaggattggctgggcgcggtggctcacgcctgtaatcccagcactttgggaggccgaggctggtggatcacgaggtcagattgagatcatcctggctaatacggtgaaatcccatctctactaaaaatacaaaaaaaattagctgggtgtggtggtgggtgcctgcagtgctggctaccagggaggctgaggcaggagaatggtgtgaacccgggaggcggagcttgcagtgagccgagatcgcgccactgcactccagcctgggcgacagagggagactccgtctcaaaaaaaaaacaaaacaaaacaaaacaaaaaaaacaaacaaaaaaaaagtaaaaggatttaaaccaacgaaggcacacacaagactctaaatctcattcattttctgtttctgtattccgcccacccattatggtttatatatctttgtgcaacttcttgaaaaaaatcaaagagcctatttaactgtaccctccaaaggaagtgttgtatgtataccttaaagcctatgctttagagaaatcaaagcatgacagtacctattgaggcagtcatcaacacagcccttcctggtgtcatcatctggcttcttacagttacaggtggtagcttcgtaaccagaaaggggtttgacatcaacgtagacatcttgaaaagaaagcaaagaatagtttgtgaacatacaggataatttttcaagtgctaggctcagaagaacattaacgtatagaggcagaaaaaatagctcctaagttactcacttgaacgaattttcttatatagtgggacatctggctttttgtatagctagaagaaaagaagaaaaatcttgatatagcatttaacttcaaatgccagacggcagcatcaatcactaaaaatacaggaaattttctatgtgctctgctcatctggaaatatttacaagacattttgggttggatacatttgagggaaactcttggtgtgatctctttttactctgaaataaaaggtgagagaataagattcaacagaagaagcactaaatagtttatacaagtggaattacatgtttcttcagcatgttgttggatagacttaaatgaaaatcacactggagaccaaagctattcatttggacaaattaagattctatttgcttctatcaaaagaaaggaaaacaacatgcataggacttacttagatgtctgggtgggtacatgaaattaaaaagatgagtaccctggcttttcaggttgagaattataggaaaacatttcaaattttaattaaggcaattaatttagtgaataaaggagagagggcaggcaggcaaaatggagctctcacattataatcaagaagatattagaaagaaaaaaaaaaagaatgcattagaagagaggcagtcttccagcattttgccataagggactgtacaaaacaaacagcaacttgcacaaagctagactgtttattaatatattggaataatcccaccattattttctagtcagtatgttcaaagcattctctccttcattgttaaaaactctgagacaaatacctaacatattaatactctcagaattcaagagaggccattggagaagacaacgcagaggggaatgtcaattttggctttccaaaataaacctttggtggcattttggcagaactcaagaaatctattcacctcaattgcatgactatttctatttcccaatggttgttctcaatatgagacctgggggctataagctaatacaaaaatcactacgggaaacttttcaatttgggaagcaagagaaaaaacacggcatcttcctgtttttagttaccaatatatttaaagattttttaaaagtgcaagagtgttaaacatttccctgcttcctttgatagaagaatctcttttgcatgtgaaaaataaatttcaaactgataagaaggagccaacaaaaataaagtctgaaatttcttagtgctgctggcagtacatctaaattctcctgagacctgcatcaaatagaattcttacagaacaaaatctttgctaccaaaataaaagtccagaataacaacagaaggttgcctaggaaagcaggaacttactgctattttgcagtaagagtaaaggcaaataggtcacattaaagatggatgcaaattcatttttcttagtcctaaccttcacagggacacttctgaaaacctcctaagatgaaaacataacaaggggagagaaaaacacttgcatttccacccctccccctttaccacttaagaatgaaacctggtaaaacaggctctctgtacctgattgtgtttccactgccaaaggatatcataaggaagctggaagtcaattctcttttgtcttagatactttcctgaaacaaaaaacactattaatttcaataccttttctaatatttgcttatacaaaggtgtcaaacagctacaagaactaacatgtactgactaaaaaaataaagatttaattctttaaggatttttccatcaccaatttttaattttagctcttctttcccactatactccacacgatatatgccgaagatatattttaagtataatagtctacataaaacaacaaatacagcaaaactacaaccaaaaacacacaggtcattatgaagcttattaaatattttattattattaaaaattattaagggtacagcatctggcacctgctcttcattattacacataacctaaggttgattacaaaaaggagaaattcttgtgtttaaataactcgagaagttttccaggcaaatttatgatcttttaacattttttcctacctattgaaatagtatttttgtttgatttttttgtttttgtcttatataaaattattcagccttaaaaagaatgaaattctttttttttttgagatgaggtttcgctcttgctgcccaggctagagtgcaatggtgcgatctcggctcactgtaacctccgcctcctgggtttaagcgattctcctgcctcagcttcttgagtagctgggattacaggcatgtgctaccacacccagctaatttgtattttttttttttttttagtagagacagggtttctccatgttggtcaggctggtcttgaactcctgacctaaggtggtccacctgcttcagcctcccaaagtgctgggattacaggcatgagccaccgcacctggccaaaagaatgaaattcttatacatatagtcatgtgccaatgttttagtcaacaatggactgcatatatgatggtggacccagaaggtaataagggagctgaaaaattcctcctagctgtcataactttgcagtgcaaagtgttaatcatgtgtttgtggtgatgctggtgcaaataaacctatagcgctaccagttgaatacaagcatagcagacataattaggtataatacataatacttgataaaatgtctttgttgctggttttataattaatatactatacttttcatcattattttagagtatactcctgcttattaaaagacatccttggctgggtgcagtggctcatgcctgtaatcccagcactttgggaggccgaggcaggtagatcacgaggtcaggcattagagacaaggctggccaacatagtgaaaccctgtattaaaaatacaaaaaattagccgggtgtggtggtgggcgcctgtaatcccagctactcaggaggctgaggcaggagaattgcttgaacctgggaggcagaggttgcagtgagccaagattgcaccactgcactccagcctggacaatagtgcgagactccgtctcaaaaaaaaacaaaaatcaaacaaacaaaaaaaccaaccttggctgggcgcaatggttcatgcctgtaatcccaacaacactttgggaggctgaggcaggcagatcacttgaggtcaggagttcaagaccagcctggccaacatggtgaaaccccaactctactaaaaatacaaaaattagctgggtgtggtggcacacgcctgtaatcccagctacttgggaggctgaaataggagaatcgcttgaacctgggaggcagaggtagaggtggaggttgcagtgtgtcaagatcacgtactgcactccagcctaggcaacagagtgagacacggtctcaaaaaaaaaggaaaacaaaacaaaacaaaaaaacagccttgccaggagtgctggcccacacctgtaatcccagcactttgggaggccgaggtgggtggatcacttgaggtcaggagttcgagaacagcctggccaacatggtgaaagcctgtctctgctaaaaatacaaaaattagctgggtgtggtggcgcacacctgtagtcccagctactcaggaggctgaggcaggagaattgtttgaactgggaggtggaggttgcagtgagcccagatcgtgccattacactccagcaggcaacgacacagactctgtctcaaaaaaccaaaccaggctgggcgtggtggctcacgcctgtaatcccagcagtttgggaggccgaggtgggcagatcatgaggtcaggagatcaagaccatcctggctaacatggtgaaaccctgtctctactaaaaatacaaaaaattagctgggcgtggtggcgggcatctgtagtcccagctactcgggaggctgaggcaggagaatggtgtgaacccaggagatggagcttgcagtgagctgagattgtgccactgcactccagcctgggcgacagagcaagactctgtctcaaacaaacaaacaaacgaacaaacaaaaacccaaaccaaaccaaaaaacagtcttaggcagatccttcaggagatattccagaagacattattaccatatcagatgacagctccatgagtgttactgcccctgaagacctttcagtagaacaagacatacagcgagaaaacagtgatattgatgatcttgcccctgagtgggcctaggctaatgtgggtttgtgtcttagctcttttttttttttcaagacagtgtctcgctctgtcacccagcctggagtacaatagcaggatcatggctcactgctgcctcaacctcccagactaaagcgatcctctcacttctacctgccaagttgctggcactacaggcatgtgccaccatgcctggctgattttttattttttgtagacagggtcttgccatgttgcccaggctggtctcaaactcctgggctcaagcgatctgcctgccctggcctcccaaagtgttgggattacaggcgtaagccgccatgcctggccctcttttcgcttttaactaaaaaagtttaaaaagaagaaaaaatgttaaaaataaagcttataaaataaggacataaagaaaatattttcttgtacagctgtacaatgtgttcatgtttaaagctaagttattatgagtcaaagtgttaaaaaattaagtttataaagtaaaaaagctacagaaagctaagattaacttaactattgaggaacaaaaaataaaaatttagtgtagcctaagtgtgcagtgtttataaaatctacagtagtttaacagtgatgtcctaggccttcacattcactctccactcaatcactgacccacagagaggaacttacaatcctgtaagctccattcaggtaagtgtcccatagtgggctgccattttttatcctttatattgtatttttactgtaccttttctacatttagatatgtaaatacttaccactgtgtcacaactgactactgtattcagtatactaacatgatatacaggtttgtagcttaggagcaagaggctataccatacagcctggttagtatattctgtttgcataattataagattgcctaacaatgcatttctcagaatgtatcctcatcgttaagcaacacatgatggtactacaacatggatgaaccttaaagacattatgctaagtgaattaaggcagatacaaaagaacaggtattatacaaccccactttcaaagaaatagacagtgattaccagaggctgaggggaacagagaatggagagttacagtttaatgggtacagagttacagtaggggataatgaaaaagttccggggatggatagcagtcatggtcatacaacaatgcgaatgtacctaatgacactgaattgtccacttaaaaatgatcaaaatgcaaattgtgttatgtatattttactggaagttaaaaaaaatgtaatatatcaaaaactatagtctattttaaaagagtaaattggatggtctgtgaattgtatcttaataaagttgctaaaacaatacagcagtgttaaaactttttgcttcaatgattaaacgtaacttagaaaaaactcaagagaaggaaagcctattgtatatatccatgtttttgcttactgtattcttccttcctaatgttccaaagtgtcttttttttaaaattgtttcctttctgttcacagaacttgctttactcatagggtacatctgctggcaacaaactctcttagttttccttaatctaagaatgccttcatttcttcttaattcctgacagatattttcattggttagaagattcggagttgacaattctttgcttttaggatgtgaaaaatgctgtatcacttccatttggcctccatagattcagatgagaaatctactgtcatttgaattgttttatccttataggtaagggtaatttctctgtcattgctttaaaattggtgtggtttttttttgttttttttattttttctgagattcgttctcctgagtagttgggatgacaagcatttgccaaccatgcctggctaattttttttgtattttttgtagagacagggtttcaccatgttgctcagggtggtctcaaacttctgagctcaagcaatcagcctcccaaggtatttggtattacaggagcaacctatctcgcccagcctaaaattgttttgttagtgtactgaaatgtgattatgtgtctcggcatatatttgtttgagtttatcctgttcggagtctgctaatcttcttgaatacagagatttctgtctcctgccaaatttggtaagtttccagttgttatttactaaggtgcttttcatctatgcccttttttttccctccttccatgactccgataacacaaatttgctttttttgtcatattctcacaagctcctcagtctttctgtttttaattctattttctatgttgttgtatacgctgagtaatatgtattattctatcttctagtgcatagattatttcctctgtcccattcattctgctgttaagtctatctctgaatgtatttttttttctggttcaatttctctcataaaagctctgaactttttatttcaattactgagtcagttataaaaattctaatttaaaaaaattattggccaggtgcagtggctcacgcctgtaaacccagcactttgggaggtgaggcgggcagatcacttgaggtcaggagttccagaccagtctggccaacgtggtaaaaccccgtctttactaaaaatacaaaaattagccaggtatggtggcacatgcctgtaactccagctactcgggaggctgaggcaggagaaatcacttgaacctgggaggtagaggctacggtgggcagagattgtgccactgcactccagactgggcaacagagcaagaacctgtctcaaaaaattaaaataataaataaaataaaatatgaaaaattatcttcttctatttcttgatttgtttcaagcatgttcacaattgctcactaaggcatttttatcaagactgctttaaaaatctgccagataattctaatgtcttggtgtggacataaattgtcttcccaaagtgctgggatttcaaggcatgagccaccatgcttggcaaataacatatgattttaaattcaaagttaaacacttttgtagtagtataaggttctagattttatgaaatttgtattttagctggctttttctgaaactgctccagcagaaaagggataaagctgcctcattactgccagctgtaagtaaaagaccaagttgcctactaggcctccactgaaacctgagtgttgggggatggggaagctccccattactgctagggaatggttagaattccaatttcccaaggggtctccactgacattgtggtggggtagttatgttactgctaggtgttggtaaaagtctgactcggctagacctcctctgacaccatggcagtggagggagagacatatgattgttggccacgtatatgtcttttgagaagtgtctgttcatgtcccttgcccattttttttttttttggagatggagtctcactcttgtcacccaggctggagtgcagtggtgtaatctcagctcactgcaacctgtgcctcctgagttcaagcgattctcccgcctcagcctcccaagtagctgggattacaggagcccaccaccgtgcccaactaatttttttgtattttaagtagagacagggtttcaccatgttggccaatggtctcaaactcctgacctcaggtgatctgcctgccttggtctcccaaagtgctgggtttacagatgtgagccactgcgcctggccaagagtctttaaaaaaattttattattattgttgttttgagacggagtcttacttttttgcctaggctggagtggagtggcatgttctcagctcattgcaacctctgccacccggagttcaagcaattctgtctcagcctcctgaatagctgggattacaggcacgtgccaccatgcccagctaattttttctattttttttttttagtagagacggggtttcaccatgttggccaggctggtctcaaactcctgatctcaagtgatctgcctgccttggtttcccaaagtgctgggatgacaggcgtgagccaccacaccaggccttgcccacttctcaatggttttttttcttgtatatttaagttccttatagatgctggatattagatctttgtcagaagcagtttgcaaaatttttctcccattttataggttgtttactctgttcatagtttattttgctgcgcagaagttcatactatttgtccatttttgcttttgttacaattgcttttggcatcgtcatgaagtctttgcctgtgcctatgtcctgaatggtactgcctagattgtctttcagggtttttatagttttgggttttacaattaagtctttttttttttttgagacagagttttgctgtgttgcccaggctggagtgcagcgatctcagctcaatgcaacctccacctccagggttcaagtgattctcatgcctcagcctctcaagtagctgggattataggcatgtgccaccacacccagctaatttttgcatttttgttagagatgggattttgccatgttgatcaggctggtctcgaactgctggcctcaagtgatccacgtgcctcagcctcccaaagtgctgggattacaggcgtgagccaccacgcctggcctacattgaagtttttaatccatattttgtttttgtatatgctgtaaggaaggggtccagtttcaaccttctgcatatggctaaccagttatcccagcaccatttactgaatagggaatccttacccaattgcttgtttttgtcaggtttgttaaagatcacgcagttgtaggtgtgcagtcttatttctgggttctctattctgtttcactggtctatgtgtctgctcttgtatcagtaccatgctgttttgattactgtagccctgtagtatagtttgaagtcaggtagcatgatgccttcagctttgttctttttttgtgtgtaggattgccttggctatttaggttcttttttggttccatatgaatgttaaaatagtttttttctagctctatgaagaatttcaatggtagtttaatgggaatagcattgaatctataaattgctttgggcaatatggccattttaacggtatttattcttccaatccataagcatggaatatttttccatttgtgtcttcgctgatttctttgagcagtggtttgtagttctccttatagagatccttcgcttccctagttagctgtattcctaggtattttattctttttgtggcaattgtgaatgagagttcaatcatgatttggctcttggcttaactgttattggtgtataggaatgctagtgatttttgtacattgattttgtatcctgagactttgctaaagttgtttatcagcttaaggaacttttgcttaagcaaacactccccagtgggtgtttgctggtgtaagtttgagagaggtgtgaaagttgattagacaaaacggaatcattcataccatatccaactaaaatggagtcaggaggccatgggggagggcactaaggtccctgatccaggaactgattttgcatttcaacagaaaattcactctaactataattaagactatgtcttatatagtaactgctgccactcaccaatgacaactgtaccagtgacctttttcttttctttctttgtttttgagacaggatctcactctgtctttcaggctggagtgcactggtgcaatctcagctcattgcagcctcaagctcccaggctcaggtgatcctcctgcctcaggctcctaagtagctggaccacaggtgcatgtcaccatacctggctaaatttttcttttctttttaaatttttgtatacatgggttttcattatgttgtccaggctggtctcgaattcctgagctcaagcaatccaacagcctcagcctcagcctcccaaagtgctgggattataggcttgagccactgggcctggctgaccttcttccaaccttcctcttttgctcaatacaaccccagcctttctctttgtttttcagacacacttagggactaccctggtctatgtgtcctgaattgcgattctttttttttttttttttcatagaaaacagggacttgatccatcacccaggctggagtgcgctggtgcaatcataactcactgcagcctcgatctcctgggctcaagtgatcctcctgcctcagcctcctgagtaggcatgtaccaccgcacccagcaaatgttgttattgctttatagagagaggttctcactacattgcctaagttggtctcaaactcctggcctcaagcgatcttctctcctcggcctcccaaagtgctgggattacaggcatgagccaccatgcctggactaattctttttttttgagacagagtcttgctctgtcacgcaggctggagtgcaatggtgtgatcctggctcattgcaacctccacctcctgagttcaagtgatcctcctgtctcagcctcctgagtaactgggattacaggcatccactatcactcctggctaatttttttctatttttagtagagaccatgttggccaggctggtctcgaacttctgacctcaggtgatctgcctgcctcggcctcccaaagtgttgggattacaggtgtgagccaccacgccaagcctaattattgtatattattcccaaataaaccctttacttggagatatatatttatattatctgaatatatgtttatttaagactttaaaaaagaggctaggcgcggtggctcatgcctgtaatcccagcactttggaaggacgaggtgggtggatcacttaaggttaggagtctgagaccagcctgggcaacatggtgaaaccccgtctctactaaaaatacaaaaattagctgggcatggtggcgcatgcctgcagtcccagatactcaggaggctgaggtgcaagaattgcttgaacccaggaggaggagaatgcagagagccaagatcacgccactgcactccagcctgggcaacagagcgagactccatctcaaaagaaaacaaaaacaaaaacaaaacacacatctatatgcaggtttttcttttcaatagatatgttttcaaattatttgagaaaataccaaggagcatgactgccacatcaaatgttcagagtatattaagttttataagaatacaattgattttttaatactgatgattttccagtaaccttgctgctactactaccagtagctttttttttttttttttggtgtggatctctttggattttttttttatataaacaatcatgtcatctataaacagaaacagtttcatttcttccttcctgatcattatgatgactcttactcatcttcttgacttaatacactgcctagaacatccatgtaatgctgagtcagagtggacaactctatcttcttcccaatcttaggaggaaacattcaacatttcaccattaagaatgatattaggccaggtgtggtggcttaccagtatccaaaataaaaaaagttgatctcactataggtcctagactcattaagagactaataagggaatgttataaataatgttatgccagtatctttaataatttagataaaatggacaaattcctttagaaatacaacgtatcaaaactgagtcaagatgaacatctgaatagtctagatcttttaaataaattgagtaccttaccatattattcacataaaaaatttcagttctaaatggcttccctagtgaagtctggtatatgtttgagaaagaagtaataccagtcttccagaaaacagaggaggaaaataattttccaactcatttaatgaagctagtgtatgcctaatacaaaacttgacaaagactttaaaagaaaaaacaactatagaacaaaattaattctaaagacttctgcagaaagctctcagaactaaaaaggaatttccttatcttattaaagatatctgtagttaatatcattctccccccccccccttttttctttcttttttttgagacggagtctcgctctgtcacccaggctggagtgcagtggcgtgatctcggctcactgcaagctccacctcccgggttcacaccattctcctgcctcagcctcctgagtagctgggactacgtgcgcccgccaccacgcctggctaattatttttttgtatttttagtagagacgtggtttcaccgtgttagccaggatggtttcgatctcctgacctcatgatctgcccgccttggcttcccaaagtgctgggattataggcgtgagccaccacacctgcctgtgttttttttttttgagacggagtcttgctctgttgcccaggctggagtacagtggcgcaatctctgctcactgtaacctctgcctcctgggttcaagcgattgtcctgcctcagcctcctgagtagctgggaatacaagtgcatgccaccacacctggctaatttttgtatttttggcagagatggggttttgccatgttggccaggctggtctcgaactcctgacctcaggtgatccacctgcctcagcctcccaaagtgctggcattacaggtgtgaaccatcacacctggctgacaatttatattcatatactttcaagttcaactgacacttctgccatcttcaatctgttattaaacctacattttgtgttttaaaatcagacatatatgttttagttctgggactttcatttgctattgttcattttaaaatttttatgtttccatttttaagatttatctgcttgttcattataagcatattttcctttacatccttgaacacagttataacaatgactttaaaatccttgtctgctattttcagcatctggatgaccttggaaattgtcagtgttgactgccttctctcttaatatgaattatattttcatgtttattaacgtccagtaattttggattgaattatggacattataagtaatacgttacagagattctcaattgtgttattatcctatgaaaataactggtttcggccgggcacagtggctcatgcctgtaatcccagcactttgggaggctgaggtgggcaaactgcttgaactcaagagtttgagactagcctgagcaacatggtgaaaccctatctttatcaaaagtacaaaaaattagccaagtgtggtagtgcatgcctgtggtcccagctacttgggaggctgaagtgggagaatcacttgagcctaggaggtagaggctgcagtgagccaagattgcactactgcacttgagcctcaacaacacaatgagattccatctcaaaaaaatagaaataaaaataaaaaaataagaaagaaataaaagaaaataagtttttctttgcattagagcaaccagttactgtgggttaaccaaaatctgtaacactctcttccgtggggtaggcagcagctgaaatccctacttagtatctttagtctcaactaactatactggattctggctgcatatacatagtttagggggtcagttacctagataagtggcttgagtttatatgcaaaatttgcagtttcccctattagcattttatccctcactttcctgctgctgtagctgtcctgaaacatggcccttaaataatcagtaagattcaaggtttctaagtgcttacttgtactgctaactgggacctggccacagataaaaagagctatacaagcgggaaatgcaaccagtgtgcttctcctcttctaattattgatttttcttcagtttgtgcctgcttttggttgctctccagtgacttaggattactatgttttaaatttgtccagttgatgcatttttttcttatttatttatttatttttttgagagtcttgctctgttgcccaggctggagtatagtagcatgatctcggctctctgcaacctctgcctcccaggttcaagtgattctcgtgcctcagcctcttgaggagctgggactacaggcacacaccattatgtccagctaatttttgtatttttagtgcagatggggtttcaccatgttggccaggctggtcttgaactcctgacctcaggtgatccacctgcctcggcctcccaaagtgctgggattacaggtggataattgttattcccgggagggttagcctgatgtaatctactctttcaataccaaaagtagaattcctcgtctttttttttttttgagatggagtctcactcttgtcacccatgccggagtgcaatggggtgatcttgaactcctggattcaagggatccgcccacctcagcctcccaaagtgctgggattacaagtgtgagccaccgcgtccagccttgttcttattttcaaagcctatttatcattagcagattttaaatttgctgagagcctgcttccgctgctatgatctcactagtaaatacaaaagactctttcaaaagagctttggcactaatcctagagaataaggaacttactcttaccttcattaagtaagcacacgtaaagtttatgtagctgagaattaaaccttgtaacttcatgttgtagttaaatctgtctccagccacccaatacagaataattcaagcaaactaatctttactgaagaacttgtttatgtctgctgattaaaaaactctgctggtactgaactctctcagggagaaaaggagattagttaatcagaatataaacaagagctccacagtcaagagagttaagagaatcatagttgaagaaaacactacaagacataggatcaacatcaagtatacaattaaggtgttcctggtttcatactatgtgtttaatgaacccctttaaagcaattttgtttaaacaaactgaatatatgaagaaaacctgacatttacattcaatattttatccttatttcttttcttttttttttttttgagactgagtctcactctgtcgtccaggctggagtgcagtggtgcaatctcggctcactgcacactccgcctcctgggttcacgccattctcctgcctcagcctcccaagtagctgggactacaggtgcctgccaccatgcccagctaattttttatatttttagtagagacagggtttcactgttagtcaggatagtctcaatctcgtgacctcgtgatccacctgcctaggtctcccaaactgctggggttacaggtgtgagccaccgcacccagccttctccttttctttcatttgtacggcaaatatttgataaacttctattatgtaccaggtgctgggaaatccagggagagtaagaaagacaatgatcctgtactgccggagattataatctaatggaggagccaaataaatattgtaattatagatatagagagtgatgttatctagaacaaagagagacgaagcctcttttgatgagactatcaggaaaattattttaaagaaaataaatcgtattgaagctgatactaacattaagatcatccttaaaagatgagcagaaaccaaccatgggaagactgaaaaagagcttttcaggcaatgggaataacaagtataatgaccctccagtgggaaaaagcttgctatgttctaaaaactgaaagaaggccagtatgacacaatatagtgaataaggttgagatgggaatgaataaaaggagagagatggggtaatcaggaaccagatcattcaagtcaagaagtttgcattttaatctgatggtaagccatgcaaagcttttaagtatgatctgggttaagttaaaaaataatttctgtttttactgaatggaggctgggccacatggaaacacaactggaaatagatctgttagatggctattgcagcagcctgaagaaaagatactactgtcacagacttgagagatagcaatgagatttggagaggagtaggatatatttcagggatagaaacacaacagaacttgagatgaactggataagggacagaaaaaaatgggaggaacttagaatgacttcttggtactttttacttatctgataagctcaataatagggtcctggaaggtactactatccaaatgctaaacaaagtcttgacatttttgccaagaatgaacagtagaataaatatcactccactttcaagcagataaatactcagtaaaagcagtggggcttcttactctgatcatatgtgtgtataaatcatctatttttgaacgtggaaaatatttgacactgaatggctactacttggtttttcctaggtgacatacctatggaaacaaaaggtacagacatagtgttatttatttaattttttttagagacaggatttctctctgtcaactcaggctagagtgcagtggaaggatcatgactacaccatagcctcaaaatcctaggcttgggtgatcctctcacctcagcctccagagtggctgggactacagacctgtgccaccacgtccagctaattttcatattttttgtagagacagggtgtcaccaagttgcccaggccatcaactcctgggctcaagcaatccacctgcttcagcctcccaaagtgctaggattataggcatgagccaccatgcctggcccagtgttatttattaaggctccaatgaacaagatttatgccactgtgaccccctgactatcaaacagtgtataaaattcttcagagtaagtttaagtaaaatggtaaagaaagagcttgatcccactggagaaatagaaataataacaagattaaaaagacatttccctcaaacccaggaaatactgtttcttctcagcaatacattgtgtggactcggtacttaccaacatgaatgggcgctggaaataatccatattcatgctctcctggagtatactccagcttctctttctttaattggatcaatcgactctttgggctgtgataaaaaaagaatgggaaacagtcaagaggcaaagaaatttcctcctgtggtcaaatacagataacagatcatcctatgaggagagggtaccaagtacattgataaattaaaaaaaaaaatctttacttctgaaactgtccttaagaaagaggctcctggctgggcgtgggggttcacgcctgtaatcccaatacttttggaagctgaggtggaaggactgcctgagcccaggaatttgagactggcctgggtaacaagtgagaccctgtctctacttttaaaaaaaaagaaagaaaagaaagatgctcttttattttctccaacagttttggagaaggaacacaaattttagatcggattataatgactgccttatatttggttactttatatcaatactgtgaagtaggtaagaggaaagatgctctataagactgagtgacttgccttgattttagtagttgggaaggagatttaagcttcaaaacctcagtttcttgctcaacatctactcactatattattctatattattctcttgcttttattccaccatgtctctctgggcttgtgtcttctactcacattattggtttgtttcctaaagtttaaaatgcgatctcaagagatttcataaatatataaaagggggaaaaaaagaaggaaaacaaaaaaggaaaatgagaaaaaagggccttagaagagtctcatttaagatattatgactatattttagcttaaagttccaattaattcttttttttgtttttttcagatggagtttcgctcttgtcacccaggccggagtgcaatggtgtgatcttggctcactgcaacctccacctcccaggtttaagcggttctcctgccttagcttcccaagtagctgggattacaggcatgcggcaccacgcctggctaatttttgtatttttagtagagatggggtttcaccatgttggtcaggctggtcttgaactcctgacctcaggtgatgcatccgcctcagccaaagtgctgggattacaggcgtgagcaactgtgcctggcctaaagttccagtgaataagacaaagctgatatatttatttcctttaacgaaattataacatactgacttttggccgggcgcagtggctcacgcttgtaatcccagcactttggaaggccgaggcgggtgggttatgaagtcaggagttcgagacaggcctggccaacacagtgaaaccccatctctactaaaaatacaaaaattagctgagcatagtggtaggtgcctgtaatcccagctacttgggaggctgaggcaggagaattgcttgaacccaggaggcagaggttgcagtgagccgagatcgtgccactgtactccagcctgggagacacagctagacaccatctcaaaaaaaaaaaaaaaaagctgggtgtggtagtgcatgcctttggccccagctactcgagaggctaaagtgaaaggatcacttgagcccggggtggggcagaggctgcagtaagcccagatagcacactgcactccagcctgagtgacagagccagactctgtcaaaaaaagaaaaaaaaaaaaaaaaagcatggtaacaaaaggcaatgcatgatcatggattatatcctgaatcagtgtaagaaagattgctgaccggacagggtggctcatgcctgcaatcctagcactgtgggaggccaaggcgggtggatcacctgaggtcaggagttcaagaccagcctggccaatgtgataaaaccctgtctctactaaaaatacaaaaattatctgggtgtggtggagcgcgctggtaatcccagctactcaagaggctgcagctggagaatcgcttgactccgggagacggaggttgcagtgagccgagattgtgccattgtactacagcctagacaacaagagcgaaactctgtctcagaaaaaaaaaaaaaaagaaagaaagattgccatcattatgaagacaaccttcatttatttatttttttcttgagacagagtctcactctgttgcccaggctggagtgcagtggcatgatcttggttcactgcaactctgcctcccaggttcaagtaattcttgtgcctcagcctcccgagtagctgggattacagatgccaactactgggattacactatgcctggctattttttgtatttttagtagagacagggttttatcacattggccaggctggtcttgaactcctgacctcaggtgatccacttgcctcagctcccaaagtcttgggattacaggcgtgagccacggcacctggccaggttatcttaataattcataaaacaggtaataaacatcatgtgctttaggaaaatattaaatgatttttaatttatttactctcataatttattatgattaatatttaaacaagtataaaattatttagtaccaaataaccagaggaaaaataggatcaaaatcatactgacagggaaagaaaaactgtcttggatttaaaacaatgttccagtaaaaacaatatatttataaagactgttatgatctgagtctattaatatacatctaggactataacatagatgtacttaaacacagcacagctcactcaaacgcagatatatgtaaaagcactttataaacagcaaaggagaacacaaacataacttaatagatgtaataaatgttgctcacagaaactgttttggatagaaatataaagtcatttgtcatttgatagtgatacattctgacaaatgctgtgtgaacatcatagaatatacttacacaaacctagatggtatagcttataggtcctaggctacaaacctgtttagcatgtaactgtactgaatattgcaggcagttgtaacacaatggtaagtatttgtgtatctaaacatttctaaacataagaaagatagagtaaaaatacggttgtaaaagataaaaagtggtacactttatagtatagagtacttaccatgaatggaccttgcaggactggaagttgctctgggtgagtcagtgagtgtgtggtgaatgaatgtgaaagcctaggaaattactgtacattgtacaaaaaaatgtacaaaaaagccaaaatgctaggaaagctatgacatcactaggtgataggaatttttatttttttgcttttttgagacagggtctcattctgtctcccagggtagagtgcagtggcgagatctcagctcactgcagctgcagcctcaacctcccagactcaagtgaacctctcgcctcagcctccttgccctccgagtagctggaactacaggtgcatgctaccacgaagggatgggacattttatttatttatttatttttgtagacacggtgtttcaccatgttgcccaggctggtcttcaactcctgggctcaagcgacttgcctgccctggcctcccaaagtgctaggattaccggtgtgagccattgtgcccagcctacaaacttttcaggataaaatttggcacttaatccattttgaaatgtctatcttgggtagatatgaaattgatgaaccaaaataatttcctcatatttgttaccacatgagagggcagatgcatttaaatctctttaaggagattttaagtcatagatattttagtaattatatgtagaaaatgctgctgggttctacaaggcatccaagttgaacaaagggtggccctggccataagaagtttacaatttggtgggacaacaagtatgtatgtagatatctagattatctatcagaatgtgataaaactttgaggccgggagcagtggctcacatatgtaatccaagcatgtaatccaagcactttgggaagtaggggcgggcagattacctgaggtcgggagttcaagaccagactggctaacatggctaaaccttatctctactaaaaatacaaaaattagctaggcgtggtggcacctgtaatttcagctacttgggaggctgaggcatgagaactgcttgaacacaggagacagaggttgcagtgagctgagatggcaccaccgcactccagtctgggtgataaagtgaggctgtcccaccccaacccccaccccccaaaaaaaacagaatgtgataaaactcataacactacttactaggaggagatactaagttctacaaaaggagaaagaaaagtaattgtaattaggaaagaattaagaaaacttatttgaaaagataaatgggattttgacaaggaaaggtgaagtagggaaggtagttcatactacacagagcagacatctaggataaaccccaggagaaaagtgtaggatggaggaagtaaggaaaatgatcagatgtggctaaaggaacaagtatttgaggactatgactggacaaataactagaaaaataggttacacaagataagggtgggacttaaatattatgcaacagttctgcaggaagtaacaagatttcaaaggaatctgggtagggaataacgaccccaatgaggacatatgctgggcgtggtggctcacgcctgtaatcccaacagtttgggaggctgaggcgggcaaatcacgaggtcaggagattgagaccatcctggctaacacggtgaaaccccgtctctactaaaattataaaaaattagccaggcatgtagtcccagctacctgggaggctgagaaggagaatcgcttgaatctaggaggcagaggttgtagtgagccgagatcgcatcactgcaatccagcctgggtgatagagcgagactgtctcaaaaaaaaaaaaaagaggacatattacttctaaagaggaagagtcttagaggagtaatttgtccaaggtcacaatatagtgattgtggagtaagacattaaataatattttgaatgcctacttcatgtatggaaagcattctgacattgataactgagtaacaggtactatttatcattgccattttaaagctgaggacactgaggatcaagggttgcccaaatcaataacttgcccaaattcatataactagtaactgacgaagctaggatctgataaattctataaccacaaatgacaattctattctatattccactggcagttaaacttttctgaaaatactgttttcataaattaccttcctaaagatgttaacatttctctcaaaacaatctatccaccaaagtacagtctactttctggaacagatttattttgctaattttactaaatttagataaacataaatttacatacttcagcataatcacctatttacagggagagacggtccagacccagacaaaagataaattaagatcatgccagtgatgtggtggctcacgcctgtaatcccagcactttgggaggctgagtcaggcagatcacttgaggcaaggagtttgagaccagccttggccaagaaggtgaaaccccatctttactaaaaatacaaaaattagtagggcgtagtggtgtacgcctctaatcctagctgctcatgaggctgaggcacgagaatcatttgaaccagggaggtggaggttgcagtgagctgagatcgtgccactgcacgccagccagggtgacagagtgagactctctgtctcaaaaaaaaaaagtgttaaaaaagatcgccggtggccgggcatggtggctcacacctgtaatcctagcactttgggaggccaaggcaggcggatcacttgaggtcaggagttcaaaaccagcctggccaacatggtgaaatcccttctctactaaaaatacaaaaaattagccaggcatggtcgtgggcacctgtaatcccagctactcaagaggctgaggcaggagaattgcctgaacctgggaggcggagattgcagcgagccaaagtcatgccactggactccagcctgggtgacacagcaagactccatctcaaaaaaaaaaaaaaaaaagattggtagggcacggtggctcacgcctgtaatcccagcacactggaaggccaaggtgggtggatcaccagaggtcaggtcaagaggtggagaccaacctggcgaacatggtgatatcttgtctctactaaaaatacaaaaaattagccgggagtggtggtgggcacctgtaatctcacctacttgggaggctgaggtaggagaattgcctgaaccccggaggtggaggttacagaaagccaagatcgtgctattgcacaccagcctgggtgacagagtgagactctaagaaaaaaaaagagcatactggcttccgggaacagtggctcatgcctgtaatcccagcactttgggaggccaaggcaggtggatcacctgaggtcaggagtttgagaccagcctggccaacatggtgaaaccccgcctctactaaagatacaaaaaattagctgggcgtggtggcaggcgcctgttatctcagctacttgagaggctgaagcaggaaaactgcttgaacccaggaggtggaggttgcagtgagccaaggttgcaccactgcacaccagcctgggtgacagagcaagactgtctaaaaaaaaaaaatcatactagctgggcatggtgattgtgccactgccagactccgtctcaaacaaacaaacaaacaaacaaacaaacatcatatcagggttaaaatacttctgaacatcatctacagacaacaggaaaacagactcccttaatgttctttcataaacaatatggcaacttttgccctggggatatgaatttgaagaagggggaggcatcattttttcataatgtcacctttccctaaccttgctccaatccagaccattttactgcacaacttaaaatcctcaaggaatacggcacttttagataaaaaggtaaaattatatttcagattactatataaactttatgctaaaaagtacagaatgtaaaaaatggacatgttattctagagctaatcttttaaataaaaaaaaggaattaatcaaatggtccagacaagttatccatgttttactgctttgttttgtttttaaagacagggccttgttctgccacccaggttgtacagtggtgcaatcataattcaatgcagccttgaactcctaaggctcaagcaatcccaccatcccagtctactgagtaactaggactacaggtctgtgtgccactatgcctggataattatttaaaaactttttgtagagatggggtcctcaccatgatgtctaggctggtctcaaactcctggcctcaagcaatcctcctaccttggcctcccgaagtactgggattacaagtatgagccaccacacccagccaagttatactttttttttttttttttttcagcataaaaagacattgaaggccgggtatggttgcctgtaatcccagcactttgggaagctgaggtgggtggatcacctaaggtcaggagttcaagaccagcctggccaacatggtgaaacccgtctctactaaaaaaaaaaaaatacacaaattagccaggtgtggtagcgcacgcctgtaatcccagctacttgggaggctgagacaggagaatcgcttgaacctgggaggcagaggttacagtgagccaagatcgtgccattgcactccagtctgggtgacaagagcgaaactccatctcaaaaaaaaaaaagagctggtggtggtgcaaatgcctctaatcccagccttttggaggttgcagctgaaggatcattgtggaaggatcccaggagtttcagaccagcctaggcaatggagtgaaactcctgtttcaaaaaaaaccaaaaaaacccacaaaagatatgtcagtactgtagaagctaagtaaagtagggaaaagtacaaacaactctgcagccaattattgccagaactcaaatgttaactatgctattgactaactgtaaaactctagacaaattacttaagtttctctaattctctaagccttagcttcttcaataatattaataatacctgttctctcacaaggttcttgaataaatttataagataacatatataaactcattagcacagtaactggcacataataggtatgcaagaagtattaactttctttttacttcttcagtattagcccagactaatatacctgaaaaaattccaaatatattagggaactagatgcaaaaattgaatccaagcaattaccagaagaaaacaaaagtaaatttcttacttgcttaaaatttgtgtgtgggagagcttttctaatgacttgaaatacagaagctttttttggagggcggcgatctattctgcagaagctgtatcccctctttcacttcctgctgcagccaataaaggccgttcctaccattaaaaaaaaaaaaaaatagccaggtatggtgatgccatgcctgtaatcccagctactcgggaggctgaggcaggagaatcgcttgaacctggaaggcagaggttgcagtgagccaagaacgcaccattgcactccagcctgggcaacaagaacgaaactccgtctcaaaaaaaaaaaaaaaaaggaagcaacctgggcacggtggctcacacctacaatcctagcactttgggaggccaaagagggacttgactcaagagttcaagaccagcctgggcaacatagagagaccctgtctctgaaaaaataaaaaaattagtccagtgtggtggcatgtacctgtagtcccagctactggaggaggctgaggtaagatgaacgcttgagtctaggaggtggagactgtagtgagctggtattatgccactgtactctagtctggatgagaggtagactctgtctttaaaaaagaaaaaaatccagaagcaatttaaaaataaaggccagatatagtggctaacccctgtaatcccaacactttggaaggacaaggcaggaggatcacttgaggccaggagctcaagaccagctcaggcaacatggcaagacctcattgtctctacaaaaaataaaaaaattagctagatgtggtgacgatgtgaatgatcttaagcaaagtcaagacacacatgacggaatccactaaaagactcttaggactaacacctaggttacaggagacaaactcaatacatgaaacacatctgtcagggtaaactggtgggaaaaaaaaatcaattgtatttctatacatagcaataaacaatccaaaaatttaatttaaaatatccaattggagggctgggcgtggtggcatgcctgtcatcccagcactttgggaggctgaggcaggcggatcacgaggtcaagagatcgagaccgtcctggccaacacggtgaaactctttctctactaaaaacacaaaaatcagctgagtgtggtggtgcgtgcctgtggtcccagctactcgggaggctgaggcaggagaatcgcttgaacctgggaaacagaggttgcagtaagctgagaccgcaccactgcacgccagcctggtgacagagtgagactccatctaaaaaaaaataataataatagaataaaaataaaaaaataaaaataaaaaatccaattccaattacaacaattacaatagcagtaaattaaaaaaaaattcttgggaacaagattaacaaaagaagaatagcacctgtacactaaaaactataaaacactgttaaaagttttgaggccaggggcagtgactcgtgcctgtaatcccagcactttagggggctgaggggggggcagatcacttgaggtcaggagttcgagaccagcctggccaacatggtgaaaccctgtctctacaaaaatataaaaattagccaggtgtgttggcatgcacccatattcctagctaatcaggaggctgaggcacgagaatcacttgaacccaagagggggaagttgcagtgagccgagatgaagccgctgccctcaagcctaggcgacagagtgagactcagtctcattaaaacaaacaaacaaaacaacaacaacaaacactgttaaaagttttggttaaagatcaaaataggtcgggcatggtcactcatccctgtaatcttagcaatttgggaggcctaggtgagtgaatcacctgaggtcaggagttcaagatcagcttgaccaacatgatgaaaccctgtctctacaaaactacaaaaaattagccgggcatggtggtgtgggcctgtagccccatctgtttgggaggctgaggcaggagaatcacctgaacctgggaggtggaggttgcagtgagccaagatcaggccactgcactccagtctgggtgagagagcgattctctgtgtcaaaaaaaaaaaaaaaaaagtcaaaataaatggaaagacatcccatattcacagatatggtgatgaccaaatactgttaagacagcaaaacttggccaggtgctgtagctcacgtctgtaatcccagcggtttgggaggccgaggcggatggatcacttgaggtccggagttcgagaccagcctggccaacatggcaaaaccctggatctactaaaaatacaaaaagtagatgggcatggtagcacatgcctgtaatccaaactactagggaggctgacagaagagaattgcttaaacccagggggcgaaggttgcagtgagctaagatggtgccactgcactccagcctgggcgacagagtgagactctgtctcaaaaaaaaaaaaaaaaaaaaagatgacaaaacttcccaaattgatctagagtctgtgaagattccagttgcattttttgcagaaatagataagctgatcctaaaaaatcacagagaaatggcaaggaatccaggaatagccaaaacaatcttgaaaaagaacaaagttgaaggaatcacactttctgatttcaggctttcttacaaaactccggtatttggccaggagcagtggctcacgcctataatcctagcactttgggaagccaagaggggaggattgcttgaggccaagagttcgagacagcctgggcaacataatgaggccttgtctttacaaaaaatttaaaaaatagctgggtgtggtggtgaatgcctatagtccagctactcgggaggctgaggaaggaggatggtttgagcctgggagaaagaggctgaagtgagctgtttgtgccactatactccaggctgggccttagagtgagaccctgtttctaaaaaataaataaataaaaaagctatagtaatcaacacagtgtttgaacagtaacaatatattattactggcataacaatagtcacggtcaataagcacaaaagtcaaataacaaattgacaaaatatatctacaatttatatcacggacaaaggcaaatctaatagataaagaactcttaaaaatcgaggatagaatttcccctgatagaaaatggggaaacacacatgaaaagacagttaaaagaaaaagataattaaatggccttcaaagatataaaaagatgcttgacagtattacttacaaaaaaaaggggaattgaaccagcctggccaacatggtgaaaccccatctctactaagaatacaaaaattagccaggcgtggtggtgcacacctgtggtcccagctactcgggaggttcgggcaggagaattgcttgaacccgggaggcagaggttgcagtgagccaagattgcgccactgcactccagcctgggagacagagcgagactccgtctcaaaaaaaaaagtaaattgaaattcctcacctattagattaataaacatataatcgtttgacaacataggacgggctgtggaaaagtaagacagactcataaatttctaggactacaaaaggatacaattcccatggaagcagaatttagcaatatttacaatattatatatacaattactatttaacccagtaattcaatttctaggaacttacccttaagatatacctccaaaatatcaaacaatgtgtggataaatttattcactgggcattatctataggagcaaatattagaacaacccttccttactagactggttagatagactatgaagtatctatataatctaatatcatacagctataaaaaataaaaacgtggatgtacacaaatgttcatagcagcattacttgtgatagccaaaagcagaaacaacccaaatgttcattaactgatgaatggataaataaaatgtggtatacatatgcacaatggaatattatttggcaaaaaagacaggaattatatatactacaacatgcatgaaacctgaaaacaatatgctaagtgaaaaaactcagtcacaaaaaaacacatattgtatgatactaaatatccaggactggttaaaaaaaaaaaattgtatttatattacatatattccacacattaaatatctaaatggacagttgcctaatggtggggaaattagggagtgattgcctagtgatgtgggtttctttctggaataataacaatgttttaaaactgattactgtacacttaatatctcaataaaggcttaggattgctctcagtccagagtcttaaagaagcagactgtctttgttgaagacttgaagaagcaagccaccaaccatgagttacacaactgcaaagaaatgagttttacctacatccatgtgagtctggaatacagccccagcctcggatggtaccttgattctggcttatgaaactcagaacagaggatccaactaagccaagactaaactggaatctgtgagataataaatggatgatatttaagctgctaaatttgtgataatttcttcaacagcaatataaaatttatacacttgtgtgtacgcacatttttttcattccatggtactgaaaggggctagaagcatggcatcatagcagtaacaaataccctagtagaaaaagcacatgaaaaattcagattttgacttctaaataataatcctcactaaaagaaaccaaagctccttgagggaaatagttgattccagatacaggccaaagaaagaacaagtctgataaacaacagcagaaaagtaaaccaaaacaaaaaactaaatcctcactactccgaacagcagaaagcagggaagtgctcaaagataagtaatctgaagacatgtataaaggaaacaggggccagtttaaaggggctcctgtggtaaaatcagggaattttgagcagtttcctataaaatgctaatagattataatatagtcaattttatgccaagcatgatagcttatgcctcctagcactttgggaggctgaggcagaaggacttcttgagcccaggagttagagtcaagcctgggcaacatagggagaccctgtctctggagaaaaacaaacaaaaccacccaaacaaaaaaaattcatgagtctataaggtattcaaaaaaacaaaacaaaacaaaacaaacagagagtttacggagaaaaaaaaagagaagctcatcttcaccagaaaatgtcagctaaaaatcaagaaataatggaattagaaaattttcttttctttctttttttttgagacggagtcttgctctgtcgcccaggctggagttcagtggcgcaatctcagctcactacaacctctgcttcctgggttcaagcgattctcctgcctcagcctcccaaatagctgggactacaggttgcatgtcaccaggcctggctaatttttgcatttttggtagagatggggtttcaccatgttggccagggtgttcttgaactcctgacctcaggtgatctgcctcctacagttctcggattacagggatgagcaaccacacccagcaaaaattgtcatttttcaaccatcaatgtaattattaaacttagggaaaaaacattaatggatgattaaatgttagattaaaaaagactgatagagaacaagccatagccttaaatatcaacccatggtttatgtaccaattacaatgggaaaaaatgtagtatctttgcaatgaaaagacttggtggataccaccttcactaagtaatcaaaaatggcaccatcaatgctgggacaataagtgggatgcaaaaagaagtataaagtatcacatatgcaatattcctgccatgatttttaaattttattaagttttatttatttttatttttgtagagactggatctcactatgttgcccaggctggtcttgaactccaggcctcaagtgatcctccagcctcagcctcccaaaatgttgagattacaggcataagccatctttcccaggcctctgccaagatttttttaaacctaaatttaatcatgaagataggatcaaagaaatccaaaatgaagggcattctaaaagacaacaaaagcctgagttcttaaaaaatggtcgatcttggccaggcgtggtggctcagacctgtaatcccagcactttgggaagctggggcgggcagatcacttgaggtcaggagtttgagaccagcctggccaatatgtgaaaccccgtctctgctaaaaatacaaaaattagccaggcgtggtggtgggcacctgtaatctcagctactcgggaggctgaggcaggagaattgcttgaactccatctcaaaaaaaaaaaagttcgtattattttctctttctttttctgagacagggtttcaaaaaaaacgctttgtcacttaggctggaatgtaatgtcatgaacacaactcactgcagcctcggacccctggactcaagtgatctgctcacttcagtctcacaagcagctgggactacagctgtgcgccaccacacctgctggatttttattttatttacttatttatttctgagacagagttttgctctgtcacccaggctggagtgcaatggtgcgatctcggctcactgcaacctctgcctccggaggtcaaaggattcttctgcctcagcctcccaaggagctgggattacaggtgcctgccactgcgcccagctaatttttgtatttttagcagagacagggttgtgtcatgttggcctgactggtcttgaactcctgacctcaagtagtctgcctgccttgccttccaaagtggcctcaagcaatcctccagctccagccgcctaaagtgctgggattacaggcgtgagcaatcgcacctggcctttatttttattctgttgtatgatattacaacagtagatacatgtcagtatacatttgtcgaaacccatagaatgtatatcaccaagaatgatatacaggattacaggcctgagccactgcgtctggcctgaattcttaaatttttagtagagacaaggtcttgctatgttgcccaggttggtcttgaactcctgggctcaagcaatcctccagctccagcggcctaaagtgctgggattacaggcgtgagcaatcgcacctggcccctttatttttattctattgtatgatattacaatagtagatacatgtcagtatacatttgtcaaaacccatagaatgtatttcaccaagagtgaaccctaaagtaactacggactttgggtaataatggtatatcaatgtaggtacatggatcataacacatgtatcacaatggtgtggtgtaacagtgggcaggttgtgtgtatgaagaacagggtgtatatgaaaactctgtactttccactcaattttgctgtgaaactgaaactgctctaaacataagtttattaatgaaactgctaacaacaaaatagccagcccacaataatatcctggcttcacatctttcaagaatgcatacatgtactaaactgatcaatgttcttaaaaatgcttaaagaataaaccattttcttcctacttatttttgggagaggaagagctagttctaacatacataaagtgatatttcagtccattttcaggtcaaatcttttgtatgaccagagacacttacaaatcactgatacggttgtataatttgatgtgaaatcaaattacatcaaaagatcagaatcttccatttttaaatctttaatcaagaaaaagcacaaaagtaaaaaacagaagtgtggtcttatgatatatataaatataaatatgaatataaataaataaataaatatatatatatatatatatatatatatatatgttttcatccatggttcctggctcttaactcccatagtccctgttataatgttggggcactttaagtctcaggagtgggcctcaggagatagaatctctctttgaccttctcctgtcttcctttcacctacctaaggcaggactctaatctgattctgggccaagaaaaccctcactccagagagggtcctgccccataccctagagaaaggaatgtgacacagagaggccaagaagtctagacaggacatgctgggtttacatcctctacattttgttcaatcacatttctacatggctgtcattgacgcctatgaagcttccataaaaactcaaaaagaggccgggcgctgtggctcactcctgtaatcccagcactttgggaggctgaggtgggcggactgcctgagctcaggatttcgcaaccagactgggcaacatggtgaaaccccgtctctactaaaatacaaaaaattggctgggcatggcggtgtgtgcctgtagtcccagctactcaggaggctgaggtaggagaactgcttgaacccaggaggtggaggttgcagtgagccaagatcttgccactgcaccccagcttgggcaacagagcacgactccgtctcaaaaaaaaaaaaaaaaatttagctgggtgtggtgacaggtgcctgtaatcccagctactctggaggctgaggcaggagaatcacttgaacctaggaggcagagcctgcagtgagccaagatcataccattgcactccagcctggttgacaagagcgaaaccccatctcaaaaaaacaaacaaaaccacaaaaaacaaaactcaaaaagaaaggttcagagagtttctggatagctgaacatgtggaggttcctggagggtagtgcgcccaaggagggaatgaaagctctatgctccttccccagtatatgtcttcatctatagcgtctgtaatatcctttataacaaaccagtaaatggaagtacatgtttccttgagttttgtgagccattctagcaaattaatcaaacccaaaggggggattgtggaaaccccaacttgaagctggttggtcagaagttctagagagccagagttgtgactggtctaaagggagggtggcggtcttgggaactgagcacccaacctataggatctgaccctatatccaggaaaacagtgacagaattgaattgaggacacccagctgctgcctattgcttggtgtatgggaaaaccctcatacctttggttacagaagtcttctgtgtgttttttttttttttaattttattgaaaaaaatggttttttttaaaccagcagtttgctcttacagacttctttgttgatgattattgtgatgtgacagcagaggaaaaacacagtctgagaggttctccctaagcaagaaataaaacttgaattttatttagcagaaaagttgataattatatttctgctctatttagcagactctgttccaaaattatgactgaattagatgtgtcccaaagtgtatttctactttctcatttctactgacagaatgttgattttttttttccttaacagctattaacacctagagtaatgaccattatttccgcaacctgtcttatggctaaagtgtggctatgcaatttaaattctagccaatttatataaatgcgggtttgaaattttcttacaaagaaggagcatgggccaggcatggtggctcacgcctgtaatcctagcactctgggaggcagaggagggcggatcacctgaggtcaggaattcaagaccagtctggccaacatggtgaaagcccatctctactaaaattacaaacaattagctgggcacggtggtgggtgcctgtaatcccagctacttgggaggctgaggcaggagaatcgcttgaacccagaaggcagaggttgcagtgagccgagatcgtgccattgcactccagcctgggcaacaagagtgaaactccatcgcaacaaacaaacaaaccagaaaacaaaaaacaaagaaggagcatgcttttcctcctcttttctgtctgtaacaaacatcaaatggctggactctagtaactatcttggaacatgagggaatcttaggaatgcataattagtgctgagatagaagggagaaaaaggagcctaggtccctgaagacattgtgaaggtaccattatgaactttgaactacatacttcacaacttctcttaaattaaaaaaaatagttaagtgcctatctttttaaagtcttggttatttgagatgatttattattataattagctaaacttaagcttcattagtaaaatgttttcatgacctaagaagcacgttcagagtataaaaattttgtgatatctacctcagtgacaaatcaataaaaatcttttaaatgcaaaataaagtggtatggtttacatgtcaattactttaacaccaccaaacgagatgtacctctaaaatctaaggtttcctctttcaatcttattcttctctttgtctaaattcagatattcatgactttttgacagaaactgtgaggtgagagtttttgccactagtaattcattccatttattttccaccctgctgctggagttatcttaaacaaacctatacctttcacatccatcccccaaactcattttttatttcctatagcaaaatagcattaaaaaaatttcttttttttttgagatggagtttcgctcttgctgcccaggctggagtcaatggctcgatctcggctcactgcaacctccgcctcccaggttcaagcgattctcctgcctcagcctcccaagtagctgggattacaggcatgtgccaccacactcggctaattttgtatttttagtagaaacggggtttctccatgttggtcaggctggtctcaaactcccaacctcaggtgatccacccgccctggcctcccaaagtgttgggattataggtgtgagccaccactcccatccaaaaccaaatatcttaaagttaactaaatatctcaaagtccatggttatatgttcctcatcatataatgcttatttaccacagggccactacatttcagaagccctaaactttcaagttgttttgatatatgaaaaatctttgtatcctttttacatgctgttctgactggaatatccttctccatctggtaaactactaccacacctctaaatcctaactcaaccagaaaatatttcttaattgatgataatttgctatccctttgatgctttaaaaattctcaattagagtgcttattaaattgtactctgccaagataatacaaagttcttaaaagcaaggcaaatattttattcatctgacaaagctcatggaacacagcgtccaatcagtgaaaaatgaagtcaccaatataaaaaatgaagtcaccaatatcattttagttacacagagccatttattgcttaagttaataagaaaagcatcattagggccaggcacggtggttcacgcctgtaatcccagcactttgggaggccgaggcaggtggatcacgaggtcaggagatctagaccatcctggctaacatggtgaaaccccgtctctactaaaaatacacaaaattagctgggcgtggtggcgggccctgtactcccagctactcgggaggctgaggtaggagaatggcgtgaaccccggaggcagagtttgcagtgagccaagatcgcaccactgcactccagcctgggtgacagggcgagactccgtctcaaaaaaaaaaaaaaaaacaaaaaaagaaaagaaaagcatcattagaatctcaatctagaaaggcagagagaagataaccatcagaaagacaattagtctcatacaacataagacagtacagtagtacagtgaacactggtatttgtgcatattacttttgtactgatttccccccacatcagaaagggtaatgtattgaccttgacacaaagtttgagggaggcgtacctcatacatgagtgcaaaaacacaatcatcacgcttatgaaacacaaaagaatctatattgttttttgatagtcaaagtatttttccaaatgtggaagaaaaagggatgttagctaataggtactactacttactctgtagttttgtaaacgtcagaatacagccctgctttctgatacttcttctttgggggacgtgggggcttcttttcccttgggatgagagaaagcacaggctgcaaggtactttcaggttcagaaggtttagctggggtttcagaaggactgggaatctcaactggtgcttcattaaagctagaaagagaagtttaaagataattttattatgaaaaaaaagttttcctacaaataattgtctacttaaaaaaaaaaaaccatagcaattaaaaaaagagatatggggacttccttatctggccatgtttaaataactggtaccagacttctcctgacaagaagtaatagaaatatggtagtctactagatacttagagaaaattttattttattttattttttgagtcggaatctttctctgtcacccaggctggagtgcaggggcacaatcttggctcaaggcaacctccgctttctgggttcaagcaattctcctgcctcagcctcccgagtagctgatattacaggggcacgccaccagttttgtatttttagtagagacgggttttgccatgttggctaggctggtcttcaactcttgacctcaagtaatccacctgccttggcctcccaagtgctgggattataggcatgagccaccgtgcccggcatgagaaaattttaaaagacaattattatcagatactggacaacagttaatgcagcactgttatccctgagaaatctgaaaaaaatgcggtgagtcacacaaccaccttgcctttcttttatctttttttgtttattgagatggagtctcgctctgttgcccaggctggagtgcagtggcatgatctcatctcactgcaacttctgcttcctgggttgaagcgattctcctgcctcagcctcctgaatagctgggattacaggcgcctgtaaccacatctggataatttttgtatttttagtagagacggtttttagtttcaccatgttggccaggctggtctcaaactcctaacatcaggtaatccgcccacccaaagtgctgggattacaggcatgagccactgtgcccagccccaccttgcctttcctttccttccttttcttcctttccttccttccctcccacccaccttccctccttccttcctttctttttcttttctttccttttcttttttttttttcttttttgagacggagacttgctctgtctcccaggctggagtgcagtggtgtgatctcggctcactgcaacctccgcctcctgggttcaagagattctcctacctcagcctcctgagtagctgggattccaggcatgtgccaccacacccagcttattttttttgtatttttagtacagacagggtttcaccatgctgtccaggatggtcttgaactcctgatctcaggtgatctgcccacctcagcttcccaaagggttgggattacaggcgtgagccatcacgcccagcctccaccttgcctttctaagaatgactgtggtgcagaagtagaaaccaagcagagaatggccaaactgatgagctgaaaagggatatatcagagtacagagggactgagatagctggaatttgtggaaatgagtatcagaatggaaaaacctatggagaattataactctagaaatctaactatgggtgtctcttttagtatactgctaaacactacgttgtgcatgtgaagggtgaaattccatatggctgaacaaggaactaccagaaaactgtaacctgagcaattcacacaactcacacatgatggcagatactcattccattaggcaaagtagaaagacattgttcaacaataggggacattaaacagcaagcccagagggtaatgttatccactgttagagggcttaattatcctgaaaggaagactagccttcactggtggggcgcagtggctcacgcctgtaatcccagcactttgggaggctgagacaggcggatcacctgaggtcgggagttcaagaccagcctgaccaacatggagaaaccccgtctctactaaaaatacaaaattaggcgggtgtggtggtgcaagcccgtagtcccagctactcgggaggctgatgcaggggaatcgcttgaacctgggaggcggaggttgtggtgagcccagatagcgccattgcactccagcctgggtgacaagagcaaaactccgtctcaaaaaaaaaaaaaagactagccttagctaagtttaaaaacaatatgagaatccaaactgatccataagtaacttaactgcctaccaaaataaaattgaatatttgtaaaggaaaccaacaaaaaccagacatacaataatgcgacatcacaatgtcttgcatccaataataaattcctacatatgccaaaatgcaggaaaatgtgacccaggggaaaaaatcattcagtagaaacagcaacagaaatagaaatcacaaagatagaaaagaaaataactttaaaatactactctacaagcataaatcaggaatttagaagaaaatacaaagataatgaggagaggaagagaagacttaacaacaacaacaaaaggaatattgagaattgataaatacgaaatctgaaatgaaaaactggagagtacttaacagcaaataaggcactggagatcagtgaacttgaagacagcaatagaaacaacacaaactgatagagattaaagaaaagaataaattatgtaaagaatataatactaacagaatcttagaatcccgggaaaggagaaaacttactactaaaacaattggacacttgtaaaggaaaacaacaaaaaccagatatacaatgatgtaacattcacaaaataaaaaattcacaatgaaaaaaattgagaattatggctaaaaagtttcccaaaatgataaaaagcataacctcagagttagaagaaagtaagcaaaccataggcaggataaataaaacaaggtccagtatatcgtaataaacttgttaaaaactactgatgaagaaaacaaaagaagctaaagaggctgggcgcagtggctcacgcctgtaatcccagcactttgggaggccgaggtgggtggatcacgaggtcaggagattgtgaccatcctggctaacacggcgaaaccccgactctactaaaaataaaaaagaaattagccaggcgtggtggtgggtgcctgtagtcccagctactcgggaggctgaggcaggagaatggtgtgaacccgagagcttgcagtgagctgagatcgcaccactgcactccagcctgggagggcaaataaataaataaattaattaattaaacaaaaaagcagcagctaaagagaaaacacacgttataaaaaggggccgagcacagtggctcatgcctgtaatcccagcactttgtgtggctgacgcaggaggattgcttgagcccaggagttcaagaccagcctgggcaacatagcaagacccatttcttaaaaaaataataataataaaaaagtttagatctcatatccaaaacagtgcaaaccagaagacaatgtaatgacatcaaacagtgttaaaaggagaggcaaaggggaagcttatcaaaatagaaatcaaaataaaacaaaaacattaaaaaaaaaaaaagatgtgcttgattcagcagcacatatactaaaattggaacaatacagagatgagcatggccctggtgcaagaatgatatgcaaacttgtgaagtgttccatatttttaaacaaagcattttacttaaaaaataatacaggtgattcttgttccacacaaaaatcgaacagatgcacatctacctctcattttactaagtacaactaaaaactctggaaattgtctataaaataaacataagcaaatgtactggcaatgaccaggcaggaagtttcccagatatttgatttgcctcatatgtacaggttaaattgcataaagtttccctattattaaggacaaggcaaacatatgctttcatcatatatgttcagtatcataacagaggtcctagccagtgcaaaaaggccagaaaaagaaaacaatattgaaaaggaagaattacaaactatctctactcacacattgtgtgattgtctatataaaaacacccaaagactctacaaaagagaaagtactacaattagtgaaatacacaacaatgttgcagaatccaaggtcaaattcaactgtatttgtatgttctatcaatgagaaaactgaaatcaaaattaaacaatgctacttaaacagtagaatagtagccaggcagggtgactcactcctataatcccaacactgtgggaggatgaggcgggcggaccacctaaggtcaggagtttgagaccagcctggtgaacatggtgaaaccccgtctctacttaaaatacaaaatacaaaaattagctgggtgtggtggcacacacctgtagtcccagcttctcaggaagctgaggcaggagaatcgcttgaacccaggaggtggaggttgaattgagccaaaatggttccatcttggctgggcaacagaatgagactccatctcaaaaaaaaacactccagcctgggcaacagaatgagactccatctcaaaaaaaaaaaaaaacaaaaacaaaaaaacaagaaaagcattaaatgcttagatataaatcaaacaaaataatacagaaatataatttctttataaatgtataaatataataaagtacaaatttaaaagaaaaccaaaatataaatctaacaaatacatgcagtacataagagtataaacaaaacaatgaatttaaaaaaaaaaaggccaggtgtggtggctcatgcctgtaatcccagcactttgggaggccgaagtaggtggatcacttgaggtcaggagtttgagaccagcctggccaacatggtgaaactccatctctactaaaatataaaaattagccaggcatggtgccaggcacctgtaacctcagctactcgggaggctgaggcaggagaatcacttgagcccgggaggtggaggttgcagtgagccaagatcgcactactgcactttagcctaggtgacagagcaaggctccattaaaaaaaaaaaaaaaatcaaagataacctaaaataaatgcagtaacataccatgtccatggatgtccatggaattaaacactgaatgtcattaagatggcaatttctgtccaggcttggcagctttcacctgtaatcccagcactttgggaggctgaggcaggaggatcacttgagcccagaggttggagaccaaccgaggcaacatagtcagaccccatctttgcaaaaaattttaaaaaactagccaggtgtgatggcttacacttgtagtcccagctactgaagaggctaaagtgggaagactgcttaaacctaggaggtcaaggctgacagtaagccattgcactccagcctgggcaacagaggaagattctgtgtcttaaaaaaaaaaaaaaaaaaaaaaagttggtgattgcaactttcccccaaactgatctatagatctaacacaatctcaagtaccaacagtttttttttttttttttttttttgagaaaatgccaagataattcacaaattgctatggaaagacaaaacctaaggccaggcatggtggctcacgcctgtaattccagcactttgggaggccgaggcaggtggatcacgagatcagaagattgagaccatcctggctaacacggtgaaaccccgtctcttctaaaaatagaaaaaatagccgggcatggtggtgggtgcctgtagtcccagctactcgggaggctgaggcaggagaatggcatgaacccgggaggcagaggttgcagtgagccgagatcacgccactgcactccatcttgggcgacagagcaagactccatctcaaaaaaaaaaactaaaaaaaaattggaggatttatctaatttcaagacttactgtaaatgtattgtaatcaggacaatgtgatactagctacacaaaataaatgtagaacaacgtaatagagtgtagaaatagatacacatatgactaattttttttttgaaaaattgtggtaaaatgcatataccataatatctaccttttaaaccattttaagtggtctggacagttcagtgacatcaaagtacattcacattgttgtacaaccatcaccagtatccatccatctccacatctttttcatcctcccagacagaataactgatcctattaaagaaaaactctattccatcctccctccaacccctaataaccaatattctactttccgcctgtatgaatttgtctattccaggttcctcatactagtggaatcataaaatatatgtccacttgtgtctggcttacttcacttttattcttttttgagtcagagtctcattccgtcaaccaggctggagtgcagtggcacgatctcggctcgctgcaaccctacctcctgggttcaagcgattctcctgcctcagcctcccgagtagctgggattacagggtcacaccaccacgcccagctaattttttttttttttttttttttgagatggcatcttgctcttgtagcccaggctggagtgcaatggcatgatctcgcctcactgcaacctccgggccaccagggtctgctaatttttgtatttttagtagaagcggggtttcaccatgtttgccaggctgctcttgaactcctgacctcagatgatttacatgcctctgcctcccaaagtgggaggcatgcctgggattacaggcatgagccactgcgtccggctgctaatgattttcttaatagcatctgggaacttgtctactgcctcttggttggcagaagcttctccttttaccttgattttttctttttctttctgtttttttttttttgagactgagttttactctgccgctgaggctggagtgcagtggcgtgatctcggctcactgcagcctccacctcctgggttcaagcgatttctcctgcctcagcttcctgaagagctgagactacaggcacccgctaccacgcctggctatttttttgtgtttttaatagagacaggtttcaccatgttgaccaggctggtcttgaactactgacttcaaatgatcgcctgcctcggcctcccaaagtgctgggattacaggcgtgagccattgagctggcctttcttttttttttttttcagacggagtctcgctttgttgcccaggctggagtgcagtggtgcgatctcggctctctgtaagctctgcctcccaggctcaagcaactctccctgccttagccttccgagtagctgggattacaggtacctaccaccatgcccagctaatttttgcatttttagtagagacagtgtttcgtcatgctggccaggctgatcacaatctcctgacctcaggtgatctacccacctcggcctcccaaagtgttgggattacaggcgtgagccaccacgcctggacatgtatgcttttttaaggcaatcctgcatccacataaaaactgcattttcggccaggcatggtggctcacacctgtaatcccagcacgttgggaggccgaggcaggcagatcacgagttcaggagattgtgaccatcctggccaacatggtgaaaccccgtctctactaaaatgcaaaaaattagccgggtgcggtggtagtcccagctactcgggaggctgacgtcggggaattgctggaacccgggaggcagaggttgcagtgagccaagatcgtgccaccgcactccagcctggcgacagagcaagactctgtctcaaaaacaaaacaaaacaaaacaaaaacaaaaaaacccctgcattttcaatatgagataaaaagataccttggaaaaagtactaagttttcgcacttgctggcacagctacggtgatggctttgcaaaattccttttcttttttcaagtccttatgctagattcatttatctttcttcttttgagacggagtctcagtctctcgctcaggctgcaatgcaatggcgtgattcggcgcactgcaacctccacctcccaggttcaagcaattaacctgcctcagcctccggagtagctaggattacaggcgcccgccaccactcctaattttttgtatttttagtagagacagggtttcaccatgtcggccaggctggtctcgaactcctgaccccatgatccgcctgcctcggcctcccaaagtgctgggattataggtgcgagccaccgtgcccggcccatttatcttgaaatggtgggcaaccacagctgcagaccccaatctatggtacatatcaagcagttcaactttttgttttcttgtaatgccatgacttttctcttgttcttggaagcccttctaacatcactaatggcacttcatataggtctcatagggtcattcaaggtttatggaatcgtagtaaaaacgatgagaaataaagaacttcaagagatcactttgtactgtgatacgtaatttactggagagattccagtaaactgctcacttggagatgattagtgtcatatggctttgaagtggattctggcaacactttcttcattgcaataacaacaagaggtggctatgaaattattacagtagtacagtatgtattacagtttttttttttttgagacagagtttcgctcttgttgtccacgctggagtgagatggtgcgatctcggctcactgcaacctccgcctcctggattcaagcgattctcctgcctcagcctcccgagtacctgggattacgggcatgcgccactacgccgggctaattttgtatttttagtagagacggggtttctccatgttggtcaggttggtctccaactcccaacctcaggtgatccgcctgccttggcctcccaaagtcctggaattacaagcataaactaccatgctcggcctattacagttaattttatgattaatgctgtatgtctttgtttacatttctcataactgagaatggcgtcatgtatagtttgtgtttgtaaattttgataaattttaactttttatttgagacagagtcttgcttttttgcccaggctggagtgcaatggcatgatgttggctcactgcaaccttcgctacccagggttcaaatgattctgcctcagcctcacaagtagctgggagtatagacacccaccacctcacctggctagtttttgtgttttttttttgagacagagccttactctgtggccaggctggagtgcattggagcaacatcagctcactgcaatctccgcctcccaggttcaagttattctcctgcctcagcctcctcagtagctgtgattaaaggcatgcacaaccatgcccggctaatttttgtatttttagtagagacagggtcaccatgttggtcaggctggtctcgaactcgaactcctgacctcaagtgatccacccaccttggtctcccaaaagtgctgggattacaggcatgggccaccacgcccggcctagttttttttttttttttttgagacagagtcttcctctgtcgcccaggctggagtgcagtggcgcgatctcggatcactgcagcttctgcctcctgggttcaagtgattttcctgcctcagcctccaggtagctgggattacaggcactcaccatcatgcagggctattttttttttttttgaggtggagtctcgctctgttgcccaggctggagtgcaatggtgcgatcttggctcactgcaatctctgcctcctgggttcaagcgattctcctgcctcagactcctaagtagctgggattacaggcatgtgccaccatgcttaattttttgtatttttagtagagaccaggtttcaccatgttggtcaggctggtcttgaactcctgacctcatgatctgcctgccttggcctcccaaagtgctgggattacaggcgtgagccaccacacccggccaagcagggctaatttttttatttttagtagagaagaggtttcaccacgttggccaggctggctcgaactcctgacctcaggtgatccacccacctcagcctcccaaagtaccaggattacaggtgggagcccccatgcctggcctaattttttttgtggtgttttttttttttgagacggagtctcgctctgtcacccaggctgcagtgcagtggcgcgatctcggctcactgcaagctctgcctcctgggttcacgccattctcctgcctcagcctcccaagtagctgggactacaggcgcctgccaccatgcccggctaattttatttatttatttatttattttttaagacagggtctcactctgtcacccaggctggagtgcaatggcacgatcttggctcactgcaacctctgcctcccaggttcaagtgattctcctgcctcagcctccctagtagctgggattacaggagtgtgccatcatgcccggctaatttttttttttgtattttagtagagatggggtttcaccatgttgcccaggctggtctcgaactcctgagctcaagcaatccacctgccttggcctcccaaagtgctaggattacaggcatgagccaccgcacccagctttttgtattttttagtagagacggggtttcaccgtgttagccaggatggtctcgatctcctgacctcgtgatccgaccgcctcggcctcccaaagtgctgggattacaggcgtgagacaccgcgcctggcccattaatttttatatttttaatagagatagggtttcaccatgttggccaggatagtctcgaacttctgacctcaggtgatctgcccacatcagactcccagtgaaattttaactttttataatagatttgtgtatatcttatgtctttctgcaaacaataaaatggattaacatctacaaatattttatccgttcatgacatactttttaatttttttgactatttctaggctacacctactatgtatccacaaaaaataaaaattaaaaactaaaaaatttttttctaggctacacagttcatctgtgagtttaagtatcgcaaatctcaaatctgtgttgttcaagggtcaactgtatttaatcaactgggagttgattttttgtatagaggataagacagaatccaatttccttctgatccccagggatttcaacttactgggcacaatttgttgaacagttctttatatgcctctgttacccagcaagcttccatatatgtgtaggtctgtttcttttatctattcaattccacaccaccttaatactccatagcttgaaattaagtcttgggacaaatcctttattttattcagtaattacctttccaggtatatactctgatataattttttttttttttttttttgagacagagtctcgctctgtcacccaggctggagtgaagtggtctgatctcagctcactgcaaccttcacctccaaggttctagcaattctgctgcctcagcctcatgagtagctgggattacaggcatgcagcaccacacctggctaattttaatttttctttttttttttgagatggagtcccgctcttgttgcccaggctggagtgcagtggccagatcccggctcactgcaacctccgcctcccgggtccaagcgattgtcctgcctcaggctcctgagtagctgggactataggcgcccaccacctggctaatttttgtactttttagtagagacagggtttcgccgtgttggccaggctggtctcaaattcctgacctcaggtgatccgcccacctcggcctcccaaaatgctgggattacaggcaagagcgactgcgcccggctaatttttctatttttagtagagatgggtgttcactatgttggccaggctggtcttaaactcctgacctcaggtgatccacccacctcggcctcccaaattgctgggattacaggcacaagccactgcacccggcccctgatacagtttggatgtgcgccctgcccacatctcacgctggaatgtaatcaccaatattggtggtgagacctggtgggaggtgactggaccatgggggtggttttctcttaagcagtttagcaccatcccccgatgctgtcgttgccatagtgagtgagttctgttgagatctggtgctttaaaaagtgtatggcacttcgtccttctccttcttgctcctgctctagccctgtaaccagtatactccccatgactgtaagtttcctgaagcctccccagaagcctaggagatgccagcatcatgcttactatacagcctgcaggaccatgaacgaattaaacctcttttctttataaattacccagtctcaggtatttatagcaatgtgagaacaaattagtataatgccttaagtctgggtgcagtggctcacgcctgtaatcccagcactttgggaggccaaggcaggtggatcacctgaggtcaggagttcaagaccagcctgaccaacatggtgaaaccccgtctctactaaaagtacaaaaaaattagccgggtgtggtggtgggcgcctctaatcccagctactcgggagactgagggcaggagaattgcttgaacccaggagatggaggttgcagtaagccgagattgtgccactgcactctagcttaggcgacaacaatgaaattccgtctcaaaaaaaaaaatatatatatatatgttgggaacaggccccccaaaatctggccataaactggccccaaaactggccataaacaaaatctcttcagcactgtgacatgttcatgatggccatgacacccacgctggaaggctgtgggtttaccagaataagggcaagaaacacctggcccacccaggctggaaaaccgcttaaaggcgttcttaaaccacaaacaatagcatgagcgatctgtgccttaaggacatgctcctgctgcaggtaactggccaaacccatccctttatttcggcccatccctttgtttcccataagagatacttttagttaatcccgtttcccataagggatacttttagttaatctaatatctatagaaacaatgctaatgactggcttgctgttaataaatacgcgggtaaatctctgttcggggctctcagctctgaaggctgtgagacccgatttcccacttcacacctctatatttctgtgtgtgtgtctttaattcctctagcgccactgggttagggtctccccgaccgagctggtctcggcatatatatatatacaatgctttagagaaattagtgtccatatccaccagtggacattagaggaatattaaaagcagtttttttgggcaataacctcaagttgaaaataatccaagagtaaaatcgaagaactgtattacacacaaacaatgaaacaacacattaaaactacagcaacatgcattaacatacataatttaacatgactatgttgagcaaaaaaaggtgagacacaatagtatatgtcctctgtaattaattttgtttgtttgtttttgcttttttgagacagggtctcactctgtcaccctgggtggattgcagtgatgtgatcttggctcactgcaatctctacctcctgggctcaagtgattctcccacttggcttcctgagtagctaggactacaggcgtgtgctaccacaactggctaactttttgtattcttagtagagacgatgttgcctaggctactctcaaactcctgggttcaagcgatccacacgcctcggcttccaaaattgctgaaattacaggcatgatatggcacccaacctgtataattagatttacatgaaattcaggaagaataagctgtattgtttagagctgcacacataaatagtattttaaaaggtaaatatgtggttaccttaaaagtcagaagattggttatagcttctggcaagaaaaggggtttacaaacagggaaagtatggtcacctcctgaatatttatatgggtacgacctctacagaaaatttacttagcttatgttatgtattctcttgtttgtctcttatttgttttttaagacaggttctcgctttgtcacccaggatggaatgtggtggcacgattatggctcactgtagcctcgacctcctggacaagctcaagcaatcccttaacacctcagcctccctagtagctgggactacaggcacacatcagcacgtccagctgatttttaagtttttttttttttgagacagagtctcactctgtcgcccaggctggagcgcactgatgcgatctcagctcactgcaacctccgcctgccaggttcaagcaattctcctgcctcagcctcccgagtagctgggattacaggcatgcgccaccacacttggctgatttttaagttttttgtagagatggagtttccctatgttgcccagggtggtcttcaacccctgggctccagcaatactcctgcctctgcctcccaaaatgctgggactacaggtgtgagccacctcatctggcctgtttatgtattctctttagatgtatcctcttctgtttgcagcccatattctctttaatgagatgggaataatatttttcttgaaagtgtggtagaagttaaaattgggtctgatgctgttcttggggcaagactttaaataatagattcaatttaggcaataggagtgctcaggtaatttcttttgagtatgttttgttaaaattgtatttttctaggaacatgtccatttcaacagttttcccatttgatgggcttaaagttctcacagtagtaaatttttaatctcttatatacactttatttccttttaaatccctatttattccctttctcattcctattgatcggctttaccagaagtttgtctattttattagttttcaaagaactttggtcttaaaagtgactcttactgttatacatttgccttattttattaacttaaggtgtatgttttacattcttccaatatcattttcaggctcattcacttgttcttttaatttcttattttcataaaattgtttttagaaatagggttttgccattgcccaagctggtctcaaactcctgggttcaaccaatcctccagcctcagcctccagagtagctgagactattggtgtggccagcaagctcttaacaatttttttcggtcaggtgtggtagctcacgcctgtaatcccagcactttgggaggccaaggtgggcagacttgaggtcaggagttcgagaccaccctggcctatatggtgaaaccctgtctctactaaaaatgcaaaaattagccgggcatggtggcaggacctgtaatcccagctactccagaggctgaggcaggaaaatcgctagaacccaagaggtggaggttgcagtgagccaagccattgtactccagcctgggcaacagagcaagatgccgtctcaacaacaacaaaaatatatatatatataatatttacatataatatacattataagatacatatttttagagacaaagtcttgctataatatatatgtatttttagaggcaaggtcacactctgtcaccaaggctggagtgcagtgaaggaacacagctcattgcagcctcaacctcctgagtgcaagtgatcctcccacctcagcctcccaagtagctagaaccacagacacgagccaccacgctcatttaatttttaaatgttttgtagagatggaccaggtgcggtgctcacacctgtaatcttagcactttgggaggtcaagttgagaggatcgcttgagtgcaggagttcaaaaccagcctgggtaacatagtgagaccccatctctacaaaaaacacaaaaattagccaggcctggtggcccccgcctgcagtcccagccactgtgggggagggatgggggtggagacgcttgagcccgggaggtggaggttgcagtgaactgagattgtgccactgtagtccagcctgggggacgcagcaagaccctgtctaaaataaacaaacaaacaaacagttctttgtagaaacggtagctacaaccagccacactgctcaggctgtcttgaactcctggcctcaagtgatcctcctgcctcagcctgacaaactgctgggattacaggtgtgagccaccacacctggcctgattttattttttacagcaaaaatttataagtgttttaaaaatatacctttttctttttaaaaccaggatttgaacctaggttttccgagtctagaagcccacctcataaccattaaattcttcctgtgcattctggttttatattaatcaacaaatagtgaccaaaatctttaatatatcatacaaggttcttggcacaatctgatccctacaacctctatctgtatcccatgctactctactccatgttttgaccacaaaagctttctttcgcttgcctgaaactatcatgctttttcagacttttgtgtatgctctctcctcactcctttaaataacagatgaagcctattcttcacatttttagcatagtccttactttttctgggaaactaagttagttatttctattatatacagtactcttataactctaagtaactcttcataatagcacttggatggttaaaatccatgaaggtaggaaaagtttctagatttattcaccactctatcaattctaagtacatgaaacataataatcttccaacaaatactaattgaaaaaataaatgaatacatattatataacaagtactagtgtaagctccaattagaacaagttgaaaaactgttgctatctctgggaactcagtgtgtcatgtccttccctacacaatctcttgagggcagaaattttatctttctctttataatctcttcaaatctcagaatacaatcttgtgaaaaagtatgtgtttaattttgctgaccatgatactagaatttgctggaatagaaaggctaacctattcaaaagccttttttgtcgttgttgagacgaagtcttactctgtcatccaggttggagtgcagtggtacaatctaggctcactgcaacctctgcttccctggctcaagcgatccccccacctcagcctcccaagtagctgggaccacaggcgtgcaacaccaccacgcccagctaatttattgtattttttggtaaagacggggtttcaccatgttacccaggctgatgaaagccttttcttgaagcacattttaaagatgacccttcctaacataaatggtcaagatgtctcaaactacagtaaaggcagaaatcatcctccttgtcagtgttttaaagcttcaataattaaactgctatgacagagataccaaaatagactgatagaaaggaatataaaaatatttgacatttcaccaggcccccagcttggggcgccttccttccccatggcgggacacctggcttcggatgcctgccttcttgccccctccaggcggtggaggtgatgggccaggggggccggagccgggctgggttgatcctcggacctggctaagcttccaaggccctcctggagggccaggaatcgggccgggagttgggtcaggctctgaggtgtgggggattcccccatgccccccgctgtatgagttctgtggggggatggcgtactgtgggcctcaggttggagtgcggctagtgccccaaggcggcttggagacctctcagcctgagggcgaagcaggagtcagggtggagagcaactccgatggcacctccctggagccctgcaccgtcccccctggtgccgtgaaactggagaaggagaagctggagcaaaacccgcaggagtcccagaacatcaaagctctgcagaaagaactcgaacaatttgccaagctcctgaagcagaagaggatcaccctgggatatacacaggccgatgtggggctcaccctgggggttctatttgggaaggtgttcagccaaacgaccatctgccgctttgagggtctgcagcttagcttcaagaacatgtgtaagctgcggcccttgctgcagaagtgggtggaggaagctgacaacaatgaaaatcttcaggagacatgcaaagcagaaaccctcttgcaggctcgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggtgccagaaaggcaagcaatcaagcagcgactatgcataacgagaggattttgaggctgctgggtctcctttctcaggggtaccagtatcctttcctctggccccagggccccattttggtaccccaggctatgggagccctcacttcactgcactgtactcctcggtccctttccctgagggggaagcctttcccccgtctccgtcaccaccctgggctctcccatgcattcaaactgaggtgcctgcccttctaggaatgggggacagggggaggggaggagctagggaaagagaacctggagtttgtgccagggcttttggaattaagttcttcattcactaaggaaggaattgggaacacaaagggtgggggcaggggagtttggggcaactggttggagggaaggtgaagttcaatgatgttcttgattttaatcccacatcatgtatcacttttttcttaagcctgggacacagtaaaaaaaaaaaaaaaaaaaaaaaattgaaaagaccctaagatctaacagtatataagaatttaggatggtggggcgccgtagctcacacctgtaatcccagcacttcgggaggccgaggcgggaggatcatcaggtcaggagtttgagaccagcctgaccaatatggtaaaaacccgtctctactaaaaatacaaaaaaattagccaggcatggtggtgtggtggtgtgcgcctgtaatcccagctactcaggaggagaatcacttgaacctgggaggcagaggttgcagtgagccgagattgtgccactgtataccagcctgggcgacagagcgagactccgtctcaaaaaaaaagaaaaaaagaatttagtgctgggtgtggtgagtcatgcctgtaatcacagtactttgggaggccaaggcaggcggatcacttgaggtcaggagttcaagaccagcctggccaacatggggaaaccccgtctctactaaaaatacaaaaattagctgggcatggtggcgcatgcttgtaatcccagctacttgggtggctgaggcatgagaatcacttgaacccaggagacagaggttgcagtgagccaagattgcgccactgcattccagcctgggtgactcggtctcaaaaacaataacaacaacagcaacaacaaaaacttagtgtatgataaatgtatcattccaaataagttgggaatggctaaactaatcaatagtactgaaagaaaattaaacctctaactcatagctaatattcagtattacataagtgacataaagagctaaatataaaaaagcaagatctagtcaatcacaacagtgtaattacataaattatgatatattcctaccacagtataaggtaattctgtatgttctgatgacaagctctcagcattaaagaatacacaatgtactgttaatagcgttatccatggagagaagaatgggataagagcaagtgagagcatgtgaaaagagacttttacttttaaatcagtaaactactagtttaattaaattatttattaccagcgtgtattgctcctgaaattaaaaaatatattctctagaaaaaagcaattatttttatataggtggatggaaaaaaaaaaaaaccctctctatacaggattcaccaggagagatgatagagaatatgagtaagagtgaacatgccacattaagaaaagccatttataaatgatgaacattaaattggttcattaaaaaatattaaatatgggccaggcgtggtggctcacgcctgtaatcccagcactttgggaggctgagacgggtggatcacctgaggtcaggagttcgaggctagcatggccaacatggtgaaacctcgtctctactaaaaatacaaaaattagccaggcatggtggtgcgcacctgtaatcacagctgctcaagaggctgaagcaggagaatcacttgaaaccacgaggtggagggtgcagtgagtggagatcgtgccattgcactccaggctgggtgacagagtgaaactccatctcaaaaaataaataaataaaaataagaatggtttattgcctgtggctttgttattacatctaagaaatcacggccaaattcaatgctgtgaagcttttgccctatattttctcctaagagtttacagttttatttttatttatttatttatttattttgagacaaagtttcgctcttgttgcccaggctggagtgtgatggtgcaatctcggctcactgcaacctctccacctcccgtgttcaagggattctcctgcctcagcctcctgagtagccgggattacaggcatgtgccaccatgcccagctaattttgtatttttagtagagacggggtttctccatgttgatcaggccggtctcgaactcctgaccctcaggtgatccagctgcctcagcctcccaaagtgctgggattacaggcgtgagccaccatgcgtggactttttttttttttttttttttttgagaaggagtctcgctttgtcacccaggctggagtgcagtggcgcaatctcggctcatcacaacctccgcctcctgggttcaagcaattctcctgcctcagcctcccaagtagctgggattacaggcacacaccaccacgcctggctaatttttctatttttagtagagacggggtttcactatgttggttaggctggtcttgaactcctgacctcgtgatccgcccaccttggcctcccaaactgctagaattacaggcgtgagccaccacgcctggccaagagtttctggttttagattttacatttacatctttgatccattttgagttagattttgtatatggtttaaagtaagactacaacttcattcttttgcatgcagatacccagttttcccagcatgatttgtcaaaaagactgtcttttaccctgctgaatggttttggcacctttgtcaaaaatcatctgaccatgcatgcaaggttttatttctgggctctctattctacttcgctggtctatatgtctctctttatgctactaccatacggttttgattaccatagctttatagataaaacagacaattggacttcatagatatcagaaaattttgtacgtcaaaagacagcataaacaaagtaaaaatgcaatccacagaataggagaaaagatttgcttatatgccggttaagagaataatatccagaatatattgagaactgctaaaactcaacaacaaaccaaatagcccaatcaaaaaattgaaaaagcgattgagtagacacttctctaaagatacataaatggccaataagcgtatgaaaatatgtttgtcactaatcattagggaacagcaaattaaaactacaatgagatacccatctcatactcatttggatggctgctataaaaaaaaaattgaaaatagcaagtgttggtgaggatgtaaactgaaatccttgtgcattgtaactgaaatctttgtgcatgcaaaatggtacagcccttctggaaaacagtatggcagttcctcaaaaaattaaaaatagaaatgtcacatgatccagcaattccacttctgagaatatgcccaaggttaaagcagggtctgaaagaggtatttgtatacccgctgtcatagcggcgttacggcatggaaacaccccaggtatccatcaatggatgaatggataagcaaaatgtggtatgcacataaaatgatcacagagctcatacatctctatattggataaaatacataatctttctgggccttgatttcctttgtctgtaaagtgagtgggttcagagtggatggttacttgccctttgcttcttttgtgtttgtttttgagacagggtctcgctctgtcgcccaggttggagtgcagcggtgcaatcttggctcactgcagcctcctggattcaagcaattctccctcctcagcctcctgagtagctgggattacaggaatgcgctgccacatctagctaatttttatatttttagtagagaaagggtttaccatgttggccaggctggtcttgaactcctcacctcaagtgatccatccacctcggcctcccaaagtgctgggattacaggtgtgagccactgcacctagcctctctgattcttaattataacttgtaaaagcaatacataagaacagtttttgaaaagaaatggtctcatatagtaaaaaatgaaaggttataagatgaaataattcagctatagagttacattacagtttttcaaagctagtttcctctactcagataatatgttaaatgaggaattaccttttattattctcttgctcttcttcctctggtaatggcttctgcttttttctggtctgttcttccaatagccaaccttttctcttcaacccctttttatgttctgggttcagatttacactctgaacaacagcctcaattacatctgtaactgtgtcaggactgaggtgcagtgctgctccttcctcgtctctgttcaattctgggttgacaaactgagcagcctggaatgcttgcattgatacgacagcctgaaggggacatttccgaggtcgacctggcctacgtttcacaaagttattccctgtcctggcctgcctttgaagttttttggcttttaagattttattgacatggtctaggtttttctttgtggccaagattttgtcgtaattgcacattttccgagcttggcgttgcatagcttccactacacttctcttgatatgatggggggaacagctgcttgtcaacttttcagataggagtgagatgctattattgcaagagtcacttgtgactgcaggcactaaaaggctgtctggttttcccagggttcggtccttgctgtggctacggcctggactggaagaaggtggtgcagaggcagttgcaatcacagcatcaatacttttctccatgggctcttggtcctcattttgtaccatccgctgcagcagactatccacagagtcatccccagaagcaactaatcttggacttcgagagggaactccgtttactgaaagagacaataaatcacacatagacaaaattggacacggctagttatttaaataagtttttacacagataaaagggagtactactctattttccatagcaagattacacatcataggtaaattgatggtttactttcctgaaaaaggttattacaacaagataaaaccaaagttggcctatatttctctaataatatgtaaatttaaaaagaacaactctcactttgaggtaaggattagaaagaaaaaaatttaattcttcaaaaatgaaggtcaaaaataaaaaataaataaaaaataaattaaggtccagttaagctaagggacttaaatgttggataaagagtgggcacagtggctcatgtctgtaatcccagtattctgggaggccaaggcaggaggaatgcctgagctaaggaattcgagatcaacctaaggaacatagcaagaagatgtctctacaaacaatataaaaaaattagccaggcatgctggctgaaacctatggtcacagctatttatgaggctaagttgggaagactgcttgagcctgggaggtcgaggctgcagtgagtcactgcactctaatcaggacgacagagcgagaccctgtctcaaaaaatactaataatttaaaaatcagttcaaaataagtcacttcccatgctgcctagtttactactattattcatgggtcatacttctccaaagttaattaatggatttcttatctatatgacttttaaatgtgataactatactagatattcctttattagcctcaggcattctagattccaatatcatcagactgtggaatttttctcaaattaccaataactttcttcaaataatatccaatagccttgtctaaatttttaagacttttttttttattttatcatcaactctggcctatagacccttgtctcaatttgatatttaaacattttcaggccaggaacggtggctcacactggtactctcagcattttgggaggccgaggtggaaggatcacttgatgccaggagttcgagactagcctgggcaacgtactgagaccctgtctcaacaaaaaataaaaattagcccagtgtggtttcctgtacccgtagtcctatctactcaggaggctgaggcgggtggattgtttgagccatggagtttgaggctgcagtgagctatgatcacgccactgcattccagcctggatgacagagcaagaccctgtctctagaaaaataataaaatttaaaaaaaggaaaaaatttcaaactctcagctatatttgatttcataattctttaaaatcctgcctacactatttctataatatcctttgattaactttcaattacttgcaactccattaaatttaactgcggaggtcctcaatacagagtacttgttatttaccttttatacttactttcccactgggaacatgtttattctcatagtctcaattatcatcagtatgtaagtgacttctaaatattcataccaatcttcagttttatctgaaaattaccaaaacgaaaaatgaccccttccttttctccaacctttaaatgctatagtttttaaaaactttctagcctgagcttttttcctgtctgactctctattctctctttagcaattcttttaactatcatctatattctgatgactactgaatttctattttctgaatagacctttcttctaattgtctacttttgcatgtttcacagatttctcaaactcatattcacatctcatttcattttcgctcccttcaaactagctcctccatccagattccctacatcagtgaatgataccataaagctaacattatgtatactgaccatccatcgtgtggcaggacgttggttatctaagctcaggccacatcatttattctggctccttcaccctccccacaaatcataaaattctgtcttctgttagtttaaactcttgaacctgtccactttcctttcttctactacagccatcaagactaagataatgttatctccctgccctgaagcaatagtgtaattccttgtggggctattaaaatacgtacattaatctcttgaagtttccctatcaagttgtagtctagtccctctctgctgccactgaagacttgccttagcaaagaaattcaatagaagaatgtgatgatttccaatgttaggttagaaaaggtctgtctctctctctatctccaccccccactcccaccccggccccgccacaagcccttggattcaagcttccaagctgcaaggaagcccaagcaatgagttggcatactggccaacagatcctgctgaggtcacagccaacaaccagtatcaaccaccagatatttgaataaagaatccttttttttttttttttttttttttttgagacggagtcttgctctgtcacccaggctggagtgcagtggcatgaacttggctcactgcaagctccacctcctgggttcacagcattctcctgcctcagcctcctgagcagctgggactacagacgcccagcatcacacctggctaatttatttttgtattttttagtagagacggggtttcaccatgttagccaggatggtcttgatctcctgacctcatgatctgcccgcctcggcctcccaaagtgctggaattacaggtgtgagccactgcgcctggcctttttttttttttttttggagacagggtctcactatgttaaccaggttggagtgcagtggcacaatctcagctcaccgcaaccgccacctcccaggctcaagcgaccctcccacctcagcctcctgagtagctgggactacaggcatgcaccaacatgcccagctacttttttgtattttttgtagagatggagttttgccatgttgcctaggctggtctcaaactcctgagctcaaatgatctgaccacctcagcttcccaaagtgttgggattataggtatgagccgcctgcctgaccaaacaaggaatattttgagatgactttacctcaccaccatgtagttacaaccaaaggaagggaatcctgagaaactgtgagatgataactgattattactgtttcatgacagtaagttcaaggtgctttgttatgcagcaatggacaactgaaacattgttcttcctgcttctactttcaccatcctccaactcattctttagacagcagcctgagtgatctttaaaaaaaaaacacaaaggcccggcaaggtggcttacgcctgtaatcccagcactttgggaggctgaggtgggcggatcaggtcaggagtttgaaaccagcctggccaacatggtgaagccccgtctctactaaaaatacaaaaattagccgggtgtggtcgcaggcgcctttaatcccagctacttgtgaggctgaggcaggagaattgcttgaacctgggaggcagaggttgcagtgagccgagatcacgccactgccctccagcctgggcgacaagagcaagactccatctcaaaaaaaaaaaaaaaaaaaatcaaaaaaaaaaaacctcacaaattttatcaggtttcagcttctgcttacaactcttaaaaaggctcttaccacataaaacaacttcaaaattattattaccttttcttctagcatcaatctcatattatcttagaccctaattctagtaataataaacttcagttccttaaactcatcatgttttttcttgattcaaggcctttgagtctgcctttctctctacctggaacaatctttctccacaaattcatctgcttaatgactattcattctttagtttacagtgaggacataatttcctgaaaggttatttacctgaccaggaagcaccctcttcattcttaatttaggtcccctattaagaattatcctaatactttctcctttcctaacactaatcacacttcaaattagtggtttaatgtatgtaattctcaaacaatgtttggtccattaacgcggtgactatattcaccaaaatcactttttatctccaatgaccaggacataattcattaacacgtagttgaagaatgaatcctgggatcaaaatcttggaattatttttatctcctctatcccttcatcaactactcagagctaccaatgcatttaatccatgaatatcagtttaaaagagaatcctaaaatgggtacacacttttgaagcctccttcctgggccattcacctagagctattaatacctcacacttcatttttgaattgttcctatcttcacaaattctggcctgccaatttatgtttcttggtagtctaggacatgatgctgcacactatattttagatgtaacttattttcaaaattaacttcactgtggtaaagtaccacataaaattcaatgcatgttttttatatatacatttttgagttttgaaaaatttaccatgtagccatcatcataaccaatatatagaacatttctgtcaccctaaaaagttactgtgtgtcctttccaagaaaataaattgcctgtcatccacagcctcagagaagaaacaactgatctgcttcctgttatatattaagtttgcttttctagaagttcatatacatgaaaagaaagaatatgtattttattgtacggcttcattcacacagcataaatctgagaatcattcacattgccacatttctttttactgttcctttttactattcacatatttctttttacaactgaattatatgaatataccacaatttctttacatattcacctggaaatctgcgttgtttccagtttttagtcataaagaaaaaatatcctatgaacatgtgtgcacatgacattttgtttaaacatattttcatttctcttgggtgaatacctaagactggaattactaaatcttttttttttttttttttttttgcgacggagtctcgctctgtcactcaggctggagggcagtggcgtgatcttggctcactgcaacctctgcctcccgggttcaagtgattctcctgcctcagcctcccgagtagctgggactacaggcacctgccaccatgcctggctaatttttgtttttagtagagatagaatttcaccatgttggccaggctggtctcgaattcctgacctcaaatgatccacctgccttggcctcccaaagtcctgggattacaggtgtgagccactgcaacctgcctagaattactaaatcaactaattgtatgtttaagaaatttttacaaagtgattgttctattttatagtcccatcatcaatgactgagttaaagatcctatacatcctcaccaagacttggtattatgcagtcttttacattttaatcattctaatgggtgtgttctcatttataaatttaatttgcatttccctgatgttgagcatattttcatgagcttattggcaattcatatgcattcttttgagaaaattctattcagatcttttgccgattatttttattgggttcttttattttttggcttacattttcattttcttaaataatgttttctgtttgtttgttttctgagatgaagtctcgctttatcacccaggccggagtacagtggtgcaatcttggctcactgcaacctccacctcccggggttcacgggattcctgtgcctcagcctcctgaggagctgagattacaggtgcctgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccaagtcaaatttttttaaatggtccttgctttttatactatttaagaaatctttgaccatcccccaaggtcttaaagattttttcctattcttctaaaagttttattatttccgaaatttcataggggtatatgatcttttttgatttaaatttttcatgtggtatgaaacagggtcagtgatctttttattccataaggatatccagtagttacagcaccatttgttgaaaagactatccttgtcccattgaaatagtcacatttgtcaaaaatcaattgaaagttagcggagtttcactcttgttgcccaggctggagtgcaatagcgtgatcactgctcactgcaacctccacctcccaggttcaagcaattctcctgcctcagcctcccgagtagctgggattacatgcacccaccaccatgcccagctaatgttttgtatttttagtagagatggggttttgccatgttggccaggctggtctcgaactcctgacctcaggtgatctgcccacctcagcattccaaagtgctgagattacaggggtgagccactacacctggtctaaatttcatttttaataattaaaaaaaaataagccacgaagtgtctgtcgcccaggctggtctttaacttctgggctcaagtgatcttcctgcagtggcctccgaaagtgctgcgattatgtgtgagccaccacggctggcctctatgtaaattttagaatcagtctgccagtttatattaaaatcctgttgcaactgtattgagtccactgactctacagagtgatctggagaaaggtgacatctcaacaataatgagtctttcaaaaatgcctctgacatatctctcccacttattcttcaatttttctcaaaaagactttgtatttttttaattttttgtgatttaattttaattttagtgagtacatagattgtgtgtgtgtgtgtttgtgtgtgtgtacattttttattttttattttttccctaagggacaaggtctcactgttacccacactggtctgaatctcctggccccaaatgatcttcctgcctcattcccccatgttgctaggactacaggcatgaaccactgggcctacactgtactttttttttttttttttttggtatttttagtagagacggggtttcaccatgttggccaggctggtctcgaactcctgacctcaaatgatccatctgcctcggcctcccaaactgctgggattacaggcgtgagccaccgcacccggccactgtactttttattatacagatcccgtacatgtttttctaaatttatcgttaagactttaatggcttttaatacaactgtaaatagtattatttatatttcaattaattaattaaattttttttttttttttttgagacaaggtcttgctctcatccaagctggagtgcagtggcatgatcttggttcactgcaacctccacctcccgggttcaagcaattctcatgtctcagcctcccgagtagctgagactacaggtgtgcggcaccacgcccggctaatttttgtaatttttgcagagatggggtttcaccatgttgcctagactggtctggaacttctgggctcaagcgatccacacacttctgtctcccaaagtgctggtattacaggtgtgagccaccatgcctggctacatttcagtttcttttttttttttttctttttttttttttgagacggagtctcgctctgtcgcctaggctggactgcagtggcgcgatctcggctcactgcaagctccgcctcctgggttcacaccattctcctgcctcagcctccccagcagctgggacttcaggcgcccgccaccgcgcccggctaattttttttgtatttttagtagagacggggtttcatcgtgatcctgacctcgtgatccgcccgcttcggcctctcaaagtgctgggattacaggcgtgagccaccgcgcccggcgctacatttcagtttctaattgttcactgtatgtagaaatacaattatttctatatgttgagcttaaacacacagaaattgtactgttaaactcatttattaagttccagcaactttttaacaaattccttgggaattttctgcaaattgtattatttctgaataagacattaagacttccctataatgctgaatagaagtagtggacatctataccttttccccaatcttagggaggaagctttcagtctttcaacattaagtgttaggttagctgtaggtttttctgcaaacaccctgtaatgggttgagcaaatactattctagtcttattttctaagagcttttttttaaaaaccatgaatggatgtcaaattttgtcaaatatgttcccttaatctacttagacaattaggtgatttttctcatgtattgtttttcttaaaaaatattaatttattaattgatttgagactgggttatgagactggctaatttttatatttttggtagagacggggtttcatgtgttgctcaaggctggtctcgaactcctgagctcaggcaatccgcatgcctcaggctcccaaagtgacaggattacaggagtgaaccaccacactcagccttgttactgcctgtcttttgggtataaaccattttacctggggtgagatgatatctcattgtagttttgatttgcattcctctgataatcaatgatgttgaatacctatgcctgttgccatttgtagcatcttcttttgagaaatatctcttcagtcttttgtccattttttaaacagattattagacttttacctatagagtggtttgaatttacatattctggttatgaacactttgtcagatgtgtagtttgcaaatattttctcccattctgtgggttgtctcttcactttattgattgtatactttgctgtgcagaagcttttttacttgatttgatcacatttatccatatttgtttggctgcctgtgcctgtggggtattgctcataaatttttgttcagatcaatatccgggagagttttcccaatgttctcttatagtagtttcatacttttgagatcttagatttaagcctttcatccattttgatttcagtttttgtatgtgctgagagacaggggtcaagtttttcttttgcatatgaatatccagtattcccagcactatttattgaagagactttatgctcttgggacctttgtcaaaaataagttcactgtaggtgtgtggatttgtttctgggttctctctcctgttccactggtctatgtgtctatttttatgctagtaccatgctgttttggttatcatagctctgtagcataactgaagtcaggtaaagttatttctccctttcagcttagaaatagctttggctattctgggttaatttttatttttcttttcgttttgttgttgttgttgttgttgttgtattgagatgggtcttgccaaggtgctcagactagcctcaacctccttggcttaagtagtcttttccctgcctcagtcacgcaggtagctaagacttcaggcacaggggtgccacaccacccaactttcactttcttcttttttgagacggagacttgctccgtcacccaggctggagtgcaatggtgcgatctcagctcactgcaacctctgcctcccagttcaagcaattctcctgcctcagactcctaagtagctgggattacaggtgcgcgtgaccacgcccagctaatttttgtatttttttagtagagactgggtttcaccatgttggtcaggctggtctcaaactcctgacctggtcatctgcccgcctcggcctcccaaagtgctgggattacaggcgtgagcaactgcgcccagcccactatcttctttctaatgcaggttttacttgctcttcttttttcagcttcctaaaggtgagaactgacttagatagatctttggtgtttaataatctcagctataaatattcttagattatcccacaaatttctatgtgtgtgtgtgtttttttttttaaacggagtctcgctttgttgccaggctggagtgcagtagcacgatctcgtctcactgcaacctccacctcccgaggtcaagtgattctcctgcctcagcctcccaagcagccgggactacaggcatgtgccaccacgcccagctaatttttttgtatttttagcagagatagggtttcaccatgttggccaggatggtctcgatctcttgacctcatgatccactcgccttggcctcccaaagtgctgggattacaggcgtgagccaccacgcccggccctatgtgtctttcatttttattcatttcaaagtattttctgatttcatttttggggattcatcttttacttatgaattatttagaagtgtgttatttaatttccacatatttagagaatttcataacttgtgttactgaattctaatttaattctgttgtggtctgaaaatatattctgcatgagtttaatcttttaaaacgtatcaagacatttgattacccagaataggatggtatcttggtataattccacacgcacttcaaaagaatatgagaaaaatgtggttgtttttttttttttttgagacagagtctcgctctatcacccaggctgcagtgcagtggcacgatctcggctcactgccagctctgcctcccaggttcacgccattctcctacctcagcctcctgagtagctgggactacaggcgcccgccaccatgcctggctacttttttgtatttttggtagagatggggtttcaccatgttagccaggatgatctcgatctcctgacctcatgatctgcccgtctcagcttcccaaagtgctgggattacaggcgtgagccactgcgcccagccgagaaaaatgtgttttatattttcccattggttgacaatttctggcactctttactcctttggtagatccatgtttctacctactatgttttctttctatctgaagaacgtcctttagtgtttctgctactgtaggtctactggcaacaaattctttaaacttttctttttctgataatgtttatcttgcctccatttttgaaagatatttttgctggttaaaaaattttaagttgacagatgttatttttcctttccacatttaaagacatcattccattgtgttttggcttgtaaaatttctgacaatatgtctgctgatagttgttactgtgttcctctgtatgtgtttgtatgtatgtgtttttaattttctttctgctggttaattttaagattttctctttacaatcgttttccagaaatttggtaataatgtcctttaatatgtctatgtatgctgtcagtgtgtttatcctacgtgggattcgtagagtttcatcgatctgtgggatatagttttaatgaaagtgtgaaagaaatattaaacattatttcttcaactgctattcccaatttgttctttatgagactctatcccatgtatattagccctcttgatattgtaccacaggtcactaaagtttcattcatttttttggtcaatcttttattccactctgtacttcattttggataactattaagtgtttggattttgttgtcttcctttaaaaaatgttgaagttgaaaaaactggaacatttgtacactgttgatgggaatgtaaaatggcacaccattgtggaaaacagtaggacaatccatcaaaaaattaaaaatggaattaccatataatcgaggaattccacttctgggtatataccagaaagaactgaaagcagggtctggaagaggtatctgttcaccattgctcatagcagtattattcacaaatggccaaggttggtagcaacccaagtaaccatttataaacaaataacaataaacaaaatgtggtaaaacatacaaaggaatattattcagccttaaaagggaaggcaattctgacacatgctaaaaaatggataaaccctgtctgggtgcagtggctcacacctgtaatcccagcactttgggaggctaaggcggtcgaatcacctgaggtcaggagtctgagaccagcctgaccagcatgaagaaaccctatctctactaaaaatacaaaattagcttggcatggtggcacatgcctgtaatcccagctactcgggaggctaaggcgggagaatcacatgaacccaggaggtagaggttgcagtgagctgagatctctccattgcactgcagcctgggcaccaagagcaaaactccacctcaaaaaaaaaaaaaaaaagaaataaaaataaataaaaaataaaccctgaggaacttatgctctaagttaagtaagccagtcacaaaaaaacaaacaccgtatggttccactttagtgggtgattgccagggactgaagggacaggggaatatgaagttcttatttaatggatacagagtttcagttttgcaagatgaaaaaagttacggagattggttgcacaataatgtaaatgtacttaacactagtgaattaactgtacacttagaaatggggagtctaggcaggcgcggtggctcacgcccgtaatcacagcactttgggaggccaaggccagcggatcacctgaggtcaggagttcaagaccagcctggccagcatggcaaaaccccatctctactaaaaatacaaaaattggctggcgtggtggtggacacctgtaatcccagttacttggaggctgaggcaggagaatcgcttgtacttggaatccagcctgggcgacaggagcgagactctgaaaaaaaaaaagaaaagaaaagaaatggggagtctagctccatctcctaggctggagtgcactggtgtgatctcagctcacggcagcctccgcctccaagttcatacgattctcttgcctcagcctcctgagtagctgggactacaggcatgtgtcaccatggccggctaatttttatatttttagtagagatggggtctcaccatgttggccagactagtcttgaactcctgacctcaggtgatccgcctgcctcagcctcccaaagtgctgggattacagacgtgagccattgcacacggctttagaaatggttaagatggtaattttttttttttttttgagacagtctcactctgtcacccaggctagaatgcagtggcatgatcttggctcactgcaacctccacctcctgggttcaagcgattctcgtgcctcagcctcccgagtagctgggattacaggcgcccgccatcatacctggctagtttttgtatttttagtagagacggggttttgccatgttggccaggctggtctccaactccggacctcaggtgatctgcccacctcggccgcccaaagtgctgggattacaggcgtgaccgactgcgtcctgccggtaaattttatattgtctgtattttgccacaattaaaaaaaatttttgttttttcacaattaaaatgtttttaaatgttgaactttgttttaaaaatcagttatttgtagaacagtttgacagtttgattccttgaatcctgttttaaatcattactagggtctagtgtaatcttcattccagagatactttagccctgctaaggtgtaaccttttttttttttttttcctttttgagacagggtcttgctctgttgcccaggctggagtgcagtggtgtaatcttgggtttacaacctctgcctcctgggttcaagcaattctcctgcctcagcctcccaagtagctgggactacaggtgtgcgtgaccatgtctggctaatttatatgtgtttttagtagaaatggggttttgccatgttggccaggctgccctcgaactcctggcctcaagtgatctacccgccttggtctcccaatgtgctgggataacaggtgtgagccaccacgtctgaccaagatgtaatctttatgggggccttcataattgtccccaaggactctacagttggtagtcagagttcaaatgtctcatgccacatgtaaaccttaggaatttttcatatacaactccctagtttttcttaggccatttttttggagtttcactctatgcaaggagggcctagtagccagcaaagatttaagactactcatcacatgtggctaaacaggccaggcacagtggctcaggcctgaaatcccagcactttggggggccgaggcaggcagatcatctgtggttaggagttcaagatcagcctggctaacatggcaaaaccctgtccctactaaaaatacaaaacttagccaggcgtggtagcacacacctatagtcccagctactgtggaggttgagtcaggagaatcacttgaacccgggaggcaaaggctgcagtgagccatgatcatgcaactgcactccagtctgggtgacagagcaagactccatcccataaaaaagaaaaaaatgtggctaaacgcctttgcaatctttttttatgctttaccactatactccgtctcccttgtatatgacctaattctcattccataccgtcataataatggcaggagggccaacggtagcaacagtaacaacagaagttaccatttatggctgggtgcagtggctcacgcctctaatctcagcactttgggaagccaaggcaggtggatcacctgaggtcaggagttcaaaaccagcctggccaacatagtgaaaccccatctctactaaaaatataaaaattagctggtgtggtggtgcacatctgcagtcccagctactcgggaggctgaggtagcagaatcacttgaacccgggaggcagaggcttcagtaagccgagattgcaccattgcactctagcctgggcaacagagggagactgcgtgtcaaaaaaaaagaaaaaacaaaaaggccgggcacagtggctcacgcctgtaatcccagcactttgggaggctgaggcgggcagatcacgaggtcaggagatccagaccatcctggctaacacggtgaaaccccgtctctactaaaaatacaaaaagaaattagcggggcgtggtggcaggcgcccgtagtcccagctactcgggaagctgaggcaggagaatggcatgaacctgggaggcggagcttgcagtgagccgagatcgcaccactgcactccagcctgagcgacggagcaagactccatctcaaaaaataagagaagttaccatttactcaaaaactaattcagtgataagaatttcttatccacttactctaattcccactagtctgcaagataaatagaagtagtagcctcatgttacagataagaaagccatgggttgaatggtttatgtaacttccacaaggttacatgatattgctaaatgtgaatcaactagatctaagtcaaaagtacatagttttcccattacatcaaaatgccttctcctcttctcccacttacctcttcagtcatggcatatgtatgatgtcttttaaacctcaatacaaagattatggaagcattttctgattaactttccatcatttcagcattcggttatgtgtagaataatactatacaggtcaggagtggtggctcaggcctgtaatcccagcactttcggaggccgaggtgggctgattacttgaggtcaggagttcgagaccagcctggccaacatggtgaaaccccatctctagtaaaaatacaaaaattagccaggcgtggtggcacatgcctataatcccagctacaagagaggctgaggcaggagaatcgcatgaacctgggaggtggaggttgcagtgagctgagatcgtgacactgcactccagcctgggtgacaagagcgagactctgtcaaaaataataaataaataaataaataaatttatgtaaaatcactagcatattttattgttgctctcaagataaattgatcttaacataagttccttggtattatggaatgtctcttatagtcttttggcttaaaatagtagttgaatttggtagcctgaatataatagttgctcagtaataaaattataaaagaactacctctctcatcaatgtaacaatatttgtaaaccagctataaaaagacgaaatgattctgtgaaacactattgaagggatttatgttctctagaatgtgaaaattaccatggatttgtgtcctaattataaaaatcttcagttatgtcaaatacctgagaaatgagcaaagagacataaatatcttaaaagctacaaatatttaaaaaaagacctctaagagagatgtaaactttaacagagtatttgcaaatactcatttcagaaatgaaaatagttatcctcatattacatcctaaagacctaataagatattaaaaacctccagaaaaggcttagattgtactcatcaataataattttgttactatgggttcctgatatgcataataaagactacagatttcagtaaaatcatatactgttagtatattatccctttggatttatctcaaaaacaggaatttagttcaaggatgggccttgaggcatcttatccaaaatacaaattgctttttgtttctacagttgtttacatacctcagtttactaaacagatggtttctagaggtatggtattcctttgactatacctagaaggttaggacatgattctggtttatttctttgcctttaaattgcaaaataaaggctgtcattccctgtgttgctacaatatatgagaaagctaggtcaaccaaaattgtgaatacagtgattttgaaagctcaggtttatatttaatggcaattctctagagtatttgcatttggctctgcaatgcaactgggaacattacaaacctatgacaaattttattttaacttttttctgggtctgacaaacaatataaatctgtaggagaggcagagaattagtaagagcttgtggtcaggaactcctttttcttcctccttccaaagccaaaactaaaacaagaaactgtccttttctatgataggtttatttctattttcccgtacattgttaagtgtcaccttttgggggttccaactttatgcatatgtggttttttgttctactagagtcctaggctctgtcttttgtctcttccagctggatgtgttccaattaccagactcccagccaccagggatcaagcagatgtcaagcagctctaatgctctttatctctgttgaattgaactttctgaagtttctggtttcctatttagttacttcaaagttcagtcatactgtaagaaatgttgtccatgtattttcaggttttagataacaaggtgtttgcttgctctgcacacctaatctaccacattgctggaaataaagagctctaatttatttcaatgccacctgaattttaagtctcctttccctctttcaagctccaaactttcacattctcagactattttttcttattttctcaatcatttgacactttctgatcgaactcttcttgatctctttgtgacatctaatgttgactaatctattccattctgaagtcttgtttaggcttctgtgacatatacagtttgatgtttcttatttaagtgtccttcactaaacatcttttcttccacttccctccaaaatgctcgagtttcttaggtctccgtccccatcacctcacttaacacattctccctggatgatctctttcactgccaaattcaagttcatatatatactggtagatctctaccacagatgtctctaaaagtataaaccactgcttctaacggtctattcaatatctctacctaaataggccaaagacagtccaaatttaatatatccaaatctgaagcccttatctactctgtctgcatgcatttgtcacactccattcttcatattgtaatgttatagcattttttaacatacacatatgatagactataatattacttacaaatatttgctatccaccccccaccgccaaaaggattatactttctagtcccattgacacaagacttaaccacatgacttgctttggcactgaaactgagaagtaacatttaatgcagaaattttaatagccacttagtgctttactatggccctttcccctccgccagaagacaagcaacattcaaggtacaggttctctgttagccggggtcctagagggaaggcaacatggagtggactcttgatggtcacacagcatgaacaaaaaataagcctttgttgttttaagcctctgagatttggggatcattttttaacactccaagacctatcctattcttactgatagagcatatcaaataatttatcttccttgttagaaattgttcagtagctcccaattgcatgtacaatgaagttccaactcctctgaatgaaaaaaacataccatatatgatatagtccccattattgcttttacaacctccttttccaaccaccatcaccaccacttatgtacattagtcatatccaacaatgggttattcttcaaaaacactatgctatttcatggttttgtgcctttcttcgaaagtgctgttgttactgtgctacattattaccctttatgttgtcccacttgcctacttaagtaaattcaatatacagtagtgtgcgtgacttattcagtgatatcttcttcagtcatttcaagtggttagtgcttgaatttctctgtgtcatagcattttgtacactgctctgttacagaatttaatacattgcttttcagtgaatatgtctgaattattgagggcagtaactcaatcttactcgtatttgtattcccagtgctcactactcacagcaaccctcaacagaaatctaattcaatgaacagaatagtctcattgcaaaagaaacattatgaatttagatattctttcttttgtttacaaaagtaaaatattttggtgattttcaacattgatatgtcccttatcaaaatctcattcatttgttcaggggttggtgaactttttctgtaaaaggccagagagtaaatattttaggcttttgaggacatatataatgcttacctcatattatacttcatcttttctccccaagcctttaaaaacctaaaaataattcttagcttgagggctacacaaaaacaggccttggactgcatttggcccataggctgagtttccttaccctggtctaggtaaacatcagagaaattaagtcacttcttgttagagtacaaaagtctctccatggtagtataaaaacaaagcaccaagagagatacaactatcacttgctgccaagcagacaactggactaacaaagagcttctaaagataatcatcaactaaattcaacaaataccatattgatacaatttgaaaggccttctacttcttcaaagacctagagatagaaaggcaggagataatgtcacttccttgtttacgtttccacaacttccaactgtgtttaaggctctacatcactaattctctactacgtttccagcctcatattaaaaaaccatctttggctgggtgcggtggctcatgcctgtaatcccagcacttttggaggctgaggccggcagatcatctgaggtcaggagttcgagaccagcctggccaacatggcgaattttagtctctactaaaaatacaaaaatattagccgggtatcatggtgggcacctgtaattccagctactcaggaggctgaggcaagagaatcacttgaacccaggagtcagtggttgcagtgagccgagattgcaccactgtactccagcctgggcaacagagtgggactcatctcaaaaccaaccaaccaaccaaccaaccaaccaaccaaccaaccgtctttagtctgaccacactggcttttttatttattttcctgaacactctaaattctctttaatatattcctcactatctggaattaatctatcactctccatctctctcagtaaaattaatacattaaaaaaattatttcttactcttcaaccatcaggaaaaggcagaaaacaggtataaatcatcctctctctttttttttttttttttggtaaacacacaaactatccataaaaagaaaattggaagcataccctaaatttctgtataaattatacaaatatgttgtatgtattaacaggttgtaaatatataaacattagcaattaagaagtttaaaaataactattaatagaggttctcctcatgaactcttaattattttgcatatccctagagatttctgaatgctactttggaaattactagtttactaaacaatttttttttttttcagacagagtctcactctgtcacccaggctggaaagcagtggagtgatctccgctcactgcaacctccgcctcccaggttcaagagattctcctgcctcagcctcccaagtagctgggattacaggtgcacgccaccatgcctggctagtttttgtatttttagtacagatggggtttcaccatgttgaacagggtggtctcgaactcctgatctcaggtgatccacccacctcagcctcccaaagtgctgggattataggcgtaagccacagcgcctggccttaagcaattttatatgtatctaaatctttattaaacagctacaatccacattcccctattattcccaacacacacttttactttaattcagctttgtaaaggggaagactactatattgtttcaatgtacattactgattctcaaataccaagtctattgtttcaactcctttgaatggaaaaataaaataccatatatgatacagtccccattattttttctacaatattgtaactccttattcacaaataacaaatgggaaactatcttgaaaatctggtaaaacaaatagcactagcctgttgaagaagtactctcagatgaagaccttttccgggtagggctacaatttgtgctctctgatggccgctgggagggtttatcagaggttggctgggagcctggagaaagagaaaaagatagaaatcataggaaaattcaactttaaaaataatgtgaaaccatcttttgttagaacttgttacagtttagttgctgccactgtcatcccctgtaataacatgacttgtaacctgatattaggaggaaaataagcagaggacaaatcacactatatgttgttgtcagaatttcacagatcttatatacataagttctcctgttacattaccagaggaaaaactaattttaatggaagaataaacaagatatgatttagttttcatgtgttactagcctaaaacattatttaaaatattgatacaaattactaacaatattttaaccaaatctgttctggattattgattaaaattcatcatataaactgacaaaatttacaatgtaatttattaaaaagttgatgtgagggcccagcgcagtggctcacgcctgtaatcccagtactttgggaggccgaggcgggtggatcacaaggtcaagagtttgagaccagcctggccaacatggtgaaaccctgcctctactaagaatacaaaaattagccaggcatggtggcacatgcctgtaatcccagctactcgagaggctgaggcaggagaatcgcttgaacctgggaggcagaggttgcagtgagccgagattgcgccattgcactgcagcctgggcaacagagcaagactccatctcaaaaaaaagaaagtaaagcctcaaaccttaaacccacacatcctatccaattcacagaaattattttcagattctatgtttttcttccttttgcaaattctagaaaaactggtaattaatttatccatgaaatacagtaagtttcttttaaagctgtacacttaaggatccttggctatatacataaaagcttatgaagacaaagaaactcaatttcctttcaaaaactttcatgcttttagcaaaaccgcaaatctatagagcatattacatctcccgctcaaaagaaaagtatgttgttgatgtaagattattttcctgaataaaatatacttgattcttatattggattctttataatctaaaatgccagctattaagagttggtaatgaatgtctacctcatgtttgtcaaaaaactagtaatctgaaatgcttattgatgggaaaaaattacaaataaaaaaacttacatgtaactggagccgcaaaaggtacaataaatcaaaaagttgaagattttcaagatctgcctctaaatgaaagttcactcctaaaagaagatgtgattaattctctaagaaaacttagggtcagaagaactgaatggagctaagttgctgtttccttttctctaagagaaatagaccatgagccttgtttcaattaagtagtatcttaaatcacattgctgtaaatagtcttttagcaggctatgggaagcactgctcaggtgagatgtaagactatatgctgtcattcaagagtaacacgttaaatttttttttagaaaattgatgtgatagtacatcctacttctgaaacacaatgatgactgatgtagacctattcaagcagcaagattgtttattgttgaatcttaacaacagatacaagatggatttttatatctgacagtataataaatcctcctcgagtgtggttcagatgagatatttccattaaataactgaatgtcgcaatgaaacatctaagaaataaaaagcccaggcatcagagaagacataactttaagtattaatactgaaaacttaatatacagacagatacatatttcctacccaacacatagtcaagacagaagacaatagtggccaagaagcctgagataatagtcaactgtatcaccattcctgatcatggattaagtactaagaaaagaggggtttgagggttttttttttttttttttgggagacggactctgtctcccaggctggagagcagtggtgcaatcttggctcactgaaacctctgcctcccgggttcaagtgtttctcttgcctcagcctcctgagtagctgggattacaggcatgggccaccatgcccagctaattttttgtatttttagtagagacggggttccatcatgttggccaggctggtgtcaaactccttacctcaagtgatccgcccgcctcagcctcccaaagtgctgggattataggcatgagccactgcgcccagccctaagagcactttttatatagtcttttctctcagtaataaactaacatttattaagtgagtatagtttatatgtttggtactatgctagatattgtgaaggtagggggaagactacaaatggtgtaatggtctctgccctcaaggagcttactaatcatcgtgtatatcatcatgcactacattttaggtggcacttgtgccatccattcttgagctccatcttcagttcttaggctatttggtagtgtttcctgaatttcttggtcatcttcaagaaagtcttgatgaaggcttcaactgtacctttgataatcaggatatcctgagaatcaccctgcctggcctcacccacctcagggtaaaaagagggtacaggcactttcttcaaagctccttcttttggtgacatctggagcttcagaggcagtgggagatggaatgggggtcagatccatggagatcattattggcagcattattggcagcaattcctgagaaactgaaacaattgagagagagatggcttacttagctcacttagcttctaagccatttttcatttcctgaaagtaatggaagccagcagcctattcttaggatttaataggagatttgagtaaaatttcattcaggaaggttctcatttttcatttttaaaagtttgaattccctgttcatacagagcagagctattcttaacaatattccatatttaaaaagaatcaagttgtatccttgagatacagatctctatcgcttggtaatcatcagctctagcatcttatttcacttaaaagcagtgctcacagaggcagtaagaagatgaggataactgaaaaaacattaacgatataaagcaaccaagtttaagactggaaagtgatgctatcacttatgtaaaagaaatagcaaccagttaaaagatgttcaaagtatgttaaaattagcctaacagtaggaatcatatgaaatctgcaaacatctgtaacattgccagaaatacactgttttataaacgccaatttgcagttgggcttccagaaagaaccagataatgcccagagaactagtatgtccaattcaacagagaccaatatatatgtatgtgtccaaacctaaaacataatgcagagcagagtcgagtgcgatatcgtgttcagtacatggactatggagtaaagcatccttgggtttgactcctggctctgctacaaattaaactagagagaatctatagaagtaaatgtgcctgggctttggtttaataaagctaagttacagcattgttgtgagtcccaaaacgagataatgtaatccaaaaacaattttataaaattcaaaatgttttataaatattagtgactactatatattaattgagtccttaggtttattatggaatttttacataggcaggtgtgggggctcatgcctgtaatcccagcactttgctaggccgaggtagccaggttgcttgagttcaggcgttcaagactagcctggacaatatggcgaaactcagtctctacaaaaaaaaataaaaattagctgggcatagtggtgcataccctgtagtcccagttacttgggaggctgaagtgggaagatcgcttgagcccaggaggtagaggcttcagcaagctgtgatcgcaccactgcactccatcctgggcgacagtgagacccttgccttaataataataataataatgatagaaagaagagcagtgagttatacccagtagggagctagaactaacctattaacatcaagcatttaccttaaacatagagtgaatccaattaagaagtactactcatataggcacctccagggctggtaggtacttgcagggtaggaaaaagttactctgagtgaatcttctaattcactgactcttcgccatagcttttgcagagtatgcccaagagatgagtcagaaccagaagacgtctggctttctgctcagttttttcccaagggagaaagtagttttctgcttcccctacttagcccttttccttgctgtctccatcatgtgacaaatgtttgctcatgtctcaagagtagccattttagatctgcctggaaggatgtgtggaggctccccattccacaaaggacaagaggtttatatgaattctagttcaagaaaatctgacacttcctcaaagcatacacacaaagaacacaattgtagatatcaaagagttcccatcatttttcatttcaaaatactataaagcagaataagtatttcagaagtgaataaagactacaaataggaattccttagttcacaatattactacgtagaccaccgctgtgtctcatcactcagatgatgacaacttcagaatatgtttggaaattctacacacataaatgcaggaagtagaaattataggcaagctgcaaaaaaaaaaagtacctaaataaaattggatttcagaataaatataagtagattattaagggaaatagtttttcttccgttggaaataaaggccctcatgtaaacaaggcagactactagtaaagaggaagacagaaaaagagaataccataaattggaataatacagagaaaattaagaattaaaaccaaacttgcaaatgtgaaggaaccttggaagtgattttaattatagactctctggattttatttggccagtatttgatgaacttttgaagataaagacaggatttacagaaacatttttgccaatttaaacaagaggggaaaggtagtgcttttacagcaaaactgtaagatgaaatcagggatacaaactgtcaaagttgaaaaagtaaaaaaagaacataactggatcataaagaaataagattatgaaaatctttataataaacagaaaatgagcagaaaccaagaacctgttttcaaattgatttgccacaaaaaatcttgattgacatttccactggaggaactaaaacaaaccaaagatataaaagtaatgctacttttacagatgcctgggtgtgaagacagtaaaacaggcaaagatagcagaatagataaaattctcactgataatagtgtctgcagtggtggaggcatcccaaagaaatcatgagaataaagattcaactaactactcattgaagccctgagcatcctagcctagaaaaacaaggaatttccctggtgccaaatacaaattagcaaaaaaaaaaaaaaaaaaaaaaacagtgaattaaatcaatagttggttggacaaaacatatgtttctttagcctaagttcactattaaagcttttataacttaatatagtatgaattttagtcacactctggagatcaacactaaagacacaagtaactaagaaatcatttatatgagtggaatgtttgatgtttgcaatgctagaaatatctttgggtgaattacagaaaaataaattaagtatgctaatttggaagaatgctatgcagtagtcagttctaagatattatcgattttaaaataatttactttaaaagtttctaacactgaaattgttccttcccaccaaaattaaattgttacaaaagtttagttttaaaaaagatttctcttctttcattatttataagtcaaagctatttgggaatgtgtgttaaacaacgactgaaccaaaattggttgtaataaaaatggctaccatagtaaaggaatatgaacataaaatatcaaactatttgagaacttctggtcaagattttttttgttcccagattcaagttctgaatcctttggtatggttcacagttgatagccaccttggaaccttcttgtgaatgagctgaatgctaaggtaaaagctgggtccacaataaaaacagctgttttcaattgtgggaaatacagaaagcaatacattttatctgatgcaccaactaaatgcactacaagagagtatgactcagagcctgttctggcgatttttaagctataaagtctgttttggccgggcgctgtggctcatgtctgtaatcccagcactttggaaggccgaggcaggcagatcacgaggtcaggagattgagaccatcttggctaacacggtgaaaccccgtctctactaaaaatacaaaaaattagccaggcgtggtggcgggcacctgtagtcccagctacttgggaggctgaggcaggagaatggcatgaacccgggaggcagagcttgcagtaagccaagatagcaccactgtactccagcctgggcgacagagtgagaccccgtctcaaaaaaacaaaacaaaacaaaacaaaacaaaaactctgtttttttctctaactaggctatttttcataatgcccaaatgacatcattcactgaaatggaattcttctggaaattcccctaactgcactaaccacaccacaaacaattttctttcatctctgtaggttcacacttcctttataggcatatcttttttctatcatgttttaaatctttttaaaattgatacataatagttgtacatatttattgggtacatgtgatattttgttacatgtatagaatgtataagaatcaggtcagagtattttgggtatccatcaccttgcgtagttatgatttctgtgtcaggaacatttcaagtcctctcttctagctatttttgaaaaacacaatattgtgctgtcacctatagtcaccccaccctgctactgaacatctgaacttattccttctaactgttgcataggtgtgtcttataaacagcactagagaaattgtttgagatcagtatattctgatcaaagcttatactcttcagttaaagagaaaactcagtattctttgcttcaatctatatgcttgtacagtgaatatactttttccaaaaaaaaaaggtttaagcctcacttattcttggaggacaaaatattcatcatcactgaatgcaccaaataatgtatataatttacatgtagtaaatcatttataataatgttccattgtctgcttgttctatgacttgtaagctataaatgctaaatgaaaatactccattctactgctctgccaattttagaatccaggtttgtaagttctgtcatgtgtagccagccatgagtcacatatgctgaaaaacagggatgaaataactgacattccaggtcagaaactcttgctcatccaagtcagaaactcttgcccatgagacctatttcatgtctacctaacatacatacataaattaaatagaatcactatcaggattgggagaaaccaggaaacctggccttacttaagtgtgtaattttactgtaatttcacttgcatcaagctgattttatagctgttagtctgtacagtacagaacagtatatgttagaaaaataagctaactaccatatgcacataatttataaaagtgattatagctgttattccttttaagtcttcataagatttaattttacagtgaatatacttgtttactttaaaaatgctcaaagtgataagtcagtttgattccccatttttgaaacaaggagagaagggttaaatgccttggtccaagctacacattccagtgtccctaatctggtttcatttatttttcctgaaatttatatcaacatgatttatcaaatatgcctgttttacccccaaccaacacttatgaggaatccactcaatacaaatagtaaataacctttatttcttatttcatcaattatcagtttgagatatgttttacttaacaatttgtattctgctgtattaaaaaaactcattattctggaataaattcagatttacataaaagttacaaagatagtacagagaatactcgtatgtcctttacccaacatcccccaatgttaacatcttacataactacagtacatttgtcacaaccaagaaattaatattggaataatactattaacaaaattccagactttgtttagatttagccaatttttttccactcatgtccttttttcactgtcaatctgggatatcacattgtatttagttgtcatgtctccttagtcttctctgttctgtaaaagcttctcagactttccttgttttttcaggtccttgatactttttagtactggtcaagtatttgtagaatgccctttattattattattattttttttttctgcttagatttaacacattctatcagagagtacatgatatcaccatgccttatcattggtgaagttaaccttgaacttggttaaggtgctgtctgccaggcctcttcactgtaaagttactgcttttccctcttcatactctgttctttaaaagtcagcagtccagtccatattcaagaagaggtaaattaagttccacctcctgaaagtgtgttctacatatattatttggaatttttctgtaaggaagatttgcttcttttctgccaagtatttatttagtcaatcatttatttaaatcaacatggatttatagatattgactttattttttaggttataatccaatcctctcatatttattttgttgctcaaactgtcccagcttggaccactgggagacatttcaggataataatatcctgaaggtgatcaacaatattgcaatacctattatacagtaggtagttttgggagcattttaacatgataccaaatgtaaaatgaatctaccttaaatttatatatggaaaaaatcaactgaagaccgagaagatcacttaaaaatcatatgtaattatgtatttcttaaacctttatacttcaaaaagcaacctgacatcacagattgagaaaatgtaattacatcttcaacagaatgctatagaataacaatgtcattgtaaggaaaaagcaaataataaaccagtcagaagtgctacaaaagaaaacactgaggaaaaaatagcaaaatgtaaaggtgtaagaattttaattgtctgcatttcctaacttccattcctcagcctccagaaatctaacatttgccactatacaaatggctctcagacacaagacaaactaaccgccaaagccaatcatccactttcagtacttacctaaccaatctcccataacacttgacactcttttttttaattaattaattttttttttttgagacggagtttctctccttgcccaggctggagtgcaatggcgtgatctcagctcaccacaacctccacttcccaggttcaagcaattctcctgcctcagcctcctgaatagctgggattataggcatgtgccaccacgtccggctattatttgtatttttagtagagatggggtttcgtcatgttggtaaggctggccttgaactcccgacctcaggtgatctgcccgcctcagcctcccaaagttctgggattacaggcgtgagccaccacgtccacccacttgacactcttgactataataaactcacttaagaaacccactgaattcaccataaatattgtcattccttctcatagccttaataataaagtatctataattatcttcaggttttacctctcctttgagctacagatccatctgtcctacaaaacaggcttgaaatccaaatttattacctatttccaaccttatccttttgcatatctcatttcacttaatcacatcatctctaccttggctcagagcctcataataagagcctcataatattttgtgggagcagtttccaaactgatctacctgatctcttttcactaatccatctatcacactgctgtcaatgtaatctcaacaaattattccccatcttaaaacccttaacttctcataccttataaagtaaactctatactcttgggagtctcatataaacgaggactttatgatctgcctatctttccagtcccatctcttgggtcccatatcaaaccattaacacttaactaagcacagtaacacatccccatgcccttgcaaagctgatatctagtgtaagaaacacgtgtcacacattattcttcgctgctaaattcaaaactccctcctccttcccaagacctttaaagtcagtccctcacttctctgctccccaaaatgccttgtaagtatctcaatattaagaaccgtcaggctgtgcgcggtggctcacacctgtaatcccagcactttgggaagccgaggcgggtggatcaccataggtcaggagttcgagaccagcctggtcaacatggtgaaactccgtctctactaaaaacacaaaaattagctgggcatggtggcacacacctgtaatcccagctactcaggaggctgaggcaggagaattgcttgagcctgggaggcggaggttgcagtaagccaagattgtgccactgcactccagcctggccaacagagtgagtctgtctcaaaaaacaaaaaacaaaaaaaaacaaaaaaaaaaactgtcaataactattcatatacatgtctaaactataaatcaactttaaagcagaaattacctttttttttttttttctgagacagagtctcgctctgttgcccaggccggagtgcaatggtgcaatctcggctcactacaatctccacctcctgggttcaagtgattcttgtgcctcagcctcccgagtagctgggactacaggcatgtgccaccatgcctggctaatttttgtatttttagtagaggcagggttttaccatgttggccaggctgatctcgaactcctaacctcaagtggcccacccacctcggcctcccaaagtgctggaattacagcatgttccttctcctggcacacaataggcacaaaataactgtttgctgaaagaacagctaccatcataagggaatagttaagaataaaaatcaaatacataaaatactcctaaacaaaaccagttctgactttcaaagggatcaaaacaaaagatatctgagcctgaattaatatttttatttagtattctgcttaactaaaaacttttcctcgactggtttttgttaagacaactaaacctattctcacatctacctgaaaaaagtatattaagtttctattagaaaatcaagtcacatctccatgtacttatcaacagtaattgtgaagaagatggagagattccaagatagagaacaattaacaaaagaatttagacttatgatcaagtaaagaatatagctggtctttgtccctggttcctggcacagagtttcaaaaacccttgtaattacccaagtgacaggaatgtctctgttacgacagtgagatgaaagcctgaggtaacttcaagatgggggccggtgaccagaaagaccaaatcacataattaaaaatctgaaactttgggtcaccccaacctcaagggagtggagaactgaaaattgaattaaaaaacatggccaatgatctaatcaatccggcctacctaacagagccccaataaaaactctggacactgaggttcactggagcttccaggttggtgaatatagtgatgtgctgggagggcaatgtgcccggattccacaaggggaaaggcatggaggtctgtggacccttcttgcaccaaacactgctctatgtatctcttcaactagttgttcttgatctgcatcctttgtaacaaaactgtaatcatactatagtgctttcacaagttctgtgagtccttttaacaagttaccaaaattgagggggttgcacgaagttgcaaatttttagcaggccaggcagaagtatggatgtctcaggaacaccaaaatttgtgactggcatctgcagtctcatgatgaactctgctcttaacttgaggtcttcactagcttcaggtaatttgtattcagaattgaactaaattgtacaacatccaattggtgatagagaactagtgtcagagcagtgacttcagagaggtctttgtggtttctgtatgttattttataaagaagaaaaaaagccaagtgcagtggctcacacctgtaatcccagtactctggaaggctgagacaggtggttctcttgcggtcaggagtttgaaactagcctggccaatacagtgaaaccccgactctacaaaaaattcaaaaattagccaaatgtggtggtgcacttctgcaatcccagctactcggaggctgaggcaggagaacagcttgaacccaggaggcgggttttgcagtgagcctagattacgccactgaactctagcctggatgacagagagagactccatctcaaataaataaagaaggaaatttttaaaaagacaaattcgtacttaacacaggtacttttgcataaacttccctgctatctttctcattccccaaggaccctgaaaccaggttcacatccaccattttcaccccaacttctgtaactgtcctcttgggtaatttcaatgtccatgtagatgatacattcaacatcctaacctgtcatctcatatcaccttcacctcaatttactcatcctttataatctccttctcatgactctgaaattagggatctcaaatccaaaagttccctctttaaatagctgaagagggccagatacaacacacaacagaaaacagtgaggactgtggcgaacaaaagaatacaagcagcaatgaaaaagggcctgccaatactgagccccagccatccctattatccacgaaatgtggactaattgttgccagatgttctgatttttctgagaagcagaattccacatttttatgtaaaattgctacattttttaatatgagcaattttttaaaaagtgtagagatcatcacaaagaatcacatgtgggccaaaagctgacagttttttaagcactactttaaatactgcagttcctcagagctacccaaggctgtttgtttttcactccctattctctcccaaggaaaatatcattactctcatgattatacatataaaaattcacaaaggtatacagtatgttttgttattgtatgtgtttctatatagttaaatagctcttgtatcattgataaatacaagaatgataccagaatatggaagttgtattggttaatacatgacttttaaagcacataaatattttgcaggacaaaactagcagctgaacgaaggagtacaccaacacaaactaaatgaagaaagccataagcaatgtagttctgttcaaaatgtacattcatccacattcttcctcttggctcctactggcaacagacttttctgcaagtgtttttattgtgtggcttctctcaatgtttgtacaaaagaaacaaacaggtacaatacactagaaccagctatgtctggcattgctacatttatctaccaatgacatccttctgtgcctacagttgagcagcttcaacccttctttatatccctacaagcgaccttcatcttttcctggaaggttaatgcctatatttattgtagtatttctattttttttttttttttttgagacagagtatcactctgccagcccaggctggagtgaagtggcacgatcacagcttacagtagcagccttgaactcccgggctcaagtgatcaacttgccacagcctcctgagtagccaggactacaggcgtatgccatcatgcccagctaatttaaaaaacatttttctgtagagatgggaggctcctatgttgcccaggctggtcttcaactcctaggctcaagtgatacttcaacctcacctctcaaagtgttgagattacaggcattagccaccattcccagcctctttatttattaagacatttagtcttaacaatatatatacatatattttttttgagacagactctcacactgtcatccaggctggagtgcagtggcacaatttcggctcactgcaacctctaccttccaggttcaagggattctcctgcctcagcctcccgagtagctgagactacaggcacataccagcactgctggctaatttttttattttagtagagacaggtttcgccatgttggccaggctggtttcgaactcctgacctcaggtgatctgcctgccttggtctcccaaagtgctgggattacaggcatgagccattgtgcctggtctagtatgtctttttaactgctgtttttgaaaattattacttttcttgatgctctgcttataaagttgcacaggtttttgagagtctgttcctaacttttatttcacccagaagccctttttagtgaatgatattgcctaacacaatttttcaaatactcagaggaaatgctcttatctccaggtcaagcttctctactaagcctgagaactagatacccaacgaccttctcaaatcctccgcttcaacgttcagacacttcaaactgtatgtattaaaaagtggctcagagtggtgactcaggcctataatcccagcactttgggagggcaaggtaggagggtccctttgagcccaggagttcaagatcagcctgggcggcatggcgaaaccccatctctacaaaaatacaaagaaattagcctggcattggtggcttgcacctgtagtcccagctactcaggaggctgaggctggaaaatggcttgagcccaggaaacaggttgcagtgagccaagatcgtgccactgcactccagcctgggcaacagagtgagagcctgtctcaaaaacaaaagaaaaaaaaaaactgtgttctcctctaaatctgctcctcctatagtcttctctctcttagtgcatgttatctccaatctcccatatgttcagacataagcctgccactaacctaatctaagcaccatcatgttatctagactactgcaattgcctattaaccagtttccttcaaattatttttatcctctccatccagtgttcatgcagaaggcaaaatcatcatttaaaaatgcaaacctaaaatcaatactcctttgtcttttgttcttaatataaaatccaaaattcttaacacattgtttggtctcttcttttgccacatttctcactactctctctgtatttcctctttcaccacgatgaagcttttttcagtttatccaatatctaaactccttcccaactgagaatcttaaaacatgttcttcactgtggctttttttttatttttattttttgagatacagtctcactctgttgcactggcgtgatctgggctcactgcaatctccgcctcctgggttcaagcgattctcctgcctcagcctcccaagtagctgggactacaggcacgtgccaccatgcccggctgatttttgtatttttagtagagatggggtttcaccgtgttggccagctggcctcaaactcctgacctcaagtgatctggccacctcagcctcccaaagttctgagattacaggcgtgagccaccgcgcctggacttcactgtggcttctcatcctttaagtctcaactttttatcctcagccataactagtaactatctaattagatccccttctgccagccctttaatctgtatcataacactccatggtattaactttatagcatttttctcaattaagccattatttatttgcttatcactctatggtttgtcttccttcactaagctgaaaattatgaggtcagatatcaggcatttactattgtatatgccagtgactagaatagtcctgtatgtttcaggaattcaacatatgaaccagtaaatgaatgaataatgaatgagtctgtttatccagttaaatgttgcacatctgccaggtctcagtttaggatcaccttctcaggaaagacttctctgggttaggctccccatttcatgctgtactctctcccttttacagtccttatcacaattttaacaacacgtaatgtgattttttgtttattatctacctcctctactataatctccatgactcaatgaacctgtgtgcctcattctctattatataacaagggcccacaaagtagaatgcctggtaaatacctgatattcagtaactattactgattaaataaactatttgttgaatggacctaagcataagactttttctctctttacgttgttaaaagctggccgggtgcagtggctcaagcctgtaatcccagcactttgggaggccgaggtgggcggatcacgaggtcaggagttcgagaccatcctggctaacacggtgaaaccctgtctctactagaaatataaaaaactagccgggtgtggtggcatgcacctgtagtcccagctactcgggagggtgaggcaggagaatcgcttgaacccgggaggcggaggttgcagtgagccgagattgcaccattgcactccagcctgggcaacagagcaagactccgtctcaaaataaaaaaatgaataaataaataaacactgttaaaagctaaggaacactcagattctccactaagttttaatttttcaaaagttcatgaataatgaaaatcaggaacaaaaactctttgtattcgaggggtttatcttttccctaatacacaagtctttttttgttttttgttttttttttaagatggagtctcgctctgttgcccaggctgaagtgcagtggtgctatctcggctcactgcaagctccacctccagagttcacgccattctcctgcctcagcctcccgagtagctgggactataagcgcctgccaccatgcctggctaattttttttgtattttaagtagagatggggtttcatcgtgttaaccaggatggtctcgatctcttgacctcatgatccgcccacctcggcctcccaaagcactgggattacaggtgtgagccactgcgcctggcctaatgcacaagtttttaatcttttaggggaataataataataactaatatttgcatgcttactatgtgattacttttcataatacccctacaaatcccattatataggaggtttagagaatatactgaggtttagagaatttacttggaaaatctgatgaaatttttctagattatcactaaaaaagatgcacaaacatatatacccgtaattttacttacaacatcagagggtttatggacttcctagagttattttacaaactcttaggcttaagatctctcacaaagaacttctaatcttttattcgagtggcaaatgcttactctttgttttctatcttctcaattcttaaaaggtgtataattaagagagaaaaagatgtacaattctttctagatgtacaaatgcattttccagatttcttttttttctatctaattgaagcagcttttatgaaaacatcaaaaggtatgctgcaaaatgaagtctgtctgaatgaatattcagttaaattttacaatgctgaaaatgtccaatgtttgaatttttattatgagacatacagtattaataacatattcttcctgtaacaaagatgcatttataactactggattaatatacattaaaaatccttccagcattaccttttacctcttggggtggtgggggcagggggtggtgggagatcctgcatactactaacagacctatgagccatttgtctttataaaaattgtgtaataacctgtctacataaaaaagatgaatgatttttcctggtttccaaaagttatgtatatttctttctttttttctttttgacaatagctcttctcaaaacaaaaaaataatatagacattccctacttcttaaatcttaaggaaaaggaatactgagatttcaaaatacacttattaaaaaacaaaaaaagatatatatattaaaagttcatctacatttatcaggcacctgtggaaaataacctatttctttaacaaataacaggtaacaaaataaccctcttacctgccaaagtctgtactgccctttcgttagaaggcagtgactcctttctgtgaagccgatttagtgaagtgtcctgtgcagaaaagagtccagggctgtcagttaatttcttccggccactggagttagggtttgaaactctgcagctgcctattgcacttgtgaaaaggtttgtatgttcatcactgctggctggctcagagttgggagtgaatcctccaagggataagcttggagaactttctgaacagtcaatctgtaaaggtgtctgcaatcccaaggccaatggactagattctgaaggctctcggtggacccactgttcctctctgtttattaagctttttgaaggagagagatgagggcaggacatgtgacaacggtgcttttccttatgcttatatcgctctccaacagcatcctttccaaatctatagcgcttcaaagattccaggacagatcgggaagagccagtgtccatagaaacctggggttgttcagaagaacggtgttctctgtgtttgtgacggtgcctgtgtttgtgctcaaccatccaaccataggccatctcaggaggaacactggggtaggtactcatggaaaggaggggagtcctgctggttgtaagaaaggcctcctgtcgaagtagcttatgctttttcttatggtatttggcaggattgagaagtaaatgaccagcatgcatataggaaggaggtggaagtggcgtggtgaaagaaggagatggaggaggtggataaagagtgggaggataccttccatagtaacctaatcctatgggagcagctgtaaggggtgaaggagagtaaggcataccataagatggatagaatccagtactagaaagaggaaaactaaggctgtgcataaaaggcatttcagccattgcctccctcatcttagggggtctccctcttttcttttttaagtcaggttttcgaatgtagtgcaaagggtctaaggggaaagaaggatgtgtatagaaactattaaagttgattcgaaagatagttggcagaagatctcgggggataaaatgatgacttcgatgagtgatccgaatttcacttaggcgacttattagttcctccagctctgcaataaagtctggatcctgtctatttcgaagctggggatatttctttttccgttttcgtttctgccttttcatcttgtcatagctgaggtaatcatgattcctgcgcttacatttgtgtttatgtttttctttaagactgcttagcactgtagaggtttcagggggaatcagagaaacatgctcaaaagaatgcctcctctttttttgcccacaaaatttctctgccctgtctgatgtgctgttattatctgttccaattccactatcactgggaatggtctcatcactatgagactcactgattggggaaggagtagcttcttttagagatgtgagttcactcaagtgcgaaggagaatttggcaacaaagtaggaggagataaccgcctcctcccctttgaggccttcttcattgcaagagtctgaatcatactgccctgtctggagtgtaaatgcaaatatggcactgaactgggttcaacaaaacctgcatcactacttacagggctctgacctccactagtcccagaagactgagagcaaataggtgatggaagaatctcagaactactagcagatgaaggcagtaatgggggaagaatctgtcctaatgctgacccagctgcctgttgagctgtttgctcaagaacagcaaggctagtaggactaccagaaagaataccatttaagacagtttttggtttgcgacctcttctctttcctatataaatggttcctttcttgctgacatttatctgttggcccaatttagagccaaatgtggcagcaagacttgataccgtattatggagtttggattgcactttccctttattacttgattctacagaacttgaaagaatctgattcaacagtttctttctctttaaagtcttcattttatttattttgcggataattgttttcattaattgtccattgtttctcttggtaatttttttatctggttccatctcaaggtcactcatactacagacacttggcctatgactgtcatctaggtcatctggatcctgaagttgatcctcgctctcaaagaaatcactgctacttctatggttgtcactttcagattctagcttgcttggactttcagtggcaacaaatggagccactgacagtacaggtggcttcatcttgactggtgacctcatttgcctcttaggcctgcctctcttttttggaaaaggagacacagacagaccttgtttgaaggaagggatttcaatttctggctgtaaaattgggggttcttgttcttccttagactgtaaagaaaacactttagaagcagggatttttaaagtccttttaggtggcccttccagttgaggcatctccttagatttaggccttcctcttttgggcttataaatatcagacaaaaggtcactagagacacacatactggaggatagtttgtgagtagcaaaagacttatgagatggtttttcactatcagctaagagagcaagagatggagctgtggatttgctcaactttggcaatcggcgtttaaggaagtcatgatctacaaatgaagggggtccaatgtttttcataaacttggctggctcagaattactatttgatagtgagctacatgaaacgtttttaaaaagctctgatctttctaattctagcccttttggagaccggcatgtgcttcttgccaccactttagtccaccgaggttttcttccttttcttttttttaatggtttggactgcaaactagtacttaggctttcagcaacttggcagtgtttgtctgatgcagatactgcacccagttttaaaaaaggcttattactaaataaactagtgaagttaacaactgaaggagtaatagtatgaatgctggattcagaagtcaaacttggcttttttccaagggaagagcttattcttggaatatctatatgggtagtttttgaatcatttacctctttatcaatccctttacattcaatacttatactatgaccaactgacctatgaccaacgttcaagtgggtactttcagaagtaaactggttctttccaacagattcagaaatttcttcgattagttctgtagtagaacttaaaagtaatggattaggagccaactgtgaagaagtttcagggggacttctggttaaaggattaacagatacagtaggtgatggggaagggagattgctttctcctactgcactgaatggggatttagcggtagatacatcagaagcacctcccattttaaagtccggagaagtgcaatatacaggaggctgcttttcatgctttgaggtttcataagatcccttttcactggatgagaaactgtcttgctgaatgcatgttccttcattaaacatttctttctccaaattaatgatttcttttcgtactgagaacttttccaatatgctttctttattctgccgtacaacattcttttcaaaagttttgctggtggcactatctttcagggattcagaaagttcctgactttcctgattattgatgtttgtactacaagaagccttaagcggttcctgagtggggagcagtgcttcggctttaaggtttatggcatctttactgatcagacctgccaaaggacaactcattagtttctttccaatgtccttattaaccaatcccattgctgaacttgctacaatcttctttgcacagtccttggccactaggccaacagtagaacccaatttctttcccaaatctttattaaccagtccaaccacagtgccaagtcctaacttcttgccagactctttatgcactaaacctggaacaataccaattcctagcttctttcctgaatctttgcttagcagtcctactgtagtgatagttcctggctttttgcctaagtttttattaatgaataccgctgtagtgccagttcccagttttttcacagagtccttattgaccaatcctactgctgcattaaacactggctttttcccaggatctttagttaccaatccaactgctgtgctgatggttggcttttttattaagtccttatgtattattccagctacagagccaacacctgctttcctgatcaaatccttgctaaccaatcctgctgtagtgccagttcctaacttcttcggttttgtcttggaagacttggaaggaggacaggtagcaatcagctgtgccaacttttctgttacactagttcctccattaagtaatgctctgtcctttaaatcaggatcccggctaccaagaagagtagatggcgttgcattaatataatctgccatttctgagtgtactggagacagcttcttagacaaaggattgttttctccctgtgaatgaagacggatgacttcttcagactggcattcaatggctgcaacatcatctgctttcttgtacaactttgaagggtcctaaaatttgaacaagaaaaaagttaaagagggagtaaaccttacaccactttagcttagcttaacaatccaacaaactaatggatcacatatcagataaacaataggcaacagtggtttttaaaaaacctaatattatacttatgtcacagtatgttagctcatctgctgctatacgagaggctatcatggtatattatctttgttgactttcaacacgataaaactatacattagagggtctttagaaatatccctgatatttttgacattttttaaatggcaaatcaatagtctactttcatcttacttttgactgggtaaatataaatgaagcatatgaagttaccatttttgaaaagaaaattatttttagttacagtatcctatggtcgtcatctaaaataatagtttactgcctacctccttcattgacttaaatgattctaaacctatagaagacaatccctaacctacttctactcttttataactcattctcaattatggtcttgagtgagcagtagagctctctcttaatgtggaataggaaagacaatttaaaaattcatattttcatcagaatgtgtttttatataaaatcttagaatgggaagtaacatttaagtcatttaccgtaaaatgctaattcatgaatcctcactatatactctagaaatgaattcactacttcacacaatagtctgttttacttttggataaccactaaagagttcttcctaaatataaaatactcagaactgaacaaatgtaaagttatactgtgtttgtggataggaagacataaagacgacaattttccctaagcaaatttataaatttaatgcaatctcaataaaaataccaacagatttctttggcatttagaaaaattgattgtgatgttcaatggggaaaatagatatgcaagaatagctagaaaaacctaaaatgtagaaaagccagggaataaccataccaaatatcatttttcaaagccccaatcattgaaacagtacagaagtgacaaatgaaaagacaaacaaaccaatgaaacaggacagaaaacataaaaccaaattcaagcacgtatgaaaatgtactgcatggaaaacgctacaatctagttataaactagaaaaattccatatgcatttaactacatcctttgacccagaaatcctactttgagggtctacccaagatacactcttaaaaatataatgtctgcacaagggtccaaaatgcaccactattttaatataaaaaaaaaaaaccctaaaaaaatccaaacaattatctacagaaaactggctgaataaagtaaggtacatctgtacaatggaatattgagaaattgtcaacaaaaacaaaagtaggaggagtaggaagagatatcaatatagtgctatggagtgatttccaggatatattattaaatgaaaaaaagcaaggttgagaacaatggttataatatgctatgctatgctatgccttatacatataatataccttctgtataagaaaatggggatgaagaatatgaatatatatatgcctaccgattatattttaaaatggaatgaaccaaagattagcgaaaatagtgacttatgggaaagtaaacagggttagaaactagacccctatgcatctaactttatggttttcagtttggaagtgttttacatagttatgaaacaaagttatatataataaaggaaagcatcccagatctccaaatattaaaagcaataggccgggcatggtggctcacgcctgtaatcccagcactttgggaggctgaggtgggcagatcgcctgaggtcaggagttcgagaccagcttggccaacatggtgaaaccccatctctactaaaaatacaaaaattagctggggctggtggcacgtgcctgttatctcagctaccgggaggctgaggcaggagaatcgcttgaacctgggaggcagaggttgcagtgagccgagattgcgccactgcactctagcctgggcgaaagagcaagactctgtctcaaaaacaaacaaaaaagaaattcatctattcaatatatagaaaattagttatataagtatatgaaaagtaattattttgaattactataaaacacaatattgagaatctacatcctaaatctcaaaacattacccaaaaaacaaacaaacaagcaagccagccaggcgcagtggctcatgcctgtaatcccaccacttttggaggccgaggtgggcagatcacctgaggtcaggagtttgagaccagcctggccaacatggtgaaaccccatctctactaaaactacaaatatcagccggacgtggtggcgggcgcctgtaatcccagctacttgggaggctaaggtatgagaattgcttgaacctgggagggggaggttgcagtgagccaagatcgtaccactgcactttagcctaggtgacagagtgatgctctgtctcaaaaaaaaaaaaaaacaaaaacaaaaacaaaaacaaaaaccaaccaaccacccggtgcagtggctcatgcctgtaatcccagcactttgtgaggccaagacgggtggatcacctgaggtcaggagtttgagagcagtcgaacatggtgaaaccccatctctggtaaaaatacaaaaaattagctgggcatggtggcgcatgcctgtagtcccagctactcagcaggctgaagcaggagaatcacttgaacctgggacggggaggttgcagtgagccaagatagcaccactgtactccagcctgggcgaaagagcgagattccgtctcaaaaaaaaaaaaaaacccaaaaccaaataccaaagaacctctacctctctattttttatttttatttttatttttttttaagagatggggtcttgctctgtcacccaggctggagtgcaatggcatagtcatagctcactgcagccttgaatgcctgggcttaagccatcctccccccgctcagccttctgagtagttgggctaacaggcacaagccatcttgcccagcaaaagaaagtggtaaattgccctcagtgagcatattactggtaatacatatagtaattttgaatttagacagatagatgactaacagatacatagataaaataggtaaccatgtgaatatcactaggaaccaaaatgttagaagcaaaaaacgtacaactataaaatcaaagaagtaaaaggctatacttttaagatagaattaaaaatatatgaagtctatctacctctctatccattaaaatgcctacaaacatcgacaacccattagcaatgaacacctcaagaccgtggtctctaaaaccatttcccattaaaatgaatcagggctcctgcagaaatgactgtttccaaatattagacaagaaatataaaagatgatcctagtgacaggtatctaactctagtatcttcactttgaactagtcactatgtttttgtattaaatttcccataatgaaatgtgtctattgaaaaaaaaaaaaaagttcttcctaagagtaaagtgaaatatatttttttgcaactttcagttactggtccaagtctcactttctaaaaatcacagagtaagtctaattcctcttcttcccaatggctgtcagacatttgaactcaaccaaaatatttaacttcctgactcaacagtttcacttctttctggtcattttctgatgcaagtgttttaagtttgtaaatatccctctttacatgtggcacctttaaatgaacacaatacatgtggtacttgattgactcagaataaagggaactatctcttcttttggactggaccttataattttgcccaagggcaaactggctttgacagtctcatatactcagacttatgttaacttgaaaattaaataaaccccacacactttcttcacattatattaaagaatcccggggaggtggggaaggttaatgggtaccaaaaataaaaaaaaaaaaatagaaagaatgaataaataagacctactgttgacagcacaacagtgtgactatagtcaataatcatttaattgtacattttgaaataactaaaagagtataactagatggtgtgcaacacaaaggataaatgcttgaggggatgaatacctcattctctatgatgtgattattacacactgcatgcctgtatcaaaacatctcatgtatcccataaatacactatgtatccacaaaaattaaaaatgaaaaaacaattcccattcattacttttatacttttaaaaacaaatattaagcagtttgttttaaatatttttaaacatatttatgcctgaaaatgacacttccaattttaaaacttatccttaaaaatgtgaactatgattacacgcaataccatgtattacagtttaaaaaaaaaaaaagaaaaaaaaagctctggctgggcacagtggctcacgcctgtaatcccagcactttgggaggctgatgcgggcagatcactcaaagtcaggagttcaagaccagactgaccaacagggagaaaccccgtctgaaatgaaaatacaaaattagccgggtgtggtagcacatgcctgtaatcccagctactcggaaggctgaggcaggataatcgcttgaacccaggaggcggaggttgcagtgagctgagatcatgccattgcagtccagccagggcaacaaggatgaaactccacctcaaaagcaaacaaacatacaaaaagcctcacgaacaacactgaattaatggagccagaaaaacagagtacctattctgacttcatttatataaagaccacaaagaggaaaaatttattatgatattaaaaataaaaaaaattattactcatggtaaggacagtaatgagaaagaagcccaaggggttcttactgggtgctagcaatgtcatactacttttttattttttttaagacagggtctcactctgtggcccaggctggagtgcagtgacctgattctaactttgaacttctaagcttaagtgatcctcccacctcagcctcccaagtctgggactgcaggcacaagccaccatgtctggctaatttttttgtgttgttttttgttttttggtttttttgtagagatgaggtcttgctttgttgcccaggctaatctcgaactccggggctcaagtgattttccctcagcttcccaaagtgctgggattacaggggtgagccaccgcacctggcaaacacatttcttaatctgaatgttggttgtcccatatggctgagttcatgaaaattcgctgagctgttacatttatgatgggtatttttctatatgtatgttatacttaaataggaagttattttttaaattctgtctaaaagtaaagtagaaacatattcagcttccttaattggctaatgaatgtgttcaagcctggtttttcactttttttttttttttgaaatggagtcttgccctgttgcccaagcaggagcgcagtggcgccatctcggctcactgcaacctccgcctcccgggtccaagcaattctctgcctcagcctcctgagtagctgggattacaggagcccgccagcaggcccagctaatttttgaatttttagtaaagacggggtttcaccatcttggccaggctggtcttgaactcctgacctcgtgatccacccgcctcagcctcccaaagtgctgggattacaggcatgagccattgtgcctggcctggtttttcacttttacctgaaataaatatctgagagaaattaaaagcagtttaaaacagagttcatatcccacagtaaatggtctatgactaaataaggcacacagataatttgatgttggtttcaaaaatcttttcttccaaatcctgatactatataaaataaatgaatgagacaacattaagattttgaagccgggtacggtggctcatgcctgtaatcccggcactttgggaggccgaggtgggcagatcacgaggtcaggagagtgagaccatcctggccaacatggtgaaactcgcctatactaaaaatacaaaaaaaaaaaaaaaaaaaaaattagcagggtggcgcatgcctgtggtcccagctactcaagaggctgaggcaggagaatcacttgaacccaggaggcggaggatgcagtgagccgagatcacaccactgtactccagcctgggcaacagagcaagactctgtcacaaaaaaaaaaaaaaaaaaaaaaaaaaaaagattttgaaaactgtatttggtactgatgatattatcctcttacacttgtaagaacactttaaaatgactgataagagttatcactttaagagagcatattatcaattaggcactgaaaaagatgctgtattaaaacatgatattaagcatgtaattttttccaacagaaaaatagctttagtccacatataaaatactctcatttaaaaaaaagaaccaaagtataaataatacctttcatgaataaagactttacatttcagatattttaccatatacatcaaaataaacaagtgtacattcttttatacaaatggagccaacaatgcttgctgttttgtagcccatttgctttaaatgatatgacacctttatgtgtaaataagagttagatgttaaattcaacagtttcacaatagttcataattcataaaatcaaccacctactgactgtaattaaatagtttctggctttttgttactataaataatatgtgggcgcggtggctcacacctgtaatcctagcactttgggaggccgaggagggcagaacatcaggtcaggagtttgagaccagcctgatcaatatggtgaaaacaccatctctactaaaaatacaaaaaaattagctgggtgtggtggtgcgcacctgtaatcctagctactcaggaggctgaggcaggacaatcactagaactcgggaggcagaggttgcagtgagccgagattgtgtcactgtactccagcctgggagacagaccgaggctctgtctcaaaaaaaaaaaaaagggctgggcacggtggctcacacctgtaatcccagcactttgtgaggccaaggcaggtggatcacgaggtcaggagatcaagaccacagtgaaaccccgtctttacgaaaaatacaaaaaattagacgggcatggtggcgggtgcctgtagtcccagctactcgggaggctgaggcaggagaatggtgtgaacctgggaggcggagcttgcggtgagctgacattgcaccactgcactccagcctgggcaacagagggagacactgtctcaaaaaaaataaataaataaatggggagacactgtctcaaaataaataaataaataaataaataaataaataaataaataacaatatggtaaacatccaattgcatttttctttccatacttgttcaattacttccttcaggtaaatttttaaaggtgaaagtacaaagctgaagggcatatgcattagttacacactagacaatgacatgtaagactttttttttttttgagacggagtctcgctctgttgcccagggtggagtgcagtggtgccatctcggctcactgcaaactccgcctcccaggttcacaccactctcctgcctcagcctcccaagtagctgggactacgcccgccaccatgcccggctgattttttgtatttttagtagatatggggtttcaccgtgttagccaggatggtctcgatctcctgaccttgtgatctgcccacctcggcctcccaaagtgctgggattacaggtgtgagccaccatgcccggccaaaaaagactttttatttccaattgtcagtatgtaagatgtcacaaccttatataaagacatccagggttgggcgtggtggctcatgcctgtaatccttgcactttggaaggccaaggtgggtggataatttgaggtcaggagttccagaccagcttggccaacatggtgaaaccccatctctactaaaaatacaaaaaaaaaaaatccagctggaagtggcagcacatacctgtaatcccagcttctgaggtaggctgaggcagaattgcttgaacccaggagacggagattgcagtgagcaaagatcgcaccacggcactccagtatgggctacacagccagactacgtcacacacacacacacacacacacacacacatacacacacactctctctctctctttttctggccaggcctcgtggctcacacctgtaatcccaacactttgggaagctgaggcaggaggattacttgaacctaagagtttgagactaccctgtgcaacacagggagacccccttctctacaaaaaataaatctccaaaattagctgggcacagtggtgcatgcctgtagtttcaggtacatgggaggctgaagtggagaatggcttgagccaggaggtcaaggctgcagtgagccatgagccatgatcacaccactgcactctaacctgggagacagggtgagaccctgattccaaaaaaaaaaaaaaaaaaaaaaaaaaaaaaaaaaaaaaaaaaaaaagacttcctattgcatttgtttatatttgacttatctattattctaaacgtcttttcacatgattttgctggccatctgtatttctcctgcagtgaaaagctgttcaagatcctggtccatatttttctaaattgtggaggtcatttctaatttagatgggcccttaatataatacttctttctcacatgttgcacatttttcccaatttaccagctctctttcacctactattcttcttgaagttaaaatcttaaacaaaaggttttaaaaatttttattaaaaagtgaaaggcccaggctggtcttgaacgcctggcctcaagcaatctcctgcctcagcctcccaaagtgctaggactacaggtatgagccactgtgcctggccaaaatcttttatgtattcaaatacttatgaaaaactgtactaattacctcacatattccttacaaccaccatatagtgaaattactataactatcctcatttaaaagattaaagagtggtttagacattggctaacttgctcaaggtcacttaaccagtaaatgattaagaaataatttaaacatagtctgatttcataactaaagtgcttaatcactgcattaaataaaatagtctctttaactttataggtttgttttggggttttttctctctctcatttttttgagactgagtttagctctatcacccaggctggagtgcagtggctcaacctcggctcactgcaacctccgtctcctgggttcaagcaattcttgtgcctcagcctcccaagtagctagctggtttacagggacccaccaccacgtctggctgatttttatatttttagtagagatggagtctcaccatgttggccaggctggtctcgaactctggacctcaagcgatccactcacctcagcctctcaatgtgctgggattacaggcgtgagtcaccgtacccagctctctttttttcattcatgaaaaaatatattccagcctaaggtggaatatagttttgtttacttttttttttttttttttttgatggagtttcactcttgttgcccaggctaagagtgcaatggtgcaatcttggctcaccgcaacctctgcctcccaggttgaagtgattctcctgcctcagcctcccgagtcgctgggattacaggcatgtgccactgcacatgcacagaatgcctggctaattctgtatttttggtagagacagggtttctccacattggtcaggctggtctcgaactcccaacctcagccgccagcctcggcctcccaaagtgctgggattacaggcgtgagccaccacgcccagtcttgttttcttatacttggaaaaatcatgtccttctagacgacaatcttcactacactttcaattaattatttttcggtttcttttcgtttttcctttatttgccatgttaaattctaaaaatataatctgggggtagggaagcagcctttattccaaaaggtttgctcattgttctaagaacattgctcattgttctaagaacattactcatttcatgcccattgattatttataattaatgtaatgtaataacatacttattacatattcttattcgtatttggatcttactctaaattcctaaggttttgtttcattcatatttatgattattattgtgccactaatatatggatattataacttcataataacgtttgaatatttgaaaacaagtaggttttttttttttcttgtattcctatagaaattctctattttatttacaacattactgagatttaactcacatgccataaaattcaccttgtttttgtttgagacaaggcccggttctgttgcccaggctagagtgcagtgtcaatctcagcttgccacaacttttgcccccccaagctctagccaacatcccacctcagcctctcaagtagctgggatcacaggaatgcaacaccatgcctggctaattttttctagagataagacactcactttgttgcccaggctggtctcgaactcctgagctcaagtgatctggctacctcagcctcccaaagtgttggaattacaagcatgtgccactgcacccaaccaaattcacccttttaaagtgcacaattcagtgggttttttttaactatagttacagaattgtgcaaatatcaccactactttaataaccttttcatcggactgtttttccatacgtatacttcctcacaaacttgagatatgattgaagtttttaaaaaacctcacatggctttaactttgtatcttaatgtagaaaaacatatctcaacattaactttagctctacaataacaaagtaaatgtatttagtcaagctttttcgtgtttctgggtatttatatctatataaatcctaaacatgtgctgttaaatatatttctaagtatttcatagattctgctgtttcttttattaataaattcttcttgctgttacagaatactttctaactataactgatagtattcaagaacacttgatttcattttataatattaaattcttgcttcatcaataattcatttttcagggggggcatggcggttcacgcctgtaatcccaacactttgggaggctgaggcaggaggatcacctgaggttgggagttcaagaccagcctagccaacatggtgaaaccccatctctactaaaaatacaaaaaaaaaaattagctgggtgtggcagtgtgtgcctgtaatcccagctacttggcaggctgaggcggaagaatagcttgaaccagggaggcagaggttgcagtgagctgagatcgtgccactgcactccagcctgggggatagagcaagactccatctcaaaaaaaaatttttttttcattttttcagcaagtatttactaagtacctactattgagcactgaggataacagcagttaaaaaaaaatccaaaaacatcttcctccatggagatgtcattgtaatgcatgagcaaagtagagaaaataagtaaaatatttggtatatcagatgataaaatgcactatggagaaaatcagagcatggaggaattgaaaaggccagggatggaaagaatttacaatgttaaaacgggctgtcggaaagttctgattgaaaactcaattgtgcagaaatgaaaaggaggtgaaagacaaagatggatccatgtaggtatgtgggaaaaaacaggaaccaagaaagcaaaggccctgagccaggagcttgtctgtttaaagaacaataaagaatccatgtttgcagtactagagtaagcaagagaagagtaatgttgcaggtggtaggaaaatggacatttttcagtccaagaaagaggaagccattcgaagattttatgaagaggtatatgacttgaccattcattcaacaatatttatgggtacttactgttgtggatatgtcaaggaaaagacagacaattgcagagaggacagtaaagaaaaaacacaaaaaacttttaaagattattatttgttagaaggtggcaagtgttaggggataaacagcaagtgaatactaggagagggcttgcaaaattaattaggcaattaggttatgctgcgatgatcagctaacattttagtaacgacagaagtgaggaaattattaactcacttagaggaagactgaaaatgatgatcaggagtttagtttgagacatgttaaaattgaaatacttactaaacatcaaagtagagaagcctaagaagaaagattcaaatttagaagtcaacagcatattgacatttaaaagcttgagactggacataaccgagtgagggtgaatgtaaaccgaacagtaaactaaggactgataacaccaaggtattgtaacattaaagatcatgaagattgagaagccagaaaagaataaggaaaaagagagagagagagagagagagaatgaatgtgtggtatcttggaacccaaatgaagcacatatttccaggagcgacaaatgctgctgacaagtcaagtagaaatgagaacatacatttgtttgttggattggagtcactggtaatcatgcaacagcagttcctttattaaggagcaaaaacctggttgaaatgggtttgaaagagaatggaaagagaaatctaaaaagtaagtaaagaatagcaagggaaacagtgaagtggggtgacagctagatgatgaagtagaatcaaagtacggtgtgtgttacctaacaatggggataaattctaagaaatgtctctaagaaatgtgatttttgtcattgtatgatcatagtgtgtaattacacaaatctagatgatatagcctgccacacacctaagctgtatagaataacctattgctcctaggctactaacctgtacagcgtggtactgtactgaacactataggccactgcaaaaaaaataggatttttgtatataaacatagaaaaggtacagtaaaaatatggtataaaagataaaaatctacttatagaaaatataagtacacctgtatagggtacttatcatgaatggagcttgcaagactgtacgacactctgggaaagtcagtgaatgctcagtgactgtgaagggctaggacattactgtacactactgttgactttataaacactgaacacttaagctacattaaatttttaaaaatttcccttcgtcaataataaattcatctggctgggcacagcagctcaacgcctgtaatcccagtactttgggaggctgaggccagcggatcacttgaggtcaggagtttgagaccagcctggacaacatggcaaaactgtgtttctactaaaaatacaaaaattagctggtcatggtggcaggagcctgtaatctcagctactcgggaggctgaggcaggagaattacttgaacccaggaggcggaggctgcagtgagccgagatcgtgctattgcactccagcctgggcaacaagagcaagactgtctcaattaaaaaaaaataaataaataaaacaaaacaaattaaccttagcttccttttttactttattaccttttacatttttttactttctgactcttttgtagtaacagcttaaaatgcaaatataacatacagctgtacaaaatcttttctttgtatctttacaattatttatttaaaaatttttaaatttgtttttaccttttcaacttttttgttaaaaactaaaacacaaacaaacattagcttaagtctacacagggtcaggatcatcaagacatcattaggtgacaggaatttttcagctccattatactcttatgggaccaccaaaatgtgatctgtcattgatccaaacatgattacgcagcacgcgactgtagtttcttttgaatgtggaaaatgacatctttgtcttctcaaagtaaatgtagccataaaaagaaaaaagacatgcactcatgaagtttaatatatatgtatgcatgtatatgcgtgtatggtaatataaaatctactacagaactaccggttctaatggaattgactgaataattccatctttcatcctctgatttgaaatgctacacttcccatgtactaaatcctcacgtatacacgagtctactactagtttttcttttcttcttcctttttctttttgaggtggagtcttgctctgtcacataggctggagttcagtggcaagaacgtggctcattgtagccttgacctcctgggctcaagcaatccttccacctcagcctcctgagtagctgggatcacaagcatgtgcaatcacgcttggctattttttttttttaatttttgtagagaggtgggggtctcactatgttgcccaggctggtctcaaactcccgggctcgggcaattctcccgtcacaacctcccaaagtgctgagattacaggtgtaagccaccccacccagccaattattagattttctattcggcgtcagtgattttccgtctgccagtccaccacaaccacaatattctaacccttttaatttctgttttattatctaataagcctgatttctagttactgttcttttcagaaaagttgtggctactcttgcttatttttccatacaaaccttacaagtaacttatctagtgccaatttgatttgtttaaaattttgattcttaaacttgcagacacccagaagaagtgaaagcaggaactggaacaggtatttgtaaatccatgttcatggaagcattagttagtcacaacagccaaaagcaggctgcttcacagttcatcaatggatgaataaatgaaatatggtatatacaactgattcttgaacaacaaaagtttgaactgtgcaggcttcatagcatatggagattttcttccacctctgctaccccttagacagcaagaccaacccctactcttcctccttggcctattcaaaatgaagacgataaggatgacaaccttatcaacttcaacttaacgaacagtgtaaatatttcattttctattctcttactttaagaatatagtacataatacatataacattaaatatgtgttaacaggctatgttatcgttaaggcttctggtcaacagtagactattagcagttacgttctgggggagtcaaaagttatacttggattttcaactgtgtgtggagttggtgcccataacttcagcattgttaaagggtcaaatgtacacacaatggaatattattcagccataaaagaagaaaattctttttttttttttttgagacggagtctcactctgtcgctcaggctggaagtgccgtggcacgatctcggctcactgcaagttccgcctcccgggttcatgccattctcctgcctcagcctcctgagtagctgggactacaggcgcctgccaccaggcatggctaatttttttttgtatttttagtagagacagggtttcaccgtgttagccaggatggtctcgatctcctgaccttgagatccacccgcctcggcctcccaaagtgctggggttacaggcgtgagccaccacgcccggccaaaagaaaattctaacgaatgctaaaacatggataaactttaaagatactatgctaagtgaaacaagccagtcaccagcagacaaatattgcatgattccacttacatatgaggtaaccagaacagtcaaattcataaagacagaaaacagaatagtggttgccaggggcttctaggaggggtaacaggggagtcactgttcaatagatacacaatttcagttgcagaagattaaaaaaaaactgtagagaagaacggatggtgagggctgcaaaacaatgtaaatgtacttaatgttacctcagcctcctgagaagacgggactacaggcacacaccaccatgcatggctagtttttttggtttttgtttgttcatttttttgttttgttttgttttttgtattttgagacagagtttcgcttttgttgcccaggctggagtgcaatggcattatctcggctcaccgcaacctctgcctcccgggttcaagcgattctcctccctcagccttccaagtagctgggattacaggtgtgtgccaccacgcctggctaattttgtagttttagtcgagatggggtttctccatgttggtcaggctggtcttgaactcccgaactcaggtaatctgcctgcctcagcctcccaaagtgctgggattacaggcataagccactgtgcctgaccagccggctagtttttaaaaatgttttgtagagacagggtctctctatgttgcccaggctggtcttgaactccttggcatcagccactgcgcctggcccagaaaacactttcaagaaaagtacgcttcagtttgtggcatataatcaaaagagaaccaaaacatctgagaacaggagtaaaaaaaaaaaaaaaaagccaaaaagaaatattaaagaaaattaaacatataggtcaagaatgcattttaatagaaagtcaccaaatattttcttttcaaaagcagaccacaatgggcttttcttaaattacaaaaccattagatgctgaacttgaattttatattccacactgaagccccaaattctatcctcattatatggccctcataggatcaagagtaagccaaaacatgttactagcataatttcttaaataaattatgataaaataatggcaatactaatatagaaatcatcatgtgatgtaaacttccaccacccaagaagttcttcttgctatataatttaaggaatagacataaggtgtcaatttgtcccagtggcagaggacaaagtcttcagggtctttttaacacctcttttattcccaacatgaaaaaccactgcaaatctgacttcatctatagtctttctcacaggatttctccctatccccatctaactagttacgaaagaggtacaattttgaactatgtactcagtgattttgactcacaaagtgaggtcagagaggaaacttttctttcatcattaagtttcatcttgtcttcctattaatgaattttcataaaagttccaggttttgtcatcttatcatataggacctttaattctgatgtctctcaaaaagctttcattcatttccatacagctgtagctcagaattaattagtaatgtgtaattattgagcagccgtatgtgaggatctctggagtgatttacaatcattaaaatgaaatcaaagatatgagcagacaaccataaaaagcagtatacgaattagtgagtgaaagtaatgatatttaggcttaattctctgggactaaagaagatataccttctaacaatttggttcaataatgattttttttttccattagcaagatcaacaatgaaatgagaaacattcacattcaccatatatacaccattaaaacaaaccacaatacagactccagcagatatcctagctatgaaagtgaactcttcaatcagccaaatgcagtactgattagggaagttcctactacataatgaaagcaagaattgaggatgaacctgattaaactaattacggtagttttaatcttcctggcacatttatagcagaggctgcagagcccaatggcagggatttgctttgcccttccatttaagggagctcatgcttccgtaatagaagtcattttgagaaaagagtgacatcctgttttatctccaaggctttaggacagatcacagccccttagctgtctattttgtgtatgtaaagggggaagaaaggttttactgaaatgtaaagatccaggataatttgcataattgctgctgccatggagaagctgggctctgtgccaactgttctcttctctaccataaaaatacctctagcttaagcagcttttaaagtaaacaatcaagatgaaggtaagactacagaatccatcatagcaagactcagagatacctacatacaatcgggtcttcttgcttgaatagcatttgtcaacaagaacatggaagtgaaaacgcagcagtcaaataatgtagacatgcattctggacctcttcataaataggcataaggaaaaaaaaaagcactctgagatggcacgcagcccatagggcacaagtaagatgacagaatgtgcctatcttctcctattaacaagtcccaaattctctggtaagagctgaggagcctagactgggcgtggtgtctcacacctgtaatcccagaattttgggaggcctaggcgtgcagatcacttgaggccaggagtttgataccaaactggtcaacatggcgaaaccctgtctctactaaaaatacaaaattagccgaacatggtggcacatgcctgtaatctcagctactcaggagactgaggcatgagaatcgcttgaacctgggaggcagaggttgcaatgagctgatattgcaccactgcactccagcctgggcgacagaatgagactctgtctctaaataaaaagaaactatatttaaaaaaaaagagctaaggagcctaaacacaaagaattggtttaaaaaataaaaacaaaacaaaaggcaattggaaaaacacaataccccatagtattaataataaaattgtttgacttgggttcatatggtaccacctatttggggtaagtcattaagatgtgttaaactctttcaaaaggtgtttgacatctaaaaatgttttgtctttcttccttatttttaaaatcagaaatggggtcttgttacgttgccaaggatggatttaaactcctggcctcaagcaatcctcctgcctcaagtcttctgagtaactgggattacaagcctaagccaccatgcccaacttcaaaatgttttcttaaactaagattactttcagatgttcctaattatttattacatattgtctcactctatcacctaggctggagtgcagtagcacaatctcagctcactgcaatctccacctcccggtttcaagtgattatcgtactccatccctccaagtagctgggactacaggtgggtgtcaccattcctggctaatttttatatttttagtagagaccaggttttgccatgttgactaggctggtcttgaactcctgaccgcgggtgatctgcccaccttggcatccgcaatttcttaaaaatagcaatctacagattgttttattcattcatttttttgagacagagtctcgctctgtcaccaggctgaagcgcagtggcgcaatctcggctcactgcaacctccacctcccgggttcaagcgattctcctgcctcagcctcccaagtagctgagactacaggcacacgccaccatgcccagctaacttttgtatttttagtagaaacggggtttcaccatgttggccaggatggtctcgatctattgacctcatgatccgcctgcctcaacctcccaaaatgctgggattacaggcatgagccactgcactcggcctagagattgttttaaataggcatgaaagttttactatatatttttagcaaatgagagaagaggaaatatttgagtaatacagttatgacagttttcttttcttttcttttctttttttttttttttttgagacagagtctcacactgtcatccgggttggagtgcaatggcgcgatcttggctcactgcaacctccgcctcccgggttcaagcaactcttctgcctcagcctcccgagtagctgagattataggcacgcaccaccacacccagctaattttttgtatttttagtagaaatggggtttcaccatgttggccaggatagtctcgatctcttgatcttgtgattcgcccgccttggcctcccaaagtgctgggattacaggcatgagccaccgcgcccggcagatagtgtattcaaaagcaaaatcttaggaataaggaaataaatactcacattctcaagctatattttaagcactgaatttttggtaatgatgatggtatttgttttatgcttacagatcttttcttcagtcttactgaactgtttttaaagcattttctgtgttgctcataaaaagcacaaacttaaaagatcaccctgacactgaaggagccaaagaaatagagaaatcaattaataattattatacaatgtgctatatgttaaaaacagaaatatatgcaatggaaacacagaggatagagtaacctcctagaaaggttcagggaacgtttcacagaattgggggatgtctaagctgagtctttccattccctcatcctccttcctttctccttgcacagtgaaacttttttatcctttttgctttttatttagaaatttagtgattaaatttgcttttctaatttttctcatttatcttaggtaattttagttatcgaggttgagacaaatagaatttttaagagttaccaagtatgcttaggagaatttccatatttcataattcctaaccttcataattgccctaaccgttataatcaacaaacagcttagaaagaaaggttaccaagctcccctgccttggcttataattttcagcatctgcttttgatctcctcagcaatcttttggagcccccagcccgtaaaatcaaagactaggcaaggaactacacaataatcacactcagtaattttgctaagaaatgaaaaagtgaggctgagaagcaggtgccattttgtttcactgtttttactgtgagagttactatcaaatcctacagaaagatgttaggatcatttttgtgccttcatatatatcctcagatgttagtaattcaatgtagcttcactcaatacagctaaaatattctagtgtatctaccatctgtgcatttttgtcaaaatgcctttgtgtacctcctaaactctgacttcctaatatagtagaactttttattgcaagcttgtatactttgatatgttttccaaaaataaaagtaaaatatacatagtaaattaggacttggctgttaaaaaataaacactagttcagtacctgttttgtttcaaaagtgagttctggttacaatttcaccttaataacatttctgacatctttgttgacattatcttcttttaataatcagtattctctcaatttaggtcattgattttagagaaactaaagcattagtatgcataatccagattatagaaagatccgtatttacattaagcagttccagggaagccacagttaatatgtaaactaccaccctcttccctgtaagtccttatccaatcatatattccacttcatctctctatcacctaggctgcagtacagtggcatgaacacaacttactgcagcctcgacctcctgtgctcaagtgatcctcctgcctcagcatcctgagtagctgggacaacaggtgtaagccaccatgcctggctaacatttgtattttttgtacaggggggtttcaccatgttgccagactggtcttgaactcctgagctcaagccacccacccaccctggcctccctaagtgctaggattacaggtgggagccaccatgtccagcccataactcttgacataaggcatctgctggtgcaaaatgacattcatttgtaaagaaaaggtaaacgttattaagtaggccctggatgacaccctcttatttttcaactgtttagtttgggatatggaaaggtaggtattagacataaaacattattttccctttcttcttggaaggtaattcttaattgctatattttttagtggttagtttaaaaaaatatatacacatacggagaatcttctaacagatcagcaacacccaagggtcaagctgagctttgccagttgtaccctgaatccccaatatgtgttacttcccttcctaatagtggcaactattaaaaatacgttgcaactcacccttaaacctgatctctaatgccacctgctgttgcagttctgtaagataaagaagctctacgaatctgccccaatattatatagcttgactttcactctctcatgaagaccagggtagttcactattaattatgcacatatttgtaaaataaaagtcaggtacttatctgactttgttagtatttactggctgggcgcggtggctcaggcctgtaatcccagcactttgggaggccaaggcagtcggatcacctgaggtcaggagttcaagaccagcctgaccaacatggtgaaaccgcatctctactaaaaatacaaaaattagccaggcatggtggcacacaactgtaatcccagctactcgggaggctgaggcaggataatctcttgaacccaggaggcagaggttgcagtgagctgagataacaccattgtctccagcctgggcaaccaagactgaaactccatctcaaaaaaaaaaaaaaaaagatttaccattacagctataaatgacagggcccctacttaccaaagcaaacccaaatttctgaaacagaaaaatagtccaaaaaagtggttttatcttttaatttttcctctaagaggaatcctactacaaagtaggaccacaaacttaaaaacaaacaaacaaacaaaaaaccaaagaaaaatcctaagaaaaaataagtatggtcatgcaattctttttgtttttttccactgcgcccggcctcattatttatattttcttactatttacctacagtaaagaactgtcaaattcttgttttacagcacaactgagaaaaccctgtgagacatcctaagtgtgcattttccctttattatttactttgtcccaaaagcctttctctttccagcaaattctgacaaagttgtcaacacctaattttaagcatgagcccttctttgcatattctcttgctcaccaccttctccaatgattctgcgattcacatatacactccgtatgtatttctatcatggcagttatcatgtcatagcacaatttttttttacagcacgtggaaaaacaaatcaaagaatgttgtgactctgcactagagactatgggcaaagttaagtgatataaaactgtaacctcctttgtgaaagtataaatcaaaatattagtccttttgatcagttattttaagtataaaaggcacacgaaagatacaaatttaagatgaaaatgtttattaagatgacaatgtttaaaattattaataatggtttcgtaactctgtatacacttaacatactgaatatactaaaaacactgaactgtacattttaaaaggataaattttacagtatttgaattatatctcaatttaaaatatatacattttatagaaaactgggctaacttaaaatagggtataatttaaaggaactattattatctagaaaacctaacacactattattatcattattttttattatactttaagttctagggtacatgtgtacaacgtgcaggtttgttacatatgtatacctgtgccatgttggtgtgctgcacccattaactcgtcatttacattaggtatatctcctaatgctatccctcccccctgcccccaccccacgacaggccccgatgtgtgatgtttcccaccctgtggccaagtgttttcattgttcaattcccacctatgagtgagaacatgcagtgtttggttttctgcccttgcaatagtttgctcagaatgatggtttccagcttcatctatgtccctacaaatgacatgaactcattcttttttatggctgcatagtattccttggtgtatatgttaatacactattattatctaacaaatacaaaggaaaaaaatccaaaacctaggtaatgtcataccaatttttttccaacaactctatttcaaaataattggaacttgtttgcagcactttaaaaactgccaggcaaataatctctaccgagcaagaactaaggcactattattatccatttttcttatttaagaaacaacattaggctgggcacggtggctcacgcctgtaatcctagcactttgggaggccgaagtgggtggatcacctgaggtcaggagttcaagattagcctggccaacatagcaaaaccccgtctctactaaaaatacaaaaattagccaggcatggtggcgtgtgcctgtagtaccagctacctgggaggctgaggtgggaaaactgcttgaacctgggaggtggagactgcagtgtggccaagattatgccactgaactgcctgggcaatggaccgagactccatctcaaataaaaaaaagaaaaagaaacattaatctaccagttatatagcattataaaattttaaattccaggacaggctttaagtctaatacttggattcatgtgggttttaataattctcagccgggtatggtggctcacacctgtaatcctagcactttgagaggctgaggtaggaggatcgtttgaccccaggagttcaagaccagcctggccaacatagccagactgtttctacaaaaaagaaaaatatttaactttatcaaattttgtttaaaaagtaataataattctccaaaaaaatcacttaggccaggcgcagtggctcacgcctgtaatcccagcactttgggaggccaaggcgggcaggccacctgaggtcaggagttcgaaatgagcctgaccaacatggagaaaccctgtctattaaaaatacaaaattagccagacatggtggtgcgtgcctgcaatgccagctactcgggaggctgaggcaggagaatcgcttgaacccaggaggtggaggttgcggtgtgccgagatcgcgccatggcactccagcctggccaacaagagcgaaactccgtctcaaaaaaaaaaaaaaacgcttcactgaaattcaaaattatttcttcaacgaactgcttcttaaatctattaagatggcatagaattttcttttctaaacagaaaaccatttttggactggaaattataattatggctataaattttacttgtaattcattgtgctcatgaaatccactcatctagactaaagtaacatcaaataaactatccaatgacaaaaatgttagtcaacaaagcaccaaatttcaatgctatttgactaatacgtaatctgctcatcataatcatgagacatggtataatgatatgaccaaatgcagtggctcacgcctgtaatcccagtatgttgggaggacaaggcaggaggatcgattcagcacaggagttcgagaacagcctgggcaacacaacaagacactgtctctataaaaaataaaataaaattagccaagtgcggtggcacacacctgtggtcctagtgattccggaagctgagatgggaggatcacctaagcccatgggagccaagactgctgtgaaccatgatcatgccactgcacagccttgggcaacagactgcctctttagaagaagaccgtgtctcttaaaaaatgttatgtatccaccatttgtgcatttttgccaagatgcctttgtgtacctcctcaactctgacttcctaatatagtagaactttttattgcaagcttgtatacttgactttttttttttttttggctaagcatactaaatgaactacaatcacgtattatgtaactccaaaaacggaattttctttaaatgctggaaagaaatgtaccattgctccatctccttttaagttactgtgtgataaatacaagtaaatattgtgacttccatctctactttcactttctaaaatactgctgtagaaaaatgaatgtaccattctgacagcttatgaaatggcagacaccacatgtaactgcatcaaagccaaacataaatttttagagaaaaattacaagaaagtttttctttccacttgggaggaaaaaagaaaacaggaaaacctgctataaaattaataatgagtccaagcatggtggctcatgcctgtaatcctagcactttggaggtcaaggcaggcagataacttgaggccaggagttcgagacatgcctagccaacatggcaaaaccccatctctactaaaaatacaaaaattagccagacatgatggcattcacctgtaatcccagctactcaggaggctgaggcacaagaatcacttgaaccccagaaggcggagattgcagtgagccaagattgcaccactgcactccagcctgtatgacacagtgagactctagtctcaaaagtaaaaataaaataatgaacattatttcttataaaacaatcaggggctttctacttagagcaatatgctacgctaaatactgtgaagagtcttctattacaacaaaataactcaaaccagcataaaatacgtttcttacactgctgcctcataggagtaagaagaagctccaacaggaccaaaagaaaagaataaaaagggctgacctaaataggcacaataatacagtgggtaagtgcatcaagtcatgcgctaggggcaaaatagagaccccaggaaaggtgtcagtaacgtaccctaactcctggaaaactaaagtcaaagcctctcaaagtagtcatcatcaaattaggctccaaattcaaccacagataaagatgaacaatatacaaactttataatcagccacattctagaaaaaaaaaattattttcactgaaattacattgtttataaattaataggcaaaagtacagggagcacactaaaatacaagttaggaggatggattagtcctacctataaaacaaaatacttaaaactgtatcatggtggccgggtgccatggctcacacctgtaatcctaatgatttgccaggctgggacaggaagatagcttgatccccaggatgatccccaggagttcaaggttacagtgagctatgatcacaccaccgcaccacagcctggttaaaaaagacaagactcagactcttaaaaataaacaaacaaaaaatgtaaataaacagaaacatcattgatactaaaaggaaaatcagactagaaccaagtacataaagaaattcagtgtatgacaaagcagcctctcaaatcagagaagtaaagatggacttcttaaaaatagtgttgaggccgggcttggtggctcacgcctataatccccagcactttgggaggccaaagcaggccgatcacctgaggttaggagttcgagaccagcctgaccaacgtgaggaaagcctgtctctactaaaaatacaaaaattagctgggcatgatggtgtgtgtctctaatcccagctactcaggaggctgaggcagaagaactgcttgaacccaggaggcagaggttgcagtgagccgagactgcaccactgcactccagcctgggcgacagagcgagactccatctcaaatgataataataataataataagtgttgggacaaccatgtagccatttggaaagagataaatttggaaccataactcataaaccataacaaactccaaatggatcaaggatttatatgttaaaaaacaaaacactacaaagatctgcaaaacaacataaggaaatcttttataaacttcgaaggaagaaggtctttctaatgacacgtcaaaaatccagaagccttaaaaagatttataaattacatcaggtaaaaagctaaatatttctgcatggcaaaataacataaccaaagtctaaagacaaataacaaactggaaaaagaaaattatatgctgggcgcagcggctcgtgcctataatcccagcactttgagaggctgaggcggacggatcacaaggtcaggagttcgagaccagcctgaccaatttggagaaaccctgtctctactaaaaatacaaaaattacccaggcgtggtggtgcacacctgtaatcccagctactcaagaggctgaggcaagacaaaagcttgaacccgggaggcggaggttgtagtgagccgagatcgcaccactgcactcaagcctggacgacagagcaaggctgcctcaaaaaaaaaaaaaaaaaaaaaaaaaattatataagccacatttccaagggctaaagaagttctcatagtcttgttatggaaaaatctttagtatatactatttaatagaaaaaagatacagagcagtaggtacagtgtgctactatttacattttaaaatggggaaagaacatgtatgtaggggatgcatactggtttgtaagtgcaaatatgtttctggaagataccaaagatagcaatgttggagttactcttctggaagtttctttgtaccaactttgattcccaacaatttattcttaatgtgatatgattctccaagcgaagatgaacctgaaaacacatttttttttttggagacaggatctcgctctgtcacccagactacccagctaaaattaagtcttgttttttaactaaaataggctgatggaagccacagtaaacatatacagaacaaaaattttcactgaaagtaaactgattagataattaacttttatatagcaaaatattacccagaaaaatgacacctgaacaaatctagaaattgacagttgaaaatcatgttattaacctaaaaattctcaacttttgaacctcaaatatgagtctgacattttaaaataaaaatttccaagtaataaaagtatgaaatatgacataacatactatgcattaaccatccatgatatgtgatacataaatcatcaagcagaataaccttttcttaaaggaaataaagaagacgaatatactgaaaatgtcttcaggtttccctttgtttgcaaaacaccaccacagttaagaactcactggaaccaaagtttatgcaaagaaacattagaacagtaatctaaatgtggcattctatttttgagtctaattcattagccatcttcactacactgaaactacaaaattcccacagggatcactgcagtttgatatacttaacaatgtttttctagattcaggagattctgaggttttattccctctctggagactttccaaacttcaatccactgtcaattattccttaacaaggtattacaattaagagtaggacacaaacaaatcaagattctttcatgaacaaaccaagactgtttcttgtttgtttgtttttgagacagggtggagtgcagtggcgcaatctcggctcactgcaacctccgcctcccgggctgaagtgattctcctgcctcagcctcctgagtcactgggactacaggcgtgagccaccacacccagctaatttctgtatttttagtagagacagagtttcaccatgttggccagcatagtctcgatctcttgaccttgtgatccacccaccttggcctcctaaactgctgggattacaggggtgagccaccacgcccggcaagattgtttctttcttttctttttgagatggagttttgctcttgttgcccaggctggagtgcaatgccgggatctcggctcaccacaacctcttcctcctgggttcaagcgattctcctgtctcagcctcccaagtagctgggattacaggcatgcaccaccacgcccggctaattttttgtatttttagtagagacagggtttctccatgttggtcaggctggtctcgaactcccgacctcaggtgatccacccgcctgggtctcccaaagtgctgggattacaggtgtgagccactgtgcccagccaagattgtttcttattctcttatttccctatggtcagtaaaggagaaaatactatcctttatcacaatcctttatcacaatctcaataggagttccagggctgcttcttttggagcactgaagataaagtagaaaggcaaaagatccgccaggcgcagcacagggcgtggtggcatgcacctgtaatcccagctactcgggaggctgaggcaggagaatggcttgaacctgggcagcagaggttgcagtaagccgagatcacgccactgcatgcaagcctgggtgacagagtgagactctgtcttttaaaaaaaaagaaaggcaaaggatcttagactttttttttttttttttttttgagatggagtctcactctgtgactcaggcaggggtgcagtagtgtgatctcggctcactgcaacctccacctcctgggttcaagagcttctcttgcttcagcctcctgagtagctgggggtataggtgctcaccaccacacccagctaatttttgtatttttagtagagatggggtttcaccatattgttcaggctggtctcaaattcctgacctcaagtgatccacccgcctcggcctcccaaagtgctgcgattagtcttatgtttaaaaaacaaaaaaacacatatcaagctgggcacagtggctcactggcacggtggctgacaccttgtaatcccagcactttggggggctgagatgggaggatcacttgagcccaggatttcaagaccagcctgggcaacataaggagcaacatttctacaaaatataaaaatattagaagtgtggtggcacacacctgtagccgcggcttcttgggaggctgaggcggtaggattgcttgagcccaggaggtcaaggtcaaggctacagtgagcctaatcacatcactgcactccaacctaggcaatagcaagatgctgtctcaaacaaacaaaactatagatatataataataaattataaatataatgagtaactcctacacattaggatggctataattttttaaaaatacagaataactgttaccgaggatgtggaagaaccagaatacttgtgagttcctggtgggaatgtaaaattgtacagcccctgtggaaaacagtatggtaattctttcaaaaaattaaacatagaattataatgccccagccaggcacagtggctcacatgtaaatcctagcactttgggaggctgagacagacagactgtccagcctgtccaggagttcaagatcagcctgggcaacatggtgaaacccccatgtctactaaaaatacaaaaaatgagccaggagtggttgtgcatgcctgtagccggtctactcaagaggctgagatggcagaatcatctgagcccaggaggtcaaggctgcagtgagctgtgattatgccactgcactccagccagggcaacaggagtgagatcctgtatcaaaaaaaaaaaaaaaaaagaattacaatgtccagcctgggtgacacagcgacacccaatctcttaccaaaaaaattgcaatacgaccaaaaattccacttccacatatatacatacccaaaagatgtgaaagcagggactcagatatttctacacacatgttcagcattagtcacaactgttaaaagctggaagcaataccagtggccatccatagatggactagattaacttatctagtaaaatactacccagaaaagtaatagctgaacaaatctagaaattaatagttgacaatcacattaacctaaaaattcacaaacagcttctgaatctgacatatccatagaatgaacaaaatttggtatatacatacactggaatattattcagccttaaaaacgaaagcaactctgacatactccaagatggacaaccttgaggacattatgctaagggaaataaggcagttacctaaggacaaatattgtatgattctacttatatgtggtaattacagtagtcaaattcaaagacagaaagtagaatagtggtttcgctaggggctgcaggagggagaatgaagagttaatagagtgtcagctggaaaatgtcaaaaaaagatccagagctggtgggtgggcatggtcgcacaaaaagtgcatctacctaatgccacaaaattatacacttacaaatggttaaaatggaaaaagttcaggttatatgcagcctaccacagtttatatatacggatatacatacatatacacacatttattttttaaaactatataattgttataaactataaataaaacaggtaatactggtgtaaaagtaactacagtttttgcactgttgaaatttgccacttgatattggaatacgttcttaaatgtggttatgttatatatcattttaatgcgcatttctcactttatgtttttttgctaatgattacttgctgtttattttatatttatatttatatttattttagactatggaaatgttagactaaaagcaaattcaagcgatcttcttatttgggtttaaaatgggtcataaagcagtggagacgatttgcaacatcaacaacgcatttggcccaggaactgctaatgaatgtacagtacagcggtggttcaggaagttttgcaaaggaggtaagagccttgaagataagaagcacagtggctggctgtcagaagctcacaacaactgagagcaatcatcgaaactgatcctcttttaactacacgagaagttgccgaggaactcggcaacttcaaccattctacagtcattcggcattttacacaccaacaaggaaaaatttctcagactgtgatgtgtgacaaaaagtggattttatatcacaaccggcaacaaccagatcagtggttggacccagaagaagctccaaagcacttttcaaagccaaacttgcaccaaaaaaggtcatggtcaccgtttggtggtctgctgccagtctgatccactatacctttccaaatgccagcgaaaccattacacctgagacgtatgctcagcaaattgatgagatgtaccaaaaactgcaatgcctgccgccagcactgatcaacaaaaagagcccaattcttctccaggacaacgcctgactacatgtcacacaatcaatgcttcaaaagttggacgaattggactactaagttttgcctcacctgacatattcaaccgacctctcgtcaaccagctaccacttcttcaagcatctcaacaattttttgcagggaaacagcttccacaaccagcaggatgcgtaaaatccttcccaagagtttgttgaatccagaagcacagatttttatgctacaggattaaacaaactgatttctttttggcacaaacttttattgtaatggttcctattttgattaataaagatgtgtttgagcctagttatgatgatttaaaattcatggtcaatggccggacacagggactcactcctataatcccagcactttggaagactgaggcaggcgaatcacctgaggtcaggaattcgagaccatcctggccaacatggtgaaacctcatctctactaaaaatacaaaaattagccaggtatggtggcaagcacctgtaatcccagctactcaggaggctgaggcaagagaattgccttaacccaggaggcggaggctgcagtgagccgagatcaagccactgcactccactccagcctaggcaacaaaaggagactctgccttaaaaaaaaaaaaaaaaaaaaaaatgcatggcccaaaactgcaattacttttgcaccaatctatatatacatatatatcaatataactcggagattagcctacatactatactagcatggattatggacagaaaactttatcctttgaggtagcctgatggcactttatcatcatcctttcctcttgtttcttacactgccttctatcgttctgttttcctcttcttttgtcttcctgctatagtaccagcaactactactttcagtatactagttgtttaagttcttctaccggtaaggaccactaaagaggttgcttgaccacattcaaaacactgtatgtaacctattcagtaatggccattgggagtttataattttaaaaatatgaaaaaaattatatataatatttcagtagacaaaagaacactattttcagtagctaactcactgaacagaaaataacctactctcatttcacagtaagtaaacctagtgtttcccaaatctgctggaatgtaagaaatacctgaggcatatattaaaatactgaattatctctgttggcagacgacacagttttatatgtagaaaaccctaaaacatcaacaaattgttcaagctaataaatgaattcagcaaagttgcaggatacaaaacctacatgccaaaatcagttgtggccaacacagtggcttacacctgtaatcccatcactttgggaggccaaggaaggagaatcattgaggtcagaagttcaagaccagcttgggcaaaacagcaagaccccatctctacaaaaataatttttttttattaaaataaacaaaaggaggctaaggcaggaagattgcttgagtccaggagtttggggctacaatgagcaatgccactgcccctccagcatgggcagcaagaccctgtctctaaaaaaaaattaaaattaataattaaaaaaactagttgtatttctatatatttacaatgagcaatctgaaaagtaaatttaaaacaattctggttgcaatagcatcaaaaaataaaatacacaggaataaatttaaggaggtgaaaggcttgaacaccacaaattttataaaatattgctgaaagaaattaaggaaatcttaaataaacaaaagacatcccacattcctggatttcaagacttcatattaagatgacaacactacctaaagtgatctgtagattcaatgtaatttctatcaaaatcccaacattattgtttaaagaaacagaaaaccccatcctaaaatccatatggaatctcaaggaaccccaaatagccaaaacaattttgaaaaataacaaagttggaggactcacactttctgacttcaacttactacaggccagccatgatggctcatgcttataatcccatcactttgggagaccaaggcaggaggatcacttgagcccaggagtttgaggctgcagtgagtagcgtagcctggatgacggagcaagaccctctctctttaaaaacaaacaggaagggcacggtggctcacacctgtaatcccagcattatgggaggccgaggcaggcagatcatttgagctcaggagtttgagaccagcctggccaacatggtgaaaccctgtctctactaaaagtacaaaaactagccgggcgtggtagcaggcacctgtaatctcagctacttgggagggaggctgaggcaggaggcaggagaatcacttgaacccaggaggcagaggctgcggtctcaagccgagatcatgccactgtactccagcctaggcgacagagtaagactccatctaaaacaaacaaacaaacaaacaaacaaacaacttactacaaagctacagtaatgaaaacagtgtggtacttgcagaaagacagacatatggaccaatggaatggaaaggaagagtcctaaaataaactctcacatatatggccaataatttctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacagggtttcaccgttttagccgggatggtctcgatctcctgacctcgtgatccgcccgcctcggcctcccaaagtgctgggattacaggcgtgagccaccacgcccggcccaataatttctttaacaaagttgccaaaaccattcaatgaagaaaagatactctcttcaagaaacgatgctgagaaaactgaatatcatgtaaaggaatgaagctggacccttactttaaaccatatacaaaacttaaatacaaaacggatcacagatctaaacataagagctaaaacgataaaaccctcaggaaaacatagggggaagactttcacaacattggatttggcagtgatttctaggctatgacactaataatacaggtaataaaggaaaaaataaactggacctggttttcatcaaaattgaaaacttttttttgcatcagaggacacaaaaggaaattaaaagactatccacagaatgagagaaaatatttttaaaatcctatatacagattatataaagaacctggacaattcaacaacaaaacacaattcaaaagtagtcaaataatttgaacaaacatttcttcaaagaagatacacaaatggccaataagcacatgaaaaattgttcaacatcattagttgttaagaaaatgcaaatcaaaaaccacaatgtgctacagcttgagaacgggggcggtgggggggcggtgggaggaaggaaagagagagaagggaaggaagaaaacaaaaggaaggggagggaagagagggggagaggcagagacagggagcaggagaggtagaggggagacggggagaggaaggaagaaagaaaagaaggaaggaatggagggagggagggagggaagaaaaattaagaaaacctcatgaagactcagagaaatcaaaaactcatgcattgctgatgggatatgaaacagtatagccactgtaaaagtgtacagttcctgaaagcgctaaataaataattaccgtatgacccagcaattctattcccaagtaaatacccaaaaattcaaagcaggaacttgaatagataactgtatggcaacattcactgtagcattactcacaatagccaaatagtggatgtgaaccaagattccatcaagagatgaatggataaaaaataaaatggtggctgggtgtggtggctcacgcctgtcatcccagcactttgggaagcagaggtgggcggatcacctgaggacaggagtttgagaccagcctgaccaacatggagaaaccccatctctactaaaaaatacaaaaattagccgggaatggtggcacacgcctgtaatcccagctactcaagaggctgaggcaggagaattgcttgaaccctggaggcggaggttgcagtgagccgagatcgcgccattgcactccagcctgggcaacaagagtgaaactccaactcaaaaaataaataaataaataaataaaaataaagtggtatatccacacaatggattattcagccatgaaaaggaatgaagttttggcacatgctacaacatggttgcaccttgaggacattctggtaaatgaaataagccagacacaaaataacaaatattgtatgattacacctatatgagttagctaggataggcaaatttatagttgctaaaagtacattagaattttttggggggtgagatggaatttcgctttcattgcccaggctggagtgcagtggcgcaacctgagctcactgcaacctctgcctcctggattcaagcgattctcctgcctcagcctcccaagggctgggattacaggcacctgccatcatggttggctaattttttgtatttttagtagagacggggtttcatcatgttggccacgctgctctcaaactcctgtcctcaggtgatccacctgcctcagcatgccaaagtgctgggattacaggcgtgagctaccacgcccggcaagtacattcgatattaccagtcgctgcagacagaagaaatggaagacattatttaatggttatggagttttaatttgggataatgaaaaaggtttagaagtaaattattttggctgggtacagtggctcacacctgtaatcccagtactttgggaggctgaggtggctggatcacctgaagtcaggagttcgagaccagcctggccaacatggtgaaacctcatctctactaaaaatacaaaaattagctgggtgcggtggtgggcgcctgtaatcccagctactcagggggctgaggcaggagaataggagaatcgcttgaacccaggaggcggaggttgcggtgagccgagatcgcaccactgcactccagtctgggcgacagagtaagactccatctcaaaaaaaaaaaaaaaaaaaaaaaaagaaagaaagaaatgatttcacataaatttttaaagctaataatgaaataccctaaaaatcactgaatttaaatgggcaaactgtatggtatatgaatcatatctcaataaagatttctcttttttcggtcagacacagtggcttacacctgtaatcccagcactttggagttttgcctttaaaaactgcataaataggccaggcgtggtggctcatgcctgtaatcccagcactctgggaggctaaggtggacggatcacctgaggtcaggagtttgagaccagcctggccaacatggtgaaaccccgtctctactaaaaacacaaaattagctcggtgtggtggtgggtgcctgtaatcccaggtactcgggaggctgaggcaggagaactgcttgaacccagaaggcagaggttgccatgagccgagatcacaccattgcactccagcctgggcaacaagagcaaaacttaatctcaaaaaaataaataaataaaattttaaaataattttacaagtacaaatacatacatggttatgctattaacttacatctttgacaagccttggggcttattttaaggctcacaaaaacaaactatctggaaataacatagattaaaatcaaactcccggaaatacatatataggataaaaattaatagggaaatgaaaatattgtcaataaccacatattgttaggaattctacttactcgttttgaaggacagtgttcattcttttcatccgtcatctttccacttttaagtgctttccttgggtgcttaatagttgtttttatggcaggtcgacatacatagttctccaagttctttggaggttttttagttctcttagcctggaggccaattttcaattttaaatttccctctgaaaagtttgtttctttcactgaaaactgttgctgtgcatcagtcaaaccatcatctttcccagcttcgatgtttctttctcgattccgtttgcgaaggtcctcttcctcctttgtgtttttttctagctctacttctctcttactgaccaatgtgccagtactgatggcagaaggactctttcttgaaaaaccttcggaatcagaacccaatcctaacatagcagtatttctagggtccatcacaagcgtatgttattgccaaggaatcttatgaaaattttacagaactgtgttccataaaaaacaaggatctccaaaactcgaaaccagcatctttctctgcagaacagatcataacaaaaatttatcagaaaagaggcaactactgattaacataagtaatgggtataggggaagacaaggaggtcaacaactacccaaaaaaaaatcacagttagatcgaaatgttaattcaaaatagatgtaaatccatttagttataaatacatttaaaattcagaataagtttatcattctacagatatcataaacaagccatagtggtatggtgcaaatgcaaatttaagaatcaccaagaagcttctgaaacttacagtcaagcaaacattgcctaaaatcaaaataactttcatatattttcgcactcatcagttttaaaagaatatattccccactcttctgctgaagtacacttttatttcctacagttttattgaaggtaaaaaatcatctttttttgatactccattgactatgtgattattacacattgtatgcctgcatcaacatatcacgttcaccccataaatatttaaacacgctatgtacctataaaaattctttttaaattatctcttaggctggtttcagtattccaaacttttagaagagattatcaggctttttgaggttaggactctctgatgcaggaacttatgcagatattatctttgttgttaggatacaattcaactctgaatcattcacttgtccattcaaaaaatatttccaaacatctatcatatgccaggcatcatgctacactctgaaaatacagtattcaacaaaatgaacccagttcctaaattttaaggtttatactctagtgagaagggcaaacattaagcaaatatttatacaaataatcactgttgttataagaaccttaaaaatcagcaatttatttttacaagttttcctaatagcaaatagtaggcatgtgtcaattccccaaatacacaaaatgttttaaaactagcgtgctaatttattattttacaataggtgatacacctaatctcagaatctccacaaagcactcccattttaaatataaagatcctcaggaaaccagattaccatataatcattagggagattagtgaattttttttttttttttttgagatggagtctcgctctgtcgcccaggctggagtgcagtggcgcgatctcagctcactgcaacctgcgtctcctgggttcaagagattctcctgcctcagcttcccgagtagctggcattacaggcacaagccaccatactcacccggctaatttttgtatttttagtagagacagggtttcaccatgttggccaggctggtcttgaacgcctgacctcaggtgatccgcctgccttagcctcccaaagtgctgggattacaggtgtgagccaccgtgcccagccagagactagtgaatatattaataaaaccaaaacaaaacaagtcagtattcttgaagactgacagactagtcttcatgtcaaacatatgtctgagtcaagatctagaactagtatctggaaaacggagaacatcttatcccttagaaagttccatttatgaagtagaatattttaaacgatgtgccctgagacttttcattacaacaagagagtaagattcctggccaggcatggtggctcacacctataatcccagcactttcagggactgaggtgggtggactctttgagcccaggagtttgagaccagactgggcaacatggcaaaatcctgtctctaaaaaagtacaaaaattagcagggtgtgatggcacacacctgtagtcccagctctcaggagactgaggtgggagatcacttgaaccttgaaggtcgaggctgcagtgagctgtgatcaagccactgcactccaacctgggcaacagggcaagaccctgtctcaagggaaaaaatagttgtcttatgacttctacaaggaatgtaagtaaaatacctcgcccaatgactggcacatagcgagggctcaataaaaggtactggccgggtatggtgtctcatgcctgtactctcagcaccttgcgggggccaaggcaggtgcatcacttgaggtcaccagttcgagtctagcctggtcaacatgtcgaaacccgtctctactaaaagtacaaaaatcagctgagtgtggtggcaggtgcctgtaattccaactactcaggaggctgaggcatgagaatcacttgaacctggcaggcggaggttgcagtgagccaagatcatgctattgcactccaggccaggtgacagagcaagaaaaaaaaaggtgccaataatttagtagtagtaggagcagcagcagtgtttataagtactcaacaaattttggccgattgggtaactccttagcttgttattgctccattcaatcatataaacagctggaaaactaatcttccaatcatttcactctgatgattcttgtctaccatttcatgtattaacatttcacaatggcattcaaggcttttaataacctcactctcctctaactattcaaacttatctttacttcccaacacacacccactatcatttagtcaattcagttttctttactgtccctaacaaatcatgttcatttctgcttatgtgtcatataaacatacacactctccctttaaacatacaaagtaggctgagcatggtggctcatgcctataatcccagcactttgggaggctgacggggcggatcaggaggtcaggagatcgagaccatcctagctaactcggtgaaaccccatcttttaaaaaaaaatacaaaaattagccaggcgtggtggcgggtgcctgtagtcctagctactcggaaggctgaggcaggagaatggcgtgaatctgggaggcagagcttgcagtgagccgagattgtgccactgcactccagcctgggcaacaaagcaagactccgtctcaaaaaaaaaaaaaaaaaaagtacaaagttagctgtgcacagtagctcgcacctacaatcccagcactttgggagactaaagtgggaggatcgctttagcccaggagttcaaagccagtatggacaacacagtgagacctcatctctacaaaaataaaaaataaaaaattagccaggtgtgtggtgtcatgtgcctataatcccagccactcaagaggccgaggtgggaagatggtttgagcccaggaagttgaggttacactgagccgtgattgtaccactacactctagcttgggcaacagaacaagaccctgtctcaaaaaaacaaatacataattagggaagggagaaaaaataaataataaaatgctgtgtataaaaagtaattaaaataacccaaatgtttttttaaaaataaataataattttaaaagttcaaatcctgcctgggcacggtggctcacgcctgtattactggcactttggaaggctaaggcaggaagatcacttgagcttaagagtttgagaccagtctagcaaacacagcaagaccctctctctacaaaaaataaaaaattagcccagcatggtggtgcacacctatagtcccagctactcgggaggatgaggcaagaagatggctggagcctaggaaatcgaggctgcagtgagccatgttcatgccactggactccagcccgggcaacagagcgagaccctatctcaaaaagtaaattaaaaaaataaactctaaaacaaaaaataaaaagtacaaagtcctatcttctccatgatgggctcacaatcctgaagtccaaaaaactctgaaatccaagttttttcaaaacctagtgataaaacttgacacggacccattttagtcttaattaccctaatttccatgaataatgataaattacaatgcagaagtattaatgggcttgattaagttagtaaaggatgctactactcccaaacaccactgtgccagttcacccaatctacatttctaaaagccaaaaaaaaaaaaagaagaagaagaaaaataagaaaaaagaaaaacgtgtaacacttgcagggaatttttttaaaaagaaaaaaacttacggcaccaacatttgggtaatggattctagacctatgttctcagacctatatttaagcttgcactgacctgatccatccctgaatatttatgatccatataagatcacaattagggcaattaacttttttcttgttctgtatttgtcagctatacccctcaacagattaagtcctcccacctcccatcccaccccctcagataccaaaatctgacgatgctcaagtcacttatataaaatggtatggtatttgcatacagcctatacacatgctcctgtatacttgaaatcatctctggattacttataatacctaacataatgtaaatgatatataaatagttattaaactgtactttaaaattttgtataattttttattattgtattgttatttttaattttttctaatatttttcatccgcagttggttgaatccacaggtgcggaatcacagatagggaaggccaactgtataattaaaatataagcttcatgaggataggaacctcttctggcttgctcaccactgtaaccccagcagctgaaacaatgaatagcacaaattttagtacccaataaatagctgaataaatgaatgagtgaattttaaggttcctgtaacttctaatacaatgattggcatgtagcaaatgtcttttttcctgttttacataactttatcttgtgttacaatgagaaaactatacacaagttttttcttaatatgtttatatttcacataggtggttttctgtaaatttactaaaatatcctaatttcagcactaacatacttccaaatcatattttatacatcttctgtctctgtaccatcacagctagtctaagaaaaacaataacactcaatgatctcattttatattcctgaccactaactccgagtaagcccttggtgctgccaatacacttccctaatctattccctctaccactctcctaaaaaactatttcatcccatctcccctttcttcattgtccctaattttgcttcctatctgatcacagcagtagtcagataggaagcagtaacaaacagaaaagtgccacaagtgcccaccatatatctacctaccttcctacctgtgtctgttcctatagtctgactgccttcctatcacaatatataaacgatctctcctttcaacctcttcatttaggcaactatctcctttctctctcacatcatccatttctcatatttcctctgaataatgccaataagcctgaaaacaaaaacatactataatatctctcatggaagaaaattcctcttagccgagcaagatggctcacgcctgtaatcccagcagttgggaggccaaggcgggcagacctcacttgaggtcagatactcaagaccagcttggccaacgtggtgaaaccccatctctaccaaaaatataagaaattagccaggtgtggtggcgcatgcctgtaatcccagctactcaggaggctgaggcaggagaattgcttgaacccgggaggcagaggttgcagtgagccaagatggtgccactgcactccagcctaggtgacagagcgagactccgtctcaaaaaaaaagaaaaaaaaaaattcctcttgactccacatcctccaccatcttcccatttctctgttcctcttcacaacaaaattgttagaattctctatattgtctattctccctgacctccaatccttgctttttctcttgaacatactgattatactttcactgccacccctccatagaaactgctagtcaaggtcaccaacaacctccacattgctaagaagaatgatcaattctcagtcctctcatcttacctgacctatcaacagaatttggcacagctaaacagctccctcgctacctcacttgacttacgggatacctttttttttttttttttttttttgagtcaaggtctctctctgtcaccctggccagagtgcagtggcacaatcatagctcactgcagcctcaaaatcctgggctcaagtgattctcctgcctcagaccccaagtagctattccaagtagctagaaatacaggcatgtgccaccatgtccaattttttttcactgttttagagacagggtctcactaggttgcccaggctagtcttcaagtcctggcctcaagcaatcctccgacctcagactcccgagtagctgggatgacaggcatgagtcaccgtgcccagctctgggactcctctcttgattgttcttcctcactggctactaccctctgtctcctttgcaggttctttccttcctccatgacctttaaatactggagtgacgcagggtacccggacctcttcctttttctatctacactcagttcccaaatgaccagatccagtcttacggctttaaatttcatctaacattgatgattcacaaatttctatcttcagatagagactagctgagacctctttctggaacttcagattcacatatctaaatgcttacttgacatactgactggattgtgtaatagataggcacttaacatgtttaaaatcaattcatctttgcccactgccccaaatctattcttcctacaggtttcatttcaaaatatggtaattccaaagagaaatatttaggccaaaaatctctacccatccttaattgctttttctctcaaacccctcatgtccatttggtcagctaagtttgtcagctttaccttcaaaatgtatgcagaatctaaccagttgtcattactctgacagctattagatccaagtgatgataaatatgtgaatggattattgcaatagctttttttttttttaaagaaagaggtttatttaaaggaattgctcacatgattatggaagctggccagtcccaaaatctgcagggtgggtcagtggcaggctgaagacccaggaagacccaatgttttcattctgctggcagacttgcctcttactgaggagaggtcaatcttttgttctgttaatgccttcagttgagtagatgaagttcctccccaacattatggagggtgatctgcttaactcaaagtccattgatttattgattttttaatatatttaacttttattctaagttcaggggtacatgtgcaggtttgttacgtgggtaaacttgtgtcatgggggtttatttcatcacccaggtattaagcctagtacccattagttatttttcctgattctctccctcttcccaccctccaccctccaataagccccagtgtgtgttgttcccctctatgtgtccatgtgttgtcatcatttagctcccatttatatgtgagaacatacagtatttgattttctgttcctgcactagtttgccaaagataatggcctccactccatccatgatcctgccaagtacatgatctcattttttttttgtggctccatagcatttcatgatgtatatgtactacattttctttatccagtctaccattggtgggcatttaggttaatcccatgtctttgctattgtgaatagtgctgcaatgaagatacgcatgcatctgtctttatgatttatattcctttgggtatatacccagtaacgggactgctgagtcaaatgttatttctgtttttaggtctttgagggatgaccacagtcttccacaatggcttaactaatttacactcccaccaatagtgtataagcactcctttctctctgcaaccttgccagcatctttttttttttttttttgactttttaatagccattctgaatgatgtgagatggtctcactgtggttttgatttgcatttcttgaatgatcagtgatgttgagcttttcctcatgattgttggctgcatgtatgtcttcttttgagaagtgtctgttcatgtcctttacccactttttaatcattttttttctcatagatttgcttaagttccttacagatgctgacattagacctttgtcagatgcatagcttgcaaaatgcaacatgcttctaactggttccttgcttcaaccctcatatctcttccagtcttctcaattcagttgcagggtgatcctttcaaagcctgattcagatcatgtcactcctctgctcaaaaccctttcgtaggcttcctatctccctcaaagcagaagccaaaattttttaaatggtctaaagatccaatttaatttgtcctaaagtcctctctacctctcttccatcgcctaccagtctcctcacttagttccaagaaggaggtacaaaagtttcccttctggtggagattgcagtgagccgagattgcgccactgcactccagcctaggtaacagagcaagactctgtctcaaaaaaaaataaaaaaaataaaaaaaaaagaagtttcccttctgtttctcaaacacaacaaaaatactctttaccttgggacctttgcacttaccattccgcttgacagaacaccctttccccagataattgcatatcttgctctttcacttccttcgtatctttgtctaaacgtaattttacagaagaagcatttcctaaaaaaaacacctatccccccaccaccctctactcacattcagtatcctattttattctcatactcttcttaccacctggtgtactatatatttgttgtgtacatctttccattgaaatttgaactctaccaggaaatagacttatcagtttggttcactgctatatcccagcacgtagaacactagctggcatatagtaggtgttcaataaatatttgtagaattaattccctgacttatgtgggttatattttacgagcttcaaattgtcccctttctaggccgggctcagtggctcacgcctgtaatcccagcactttgggaggccaaggcaggcagatcacttgaggtcaggagtttgagaccagcctggccaacatggtgaaaccccgtctctactaaaaaaaaaaaaaaatacaaaaattagctgggcatggtggcacgctcctgtaatctcagctactcaggaggttgaggcaggagaactgtttgaacacaggaggtggaggttgcagtgagccaagactgtgccactgcactccagcctgggtgacagaccaagactctgtctcgggaaggaaaaaaaaaaatcaaaaaaattagctgggcatggtggcacgtgcctatcgtcccagctacccaggaggctgaggtgggaggatcacctgagtctaggaggtcgaggctgcagtgagccatgatcacagcactgtactctagcccgggcaatcaaacaataagctgggtatggtgggacacacttgtagtcctagctactccagaggcactccagcctggccaacagagtgacactctgtctcaatcaatcaatcaatattaaaaaattagctgggtgtggtgggacacacctgtaggcctagttactctggaggctgagatgagaagatcacttgagcccaagtgttcaacactggagtgagctagaatcgtgccactgcactccagtctgggcaataaagagagacccccatctcaaaaaacagatgtaacaaaaaacccacaacattttacaatttggaaaaaaaaaaaaagaattgcttttatattcattactcacaaatgcatacattttaaattttcccattacaatttttgtaatgaaagaattccatgtcttaatatgtataactgcaaaatttatatgtataaatgaagaatttcagcatttttccaaagaattctttttttttttgaaacagagtctccctgtcacccaggctggagtgcagtggcgtgatctcggctcactgcaacctccgcctcccgggttcaagcaaagaattcattttttatctgcacttaattccctttcaaaacattacagagaaaggtctgacagaaacatgattctcattttaaaaatgaaaaaaaattataaaacttaatccaagtgacacatattattacataaatagcagagtaccaataaactgaaaagagatttgaaaacatttatttccccccctaaaaatgtatatgagaagagagaaatactacatttccctaacatgatcaaggagaaaaacgaacagtatgcttacaggcatattttgagaatccatttaggtagtaaaactggaaaatcatgattggcaaaccccacataccaaatttaagagtttctagtcaagataaacccaaattctgaagatatttcacaacagagtgctttttatctgctgaatgtaaactgcttgaaaaacagtccctacagcagctgccagaatgctgttttttgaactttcaaagcaatgttcattgagaatatcattctttcagcttttggaaaaatatctaaacaatctaggttttccatccaggggcaaggatgccatgttgtaacacaacttattttggtttctactacaatatattcaacttaaaatacatttccaaggaaaaacacagacctaagattgctagaatctcttcactcaaacaggcaaactcaatattcatctcacatgcaattttgggatttatgttttcaaatctctggaacaatgtgggacagtctggtccaaattcaaaggaaagtaacactgtacctacagcattaaatacttttgcacaaatcattacagcattaagtaaactctttagaaaattactaaccatatgttttttaaaaaggaaattactaattatattaataggacatatacattgtataaaaacaaagtatgataatctaacaatatgttaaaaactacctacaaatttacaaatacatattctctacaaaatgaagacctctatccaccccaacacctgccattctaatcccacatccaagtaacaaacagtggatctgataaaaattaactaatacactgttattaatatagtggtctgggctgggcgtggttgctcatgcctataaatcccagcactttgggaggctgaggcgagtggatcacctgaggtcaggagttcaagaccagcctggccaacatggtgaaactccatctctactaaaaatacaaaaattagccaggtgtggtggcaggtgcctgtcatcccagctactcaggaggctgaggcagaagaatcacttgaacccaggaggcacaggttgcagtgagccgagattgtgccactgcactccagcctgggcaacagagtgagactctgtctcaaaaaaaaaaaaaaaattatatatatatatatgcacacatatatatgtgtatatatatgtatatatatatgtatgtatgtatatgtatgtatgtgtatatatgtgtgcatatatatgtgtgtgtgtgtatatatatatggggggagagagagagagagagagtgtgtgtgtgtgttggtggcgaaggtctggtctgagatacagaactactctggaagacaactatgtttggaaatcattttatatgtaaataccccatctattttcaggggtagaaagggaatagccatgctttgatggaacactattcagcaaaacaatataaaatcaaccaaattttttaaagtactacaaatgagtcctcacagtgaatttagcatcagtaaaagtaataaaatacttactgagttcttagcatgtacaaagctctatgccaaatgttttacatatattatctcatttaaggctcacaatcagcatgcggtagttactattattattccctttttagacatgaaaagacaggctaatggccaataaaaggcagaaacaggtctgtttcgctcctcttaaccactatgctttgctgcctcccaaagatcatctttaggctgggcgtggtggctcacacctgtaatcacagcactttgggaggccgaggcgggtggatcatgaggtcaggagtttgagaccagcatggccaatatggtgaaaccccgtctccacttaaaaaaaaaaaaaattggccaggcgtggtggtgtgcacctgtagtcctagctactcgggaggctgaggcagaagaatcacttgaacctggcaggcaaaggttgcagtgagcccagatcgcaccgctgcactccattcagcctggatgacagagcgagactccgtctcaaaaaaaaaaaaaaaagaaaagatcatctttagtctcgatcttattatttctctctgctacatttggcatatttgctacgtttgaaactctttggtttctatgatacattctactggttctcccaacacctctccaaccatttcatcatttcctttatggattcatcattcttaatctattccttcattcattcaacaaatgttttctgagagcctcaaaatatgttttgagaattgtgacacacactgtagataccgtcatgagtaacacaaacatggtccttggtctcatgaactttaagtgctttctttcctttaaatttttttattattatttttatttatttatttattttctgagagttcccagctgcttgagcccagaaggtcaaggctatagtgagccatggtggtgccattgcactccacgctggaaacaggccgagatccaatctcaaaaaagaaaaaaaaaaaaaatttggaattcacaaagaaggtattaaagggctctgagaaggacaataacaagatacaagcctacattttgagaaacatctgtttgctgaggaaggaagattattccaaagacagcaaaagttggttctggaataccagtcatatcagcatactagattaggatggtaacaatggaaatagagaaaaacgggtggatttaagagacatgttagatatttgtcaatataatgtgagaggatgagggtggaaaaaactgaagacttgaccaaatggtaaatggtatggtggtaccatttggagactcattcaacaaatatttaccaagttatatatcaagaactggagatacaatagtacaaaatatagacaaaaacccttgctttgtggggccaatattctagaagtatgccaggatgagacagaaagggaagatcaaagggttcagtaataagtacattaaattttaggtacctgtgaaacatttaagtggaaagtcaaagagagagctgaaaatatatgtatatgctatatacagagggaggcagtgtaacaacatacaaatgaaaaagttaacggaattttataagatttttagcctggaagaacaatgaagaacaattctttttctttttagataagtaaacctatttaaaattgccatgttatagattaaacaatgcaggtagattgttagcttaaaacaagtaaaatctggccaggtgcggtggctcatgcccataacctcagcactttggcaggccaaggcgggtggatcacctgaggtcaggagcaagaccagcctagccaacacagtgaaactcttttctctactaaaaatacaaaaattagcgggacatggtggcacacgcctgtaatcccaactactcgggaggctgaggcaggagaatcgcttgaacccagaaggcagaggttgtggtgagccaagatcgtgccattgcactccagcctgggcaacaatagtaaaactccatttaaaaaaaaaaaaaaaaagtaaaatctaacttgtcttatctgaggattttttttttttttaagactgggttttgctctgttgccaaggctggaatgcagtggcatcttcttagctcactgcagcctcaaactctggagctcaaatgattctctcacctcagcctcccgcgcagctaacagggggcaagccaccatgcctgctcatctacaaggaatttttgttttcctttgtgatctttattaaacatggctagagactttttatttctaaacattacaacattatttcttaacattaaaaaccagttataggctgggtgtggtggttcacgcctgtaatcccaacactttgggaggccaaggcaataggactgcttgaactcaggaacttgaggcctcagtaagctaagaaaatatcactgcatttcagccttggcaacagggcaagaccccatctcttaaaaaaaaaaaaaaaaagtataaattagcgacacaagattttatttaaaaatgtatagcacattaggccaggcatggtggctcacacctgtaatcccagcacttgggaggttgaggcaggcagatcacccgaggttgggttgggagtttgagaccagcctgaccaacatggaaaaacactgtctctaataaaaatacaaaattagccaggcgtggtggcgcatgcctgtaatcccagctactcaggacgctgaggcaggagaatctcttgaacctgggaggcagagattgcagtgagccgagatcgtgccattgcacgccagcctgggcaacaagagcaaaactccatctcaagaaaaaaaaaaaaaagaaaaaaatttatagcacattattcatttaaatttgtgctgggcttcagactctttaaaatttccacagataaccatcatatttcttaggatatatcaaactagctaagtaatcacatacccaggaaatggaggttctagtcaagccaaaaagtaagtgcgaaggtcttgaggtggaagtatttttgttgtgtttcagaaatagaatggagacctttgcccaacccggcttcctggaactgaatgagtacgcagactgagagggcatgcaggacttatacagagggccttgcagacttataaagactttagcttttactttgagacaggaagccatcaaaatggttttaagaaatgacatgatctgactcaggccttgaaaagatcatctgctactgaattgagatgacaaatttttggcctaataacttgttatcatccttgactccttcctttatctcaaatcctacacacgcagtctgtcagcaaaatctgtcagctttaccttcaaaacatatgcagtcatttctcactactcaacagctcccatatatgaatacgctatgtctgtcaaaagtagaacccatgcttttaatacttctacataatgagggaggctaatccaggatgactgctcaagcccagaagttcaaggctgcagtgagctatgatcatgccactgcactccagcctgggtgacagagtgagaaccagtctctaaaaaaagttaaaagaaaaaagaaagaggccaggcgcagtggctcatgcctgtaatcccagcactttgggaggctgaaatgggcagatcacaaggtcaggagatcgagaccatcctggctaacatggtgaaacctcgtctctaccaaaaatacaaaaaaaaattagccgggcgtggtggcgagtgcctgtagtcccagctacttgggaggctgagacaggagaatggtgtgaaccctggaggcgaggcttgcagagagccgaggtcacaccactgcactccagcctggcgacagagcaagactctgtctcaaaaaaaaaaaaagggaaaaaagaaagaaattcaacacagaaaggcaattatttatcaaatgttatcaaacaaacccaaagaagtcaaaactccctaaaacatgcctgcagtgcatttgctgcctagagtttaaagctgatagactttaagattaagaggtaatttcaagggattaaatattacaatgattatatctgaaaaccaaaagcttgggcattattcactcactgaaacgaatttaaagaaacaaacaagaagagtatttgggtatcctgggagtgtttttcaaactccactaacatttatctatcttagtcctactaggcgccatacactatgccaaagtggtttcacttattgtctcatttgtttcattctgacaataatcttattagatttaactaatcacattttatagatgggcaaacaggcttcgaaacgtgattaactctaagactgtaaaattagtaaatagaagaacttggattgaatgtaatcttctcactccaaatctactacaggatatccatctgcaagaaaagaactcagacccttacctcacatcatacacaaaaattaactcaagtggatcacaaatctaaattcgaaaacgaactataaaattcctaaaagaaaatgtagaaggaaatctttgtgactttgggttaggcaaaatttcttagatatgacagcatgattttttttttttaaaaaaagctggtaaactgaacttcaccaaaactataaacttctgtccttcaaaaaggcagtactaagaaaatgaacacaagacacaaactactacaggttactgtgatagtacacattcctgccacctctctggaagccactcctgagtcttatctgctgatctgatttggcctaccagacttccagatgttggaattccttaggttcagtcagtcttttctttctctaaaatattttggcattttttaaattttttaatttttatttattttttatttttatttttggagatggagtctcactctgtcacccaggctggagtgctgtggcaccatcttggctcactgcaacctctgcatcctgggttcaagtgagtctcctgtctcagcctccaaagtggctgggactacaggtgcgcatcaccaggccaggctaatttttgtatctttagtacttatattttgcattttggagatggggtttcaccattttggccaggttggtcttgaacgtctgacctcaagtgatctgtccacctcagcctcccaaagtgctgggattacaggcatgagctatggcacctggcgtttttttgtttgtttgtttgtttgtttgtttttgagatggagtctcactctgtcacccaggctggaatgcaatggcgcaatctcggctcactgcaacctctgccttctgggttcaagcgagtctcctgcctcagcctcccgagtagccgggactacaggaacgcaccaccacatccggctaattttttatattttcagtagagacaaggtttcactatattgaactcctgacctcgtgatctgcccgcctcggccttccaaagtgctgggattacaggtgtgaaccactgtacccagccttttttttttttttttttttttaataaagacggctctatcatctggcctggggtacagtggcataataatagcttactgcagcctccaactcctgtgctcaagggatcctcccacctcagcttcccaagtaatagggaccataggcatgtgccactgcacctggctcctactctagattctttccctgtgtaatttattatactacttaagacttttaagctccagacagtatatctgaaacctggttcaatatctttacaaagtttaatcctcctccaatctttcccatttcagtaccaccaattgctcaagtcagagctactactagtcaaactactacaggttactatgatagtacacattcctgccacctctctggaagccactcctgagtcttatctgcagatctgatttggcctaccagactcccagatgttggaattctttaggttcagtcagtcttttgcttctctaaaatcttttggtatctttttaattttttaatttttattttttattttttgagatggagtctcactctgtcacccaggctggagtgcagtggcactcatcctgactattctcactcccttattgtcaaccttcaacctaacaccaaaacttctgaatgtcacataaataatctgtgattacatagagttcctctccaattctcccactgacttgtccaaaaaaaccaacaattctcacccagaatatagcaacagccctctaacttctttgtacatctaccttgctctcctccagcccaagctacatccagaaaggtgttttattttatatatatatatatattttgttcttgttctttgagaaaaaatcttgctctgtcacccaggctggagagcagtggcacgatcatagttcactgcagtcccaacctcctgggcccaagcagccttagcctcctgagtagctgggactacaggcacacaccaaccatgcccagccaattttttatttttgtagagacagcatcttgctatgttgcccaggctggtctcgaactcctgggctcaaacgatcttccagcctcggcctcccaaagtgctgggaatgcaggcgtgagccactagagattgtttttctcaaaggcccagtggctcatgcctgtaatcccagcacattgaggccaaggcaggaagatcgcttgaggccaaggcaggacgatcgcttgagcccaggattttgagaccagcctgggcaacacagcaagacctcatctccactaaaaataaaaaataaaataaaaaatcagctaggtgttgtggcacacccacctgtagtaccagctactcaggaagctgaggtgggaggattccttgagcccaggaggtcaaggctacagtgagctatgattgcaccactgactccagcctgggtgacagagcaagaccttgtctcaaaaaaaaaaaaaattctgataatgtaatttccctgcttaaaatctttgaatgttttctcactgcccttcatatataaaagtccctaatcacactcataacttgcaacttacaatctgcagcatggtttggtggttaagaatatagtctctgaagccaaaacacagtctcagaagctagtcctgctatattaattttgtgcaaagtactcacggcctcagttctctcaaatgtgaatagaaattgttgtaagggttcaataaactaatatatgaaaagtacttagaacagcacttcacagtatcactgtttactttttgttgttgttaactgcccctacatatctctggcctcaccattccccacactgttgtgagcagagcaagagcaaataaccaccaccaaaaaaaagcaagcactcagctgggtgcagttactcaaacctgtaatcccagcactttgggaggccaaggcaggcagactgcttgagtctaagagtttgagatcagcctggcaacacagcaaaaccccatctctacaaaaaatgcaaaaattagctggatatggtggctcatgcccatagtcccagctacttgggaggctgaggtgggaggatcgcttgagcctgggaagtcaaggctgcagcgagctaagatcacaccactgcactccagcctgagtgacaacacgagaccctgtcttaacaacaacaacaacaggaaacaacaaaaaagcaaacactcatacatctgtgatacatgtgtttgaagcacttttcagttcccaaataactgttttccctcctttagaacatacagttagttctctctgcctggaactctcttccagcatctttccatatgactacttctcttcctttccatcttagtttaaaagtcattccctcggggagacatttcctattcccctagacttgggaggctgaggcgggaggatggcttgagtctggcagatcaccctgctaagtgcatatccatactataagtctcttaatatgcattataccaattaagttatttaatatccatatcttccactagaccatgcattacatgagaataaaaatcctgtttgctgtattcactgctacatccttagcaaagcacctagaacataaagggcattcaaaaaatatctattgaatgagtaaacaaacattaattctacattttaaaacgtgtatatagataaaagagaataggcaaaatgaaacttaaaatattaaaaattgatatttttctttaaatattatataaatttttcagtttctataatttaaaaaataagcactatatacaccatgtaatgtgctttccaaaggtaaaagagtaacccatgccctaattagtttgaagatattttacatgaaactactaagtcactaatattatataagtcactaaaatcacaaaaaaattagaatagcttcatgaagttaccaacaaaattggaagcaatttctacaatataaactatacttacaaagttagacaaattttttactcaactatagaacccttcactgaaaagatgacaatcagtaaccatttctaactctcaaagtactgatatccaataaatctagttagtttcatatttatgtactctatatatttcttcaatttcaagaagctgctgattttaagaagcttcatgaatcaataaccatatttttaggggtgagggagcactactagattaaatgtaaacatcaattatgttatttcctaattttagaaatattaaactgggaggaaagtatgcatctcatgaccaagaaaatactgtattataccaacaagtccttctagaaacttagaacaggaaagtgaaatagacataaatttccaattaccaagtcacaaggggaaaagtaagccccagaaagcagtcccaaggctaaaaatcttgatggaaaaattatactcagactgccatacagattatccaatcaaaccttacttagcttacctgaatagcaaagttaacgtagatcaaaaatataactgcaattctgttttgttaaaaaagagggggagggggataggaatgtaggattgtgtttccgagaaatatataggaacactgatctcaatctttagggaattctaaaatgacaacaggaagaaagttcaagttgtatcagaaagattttcccattaataaattattacattttgggccacgcacggtggcttacgcctgtaatcccagcactttgggagtctgaggcgggcggatcacgaggtcaggagatcgagaccatcctggctaacacagtgaaaccccatctctatcaaaaatacaaaaaattagccaggcgtggtggtgggcgcctgtagtcccagctacttggaaggctgaggcaggagaatggcgtgaacctgagaggtggagcttgcagtgagcccaggttgcgccactgcactccagcctgggcaacagagcaagactctgtctcaaataaataaataaataattacattttggcgatgattacagcctgtcaactgaaggccactgaacatgcttatattttaaacaaaagagccacttctaagaaggcaaaattcatgctgtaattaattaattaattttttttttttttttgagaaggagtctcattctgtcacccaggctggagtgcagtggtgcaatcttggctcactgcaacctccacctcccaggttcaagtgattctcctgcctcagcctcctgagtagctgggattacatgtgcccgccaccatgcccagctaattttttgtatttttagtacagacagggtttcatcatgttggtcaggctgcctgacctcaggtgatccacctgcctaggcctcccaaagtgctgggattacaggcgtgagccaccatgcctggccaaaaccattaaatcttacaccttgttattactttttttttaaatattttaacggcactgtgtggctgctggggaaaaattgtacactttaaattactatatatgaattatatctcagtaaagccacctaaaaatcctggaagatcaaaattaagtatcttgtagaaggaaatcctttcctattttgcataaaaacaaaatatggattagtggcagtcctgtgaaaatgaaaacccttttcaattaatagatttcagtcagccgggcgtggtggctcatgcctgtaatcacagcactctgggaggccaaggcaggcagatcatttgaggtcaggagttcgacaccagcctggccaacatggtgaaactctatctctactaaaaatacaaaaatcagccaggcatggtggcaggtgcctgtcgtcccagctacttagagggtgcagcaggaaaattgcttgaacccaggaggcagaggttgcagtgagccaagatcacaccactgcactccagcctgcatcacagagtgagactctgtctcaaaaaaaaaaaaaaaaaaaaaagatttcagtatgacaaggagatgatttatttgatatatgtggctatatgttgacataactggatatccgttggcagaaaacaaagttccacccattctttgcatcataaacaaaaataaggctggcatggtggctcacatctataatcccagcactctgggaggctgaggtgggagggtgacctgaggccaggagttcaagacaagcctgggcaacatagtgagaccccatctctacaaaaaatttaaaaattagctgagcctggtgatatgcacctgtagtcccagctacttggcaggggctgaggtagaagaatcaattgagcccgggaggttgaggctgaggctgcagtaagtcatgatggtgtcactgcactccagcctaggcgaaagaacaagacctatctcaaaaaaaacacaacaaaacaaaaaagcaatttcctcatggatttattttttatttttatttttttgagacagggtctttcgatgtcacccagactggagtgcagttgtttgaacatggcttactgtaccctcaagctactgggctcaagcaaggggtgtctcactatgttgcccaggcttgtctcaaactcctggcctcaagcaatcctcccacctcggcctcccaaagtgctgggattacaggtgtgagccactatgactagccctactcgtggatgtaaacactacatacaaaagtaaaagtatctgaatgttcatgactatttctataacctatggtggagaaacccccttttttttttttttgagatatagtctcactctatcacccaggctggagtacagtggcaagatctcggctcactgcaagctctgcctcccgggttcatgccattctcctgcctcagcctcccgagtagctggaactataggtgcctgcaaccacgaccagccaatttttttgtatttttagtagagatggggtttcaccgtgttagccaggatggtctcgatctcctgccctcgtgatctgcccgcctcagcctcccaaagtgctgggattacaggcgtaagccaccgtgcccggccgagaaacccttcttaggcaaatcaggaaactaaaaaccataaagaaaaatagtgacaagtatgattatgttaaagcagtatatatctgtagactaagacattgtaaataaaataaaaagacaaataagattgggagaaaatataaacatgaaaaaggattaatatatcttaatataaaattatcttaaataagatatacaaaaaatatgcataggcaattacaagagagataaaaataacaaatataaaaagatataccacctcattagtatagtcagggaggtgtgaataaaaacaaactattggccgggcgcagtggcccacgcctgtaattctagcactttgggaggctgaggcgggcggatcacctgaggtcgggagttcgagaccagcctaaccaacatggagaaaccccgtctctactaaaaatacaaaattagccgggcatggtggtacatgcctgtaatcccagctactcgggaggctgaggcaggagaatcgcttgaacccgggaggcagaggttgcggtgagccgagatcgcgccattgcactccagcctgggcaagaagagcaaaactccatctcaccaaaaaaaaaaaaaaaaaaaaaaaaaaaaaaaagctatgttttacttatcaatttggttgaaattcaaaatagcaagtaatactgataatgtatggtaaatgggcactagtggccaccatcattttagaaagtaatatttatactatccattacaaacttttacattttacatactctttgactccaaaagtaatcctacttttgagactcctatagaaaaataaaagtaccaataaaaagatttattatatgaagatttccttcatactgaccaaaaatattttttatacacacacacacaaaatatatgtctgctatttcttagttaaaagcaagcaagatctcatatttggaaagagtaggacaaaaatcctatatagagaaaaaattatgaatgattacacaccaaattgatagtgctagtcatttaaaggagaaaggtttggaaggaaaaaaaaaaaggaaaaaaattatatatacacatatatattcctattacagaatttgcattagttttacaataaaacaaaaatccattaaaaacttattttaaaaagatttgaggccaggtgcagtggctcatgcctgtaaccccagcactttgggaggctgaggcaggtgaatcacttaaggtcaagagtttgagaccagcctggccaacgtagtgaaaccccatctccattaaaaacataaaaattaggctggatgcagtggctcaagactgtaatcccagcattttgggaggccaaggcaggcagatcactagatgtcaggagttcgagaccagcctggccaatgtggtgaaaccccatctctacttaaaatacaaaaaaactagccaggcgtggtggcgtgtgcctgtaatcccaactacacaggagctgaggcaggagaatcgcttgagcctgggagatggaggctgcagtgagctgagatggtgccactgcacgccagcttgggcaataacacgagattccatcaccaaaaaaaaaaaaaaaaacaaaaattagccaggtgtggtggcatgcacctgtggtcccagctacgtggtaggctgaggcaggagaatcgcttgaactcaggaggcggagcttgcaatgagccgatatcgtgccactgcactctagcctgggcaacaaagcgagactctgactcaaaaaaaaaaaaagaaattattgcattaccataatggtaaaggggaaagggaggtgaacaggtgacagtgagtaaagatttgcttatatcgtcatctaaccactagcattccttacatgagtttatttccacttttaagagcactctgggttgggcgcggtggctcatgcctataatcccagcactttgggaggccgaggcgggcagatcacgaggtcaggagatctaaaccatcctggccaacacggtgaaaccagtctctactgaaaatacaaaaattagctgggcatgctggcacatgcctgtagtcccagctactcgggaggctgaggcaggagaatcacttgaactcggggggcagaggttgcagtgagctgagatcacgccactacactccaccctggtgacagagcaagactccgtctcaaaaaaaaaagcactctggtaaagaacaggtaaacaacgcaactgtcattccatgattttcataattaagacacttatataacaaagaatattggcctacaatccaaagtgccagtgaaccccttacattcacattttatgtgcatatatacactttctgggaaagactacaaaggtttcatcacattcttttttttttttttttttttttttttgagatggagactcgctctgtcaccagggtggagtgtagtgacgtgatcttggctcactgcaacctctgcctcccaagttcaagcaattctcctgcctcagcctcccgagtaactgggactacaggcatgtgctaccatgcccagctaatttttgtatttttagtagagacagggttttaccatgttggccaggatggtttagatctcttgacctcgtgatctgcccgccttggcctcccaaagtgctgggattatgtttcatcatattcttaatgagggccatgactactcaccacaactaccatttaaaaaaaaaaaaagttaaaatcctctgaagacacatgcacatgtgtttctgtttactgcagcactatttacaatagcgaagacatggaaccaacccacatacccatcaatgatagactggataaagaaaatatggcacatatacaccacagaatactatgtagccataaaaaggaatgagatcggctcggtgaggtgcactttgggaggctgaggcaggcagatcacctgaggtcaggagtttgagaccagcctggccaacatgtagaaaccttatctctactaaaaatacaaaattagccaggtgtggtagcacatgaccgtaaccctggctactcgggaagctgaggcaggagaatcgcttgaacccgagaggcagaggttgtggtgagctgagatcatgatgttgcactccagccagggcaacaagagtgaaactcagtctcaaaaaaaaaaaggccaggcacagtggctcatgaagtcaggagattgagaccatcctggctaacagggtgaaaccccgcctctactaaaaatacaaaaaaattagccaagcatggtggcaggcgcctgtagtcccagctacccaccagaaggctaaagcaggagaatggcgtgaacccggaaggtggatcttgcagtaagccgagatcgcactactgcactccagcctgggcgacagagcgagactccgtctcaaaaaagaaaaaacaaaggaatgagatcatgtcctttgcagggacatggatgaagctggaagccatcatcctcagcaaactaacacaggaacagaaaaccaaacaccgcatgttctcacccataagtgggagttgaacaatgagaacacatgaacacagggaggggaacaacatactggggccagtcagtgggttggggggcaaggggagggagaacctgaggacgagtaactaacgcatgtggagcttaaaacctagatgatgagctggatgcagtggctcacgcctgtaatcccagcactttggcaggccaaagtgggtggatcacatgaggtcaggagttcaataccagcctgaccaacacggtaaaaccctgtctctactaaaaatacaaaaattagccgggcgtgtttggcacatgcctgtactcccagctactcgggaggctgaggcaggagaactgcttgaacctgggaggtgggggttgcagtgaacctagatggcaccattgtactccagcctaggcaacagagccagactccgtatcaaacaaaagagagataaaaaatagacattcattcaccaaccattttacatttgtctctacatcttgactagttagtacttgttagagtttcttagccaggaaggtgttagtcctcaaattatcaaaagattctcttttagttctggtattctagataaatttctcccagtatcaaaaatatttatccagcaactcagtctaagaacttcatcttttctctatctacactcactctctgggtaatttcatcaagttctttggctctaaatagcatcactatgctgctcagctcccaagtttatatttgccctgacctcaagacttgtacacccaactgcctattcaatatttcaactttaaacacttagtagaaatctcaaaccctgtacagtcagccctttgtatccatgggtttcacatacgaggattcaaccaaccacggatcaaaaatattccaggggcaggggtggaagaaaaggataattgtgtctgcactgaatatatatactttttatgtcattattctctaagcaacacagtatatttacatagcatttacattgtattaggtattataattaatccagagatgatttagagtatacaaacagggaggtcgagacgaacctgggcaataaagcatgactctctctctacaaaaaccaaaaaaattacccgaatattgtgtcgtgagcctgtaatcccacctacgcaggaagctgaggtaggaaaatagctttacctgaggagtttgaggttgcagtgagctatggccatgccactgcactctagcctggataacagagagaccctgtctcaaaaaaaaactttttggccagacacagtggctcacgcctgtaatcccagcactttgggagtccaaggcgggtggatcacctgaggtcaggagttcaagaccagcctgggcaacatagtgaaaccccacctctactaaaaatacaaaaattagccaggcacggtaatccctgctacttgggaggctgaggcacgagaatcacttgaacccaggaagcggaggttgcagtgagccgagatcgtgccattgcactccagcttgggtgacagagcaagactcagtctcaaaaaaaaaaaaaaaaaaaatttaagtatacaagatgatacacataggttatatccaagtagtataccattttatataagggactggcacatccacagattttggtatcctcgggggaaccaatctctcacagataccgagggatgactgtatatccaaaccaaatccctcatttctgtactccttataatttgcttttcccacagtgttcctcatcaaagaaaaaagcatccaactgctcaggccatcactgaagtcatccttgactcctcttttaccctgatcccacatccaaaccatcagcaagttattatctccactacctccaaaatatacctcaaatccacccaccagtacactcaacaccacaatcagctgttgcctcaactatcacgatagcctctttttttttttgagacagagtctcgctctgttgcccaagctggagtgccgtggcgtaatctcagttcactgcaatctccacctcccgagttcaagcaattctcctgcctcagcctcctgagtagctgcgattacaggtgtgcaccaccacgcccagctaatttttgctttttagtagagatggggtttcaccatgttggtcaggctggtctcaaactcctgacctcgtgatccacccatctcggcctcccaaagtgctgggattagaggtgtgaaccactacgcccagtccacgatagcctctgaactggtcaacctggttgcattattcatctttcaaagtgcatatatcagatcaagtcatttccctgcttccaatcaaacttgaaatacaaaactagatacctatcaagtctttaagtccctatgttatctggtccctggctacctcttctatctcctatcactattcccccctttactgttttagcccttttctattccttgaacacaccaacaggtactcctgtctcagggcttatgctcatgccccagatagttgcactgggtccttcatataattcaggtatctcctgaaatattagtgcctcagaggacttccctaactacccaacatcccttaccttgtttatacttcctttaccacatctatcatcaaaatgctaggacatatttcccatttatttaatattgtctatcttactcaaaaggaagcactatgaaagcaacaacttttatctgttttattcactgttgtatactctgggcttaatacagtacttgacataaagatccagatgggatctcatcttgttgcccaggctagagtgcagtggtgcaatcatggctgactgcagcctcgacctcctgggctcaagaaatctactgctcagcctcccaagtagctgggactacaggtatgtgccacaatgcctggctaatttttaaaatttttttagagacatggtctcactatgttgcccaggcggtctggaactcctgggctcaagcaatccccccacctcagcctcccaaagtcctgggattacaggggagagccaccatgcccagcctttatttatttgactctttttttgttttgtttttcactttcttcctgcagcattttatttgattcttaacagatgatttaatccactgatatctcaaaggactaactatccaatggaatgcctggatgaaacataggcacacagtatcttttcctcgggggggaaaaatttttgtcacataattgattcactttagcagaaaaataatcatataccaggaatttcttcaggaatcttgagtctatcttaagaatctacggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagaatcttgcaggccaggagtgttggctcacacctgtaatcccagcactttgggaggctaagacaggtggatcacaaggtcaagaatttaagaccagcctggccaacatggtgaaaccccgtctctactaaagataaaaaaaaaaaaaaattagccgggcgtggtggcgggcgcctgtaatcccagtgacttgggaggctgaagcaggagaatcacttgaacctgggaggcagagattgcagtgagccgagatcatgccattgcactccagcctgggcgaaaggttgagactccgtgtcaaaaaagaaaaagaatcttgcttgaacaacacgtaatatactggctaacagtatgttatatcagtactaaaagatctatatcgaaaaaagaaaatgcccaaattattaagtcctaagacagcaaagcagggatcttgttttgtccatcactgtatcccagtacctagaatagtgcctggcacatagtaagcactaaataaatatatgaaggccgggcacagtggctcacgcctgtaatcccagcactttgggaggccaaagcaggaggattacctgaggtaggagttcaagaccagcctggccaacatggtgaaaccccgtctctactaaaaatacaaaaattagccgagcgtggtggcgcatgcctgtaattccagctactcgggaggctgaggcaggagaattgcttgagcccaggagacggagtttgcagtgagccgagatcgcgccactgcactccagcctagccgacaagagtgagactctgtctcaaaaaaaacaaaaagaagttttgatagaaactacaacagggtggtgtcatgcactggtagtcccagctactcaggagactgaaacaggagaacggcgtgaacccgggaggcagagcttgcagtgagccgagatcgcaccactgcactccagcatggacaacagagcgagaccctgactcaaaaagaaaaagccaaacacgaaaacctaggctaaaatgaagagggaaaatacgaaattggaattcacatgtgagaaaagataaatagtatgctaaaaattgaaaatggaaaaaatatgtatacaaataaggacattgcttatatacacttcaaaagtgtattttacatattcttacctatgagggaagtaatctgctttgctatattcttttttggaaatgaagaaaataaataactaaaataataacaaatacacattatttgcttgctgcatggcacacattatgctaaacacattatacatatcatctcgtagaatccgccaactctatgctataaatattatcattactatatcaccatattttacagtcaaggaaaccaaagattgtaagtattttgctcaaaattacagtcaataagttagcaaaactcagatctgagcctaatcaatctgatttcagagtctatgatcttaatgactatttgggattttcaacaaattgaggggaaatataccaatgcagatgctgagagattcattcattattaagacaactaattatacatttttagatctggctagatacttattataatcaaggcctgattaactagaatgctgagtgggttacattctagtaaaaattttctgagtaactaaaatataaccaaatattttattgacattaatctttgctagaaattacttttataacaatagttttttgtctaagaaaagtattttgaacatatttccatctttatttgatagaagatatctaattacaaaggccaaccttatatagcactgaagacacaggaaatcataagagaatgggttgaaaatttaccgatccaaattacagtgcactcatcctgctgtgtcatacgttcatacgtttgcagatgatctccctctacctagaacgccctctcttaagtctgaatgtctcacacttatcctttaaagcctggctcttcccacttgtaggaagccaccctaacctttcctttctcaccacagattgaataacttccccaccttggacaaaaacattacatagtatgtatcgtagtatgtttgttaacataggcaaatgtattacataatattactgtaatatgtttgttaacatgctcctcctattagaatttttttttttttttgagatgaaatctcactgtcacccaggcaggagtgcagtggcaagatctcggctcaccgcaacctctaccacccaggttcaagcaattctactgccacagcctcccgagtagctgggactacaggcgtgtgccactacgcctggctaatttttgtatttttagtggagatggggtttcaccatgttggccaggctggtctcgaactcctgacctcgtgatctgcccacctcagccactcaaagtgtaagccactgcgcccggcccgagtttttttttttttcctttagagacagggtctcactctgtcacacaggctggagtagagtggtgcgattacagtttactgcagcctcaatctcccaggctcaagtgattctctcacctcagcctcccaagtagctgggaccacaggtggatgccaccacacttggcgaattttttttttttaatttatgtatttactttttgttttggagacggagtttcactcttcttgcccaggctggagtgcaatggcacaatctcggctcactgcaacctctgcctctcgggttcaagcgattctcctgcctcagcctcccgagtagctgggattaaaggcgtgtgcccccacacagggctaattttgtatttttagtagagatgggatttctccatgttggtcaggctggtctcaaactcccaatctcaggtgatccacccgcctcgtcctcccaaagtgctgggattacaggcgtgagccaccatgcccagcctgaattttttatttttttagtaaccaggtctccttatgttgcccccaggctggtcttaaactcctgggctcaagcaatcctcctgccttggcctcccacagagctaggattacatctgagatttaaaaaacaaaaacaaaaacaaaaaaaaacactgtatgtcttttccccacacctaagcacagaaatgggtatggtggaagcactggaaaaatgttagtcagtggagtgaggaatgaatgaatacaaaacaaacaaatgaatggcttgttaaagtaaattaaactcagctgggtgtggtggctcacacctgtaatcgcagcactttgggaggctgaagcgggcagatcacctgaaggtcagaagttagagatcagcctggccaacatggtgaaaccccatctctactaaaaatacaaaaatttgccgggcatggtggcatacaccagtagtcccagctactcaggaggctcaaacaggagaatcgcttgaactcaggaggaagaggtgcagtgagccgagatcgtgccactacacttcagctttggggacagagtgagaaaccgtctcaaaaaaaaaaaaaaaaagaattaaagtctgacctacagttatttgactttcttcctcttaaaattaaacacacaggccagtgcagtggctcacacctgtaatgccaacagtttgggaggccgatgcgggctgatcacttgaggtcaagagttcaagatcagcctggccaacatggtgaaacccggtctctactaaaaacacgaaaattcactgggcatggtggctcgcacctgtagtccaagctactcaggaggctgaggcaggagaatcacttgaacccaggaggcagaggttgcagtgagccgagattgcgccactgcactccagcctgggcaacagagtgagactctgtctcaaaaaaaaaaaaaaaaaaaaaatggaaaacaaaaaaatgaaaatctagggactaaaaactagacattttttagcatcttgtcgctatgactaaaaaactgtaagaaaccctttgtttctctcttgtgcatttgaaaaaagctgataagctattctgaatagcataggaactgttctaaatgttcaatgcaaacatcgaaaagcaatgatgtgaactatttacctcatttcttcttagctggcacagggaattccctactgataagtaatatggattagaagtagatggtgtaagtagtttagttccaactatgatcagatacttaaaagttatataaacctaactatgaaggagtaattcctcacttaacagtgaaaagaatttttaaatacttaagtatttatggatgaaattatacaataactggaagatctgctttaaaataagcaagaggggaaggagggacaggggctggtagatgtggaaacagtgtgttaactgtgttgataactgctgaagctggatgttgagtacatgaaggctcattatactattctctttatttctatatatgtttgcaatttgccacattaaagaaataaaaagctgactgggcattgtggctcacatttctcagcactttgggaggccaaggtgggaggaccacatgagtccaagagttcaagaccatcctgggcaacacagtaagactctacctgtacataaaatttaaaaattaaccagatgtggtggcacatacatgtggtggcacatacctgtggtcccaaacacttgagtggctaaagtgggaggatcaactgagcctgggaattcaagttcagtctgggcaacacagccagaccccagctgtaaaaaattataaatataaatatacatatatatacgtgtgtgtgtgtgtgtgtgtgtgtgtgtgtgtgtgtgtatgtgtatatatatatattttttgagacagagtttcactctgtcacccaggctggagtgcagtggcgtgatctcagctcactgcaacctccacctcccaggttcaactgattcttctgccttagcctcccgagtagctgggactacaggcacatgccacctgcgcctaattttttatatttttagtagagacggggtttcaccacgttagccaggatggtctcgaactcctgacctcgtgatctgcccacctcggcctcccaaagtgctgggatgacaggtgtgagccactgcacctggccaaaaatatttttaaatgaacaaaattgcccaggtgtggtagctcatgcctataattccagcaatttgggagtctgaagagggaggactgctgaagttcgagaccagtgggggcaacacggtgagactccatcgctacaaaaaaattaaaaattagccaggcgtggtggcatgtgcctgtaatcccagttacttgggacaatggaaggactgcttgagcccaagaggtagagcatgcagtaagttatgctcgtaccacggcaccctagcctgggtgacatagtaagaccctgtctcaaaaaaatttttttaattagatggaaaaaagtatacaaccttgtcatcaacttgtgtatgtctgagggcaaatgactaaagactatgaaaagcaaatataatactacaataaaaatttcatagatttccaaacatgaaaacttagctgttcaatgaaaaaatacaactctgaaatagcagtaagattattggttaaatttctgtcatcactagaagtcattattttatttatttattttttttttgagacagagtctcgctctgtcacccaggctggagtgcagtggcgcagtcttggctcactgcaagctccacctcccaggttcacaccattctcctgcctcagcctcctgagaagctgggactacaggtgcccatcaccatgcccggctaattttgttttttgggttttttttttgtatttttggtagagacagggtttcaccatgttagccaggatggtctcgttctcctgaccttgtgatccgcccacctcggcctcccaaagtgctgggattacaggtgtgagccaccacgcccggcctagaaatcattattttaaagttaattttgataaatatcacattctgccaattacaggcctgatgaggcagtcactaaaaaagcgatttctaaaacgtgaaatataagactattattaactatgatgacaagcaataagaaaatctagcctcttcatatgaaaaaatataaatgaaaaaacactaaaattaattttaaggaaaatgataacagaaactagcagcatacctcaaaacaaaacaaaaatgaactagttgcatttccacctcttgcggcacccaggtttaaaatactacatgctgctgaaaaggctggcctaagcagatctcacagcagattatagtgaggttgtatactacctttaaaagactcagatcaatacacattattcaaatagcaatacaaagttattttaaatggagaccaccaccaccacaatcttacacatagtaagacttctccactgtgtgcttccacattgtcttgggcagaaatgaaggtggccaattcaatattaataaagcatggaggaagactcagaataaagactcaagtggaattgctaatactataaagacacagtacctagcaagttattaagaagtgatgtgcaggtgcggtggctcacacctgtaatcccaacactttgggaggccgaggcgggtggatcaccagaggtcaggagtttgagaccagcctgaccaacatggcaaaaccctgtctttactaaaaatacataaaaaatagccgggcgtggtggcacacacctgtaatcccagctattggggaggctgaggcaggagaatcccttgaacccaggaggcagaggttgcagcgagctgagatcgcgctgttgcactctaggctggacaacaagagcgaaactctctctcaaaaaaaaaaatttaaaaagtgatgtgctgtattctatttcacaatataactcaagagtagaacatgaaaatccttttcctttttttaaagagacagtgtttcacgctattgcccaggctggagtgcagtagcaccaccatagctcacagcagcttccaactcctgggtcaagtaattcccctgtctcagcctccagagtagctaggactgcaggtgttcattctaattttttaactttctgtagaaatggggtcttcctatgttggccaggctggtatcaaactcctgggcacaagtgatcctcctggctcagcctcccaaagcactgggatcatagggataacccactatgccaggccctaggcccctttttcttttcttttttttttttttttgagagagtcactctgtcgtccaggctggcgtacagtggtggatctcggctcactgcaacctccacttcagggattcaagagatcctcctgcctcagcatcccaactggctgggactaccggcacacacaccatgcctggctaatttttgtacttttagtagagacggggttttgccacgttggccaggctggtctcaaactcctgacctctggtgagccaccctcttcagcatcccaaagtgattacaagtgagagccaccatgcccagcgacatcaaaacctttttacataaacgcactgtagaaatatatcccaaaagaaggtaagaaatataaatgtttgccttcttctcaaaccaatagttcctttatacaaaaacaccagatgaggccgggcgcggtggctcacccctgtaatctcagcactttgggaggccgaggcgggtggatcatctgtcaggagttccagaccagcctgaccaacatggagaaacgctgtctctactaaaaatacaaaattagcagggcatggtggcacatgcctgtaatcccagctactcgggaggctgaggcaggagagtcacttgaacccaggaggcagaggttgcagtgaattgagatagcgccactgcactccagcctgttaacaagagtgaaactcagtctcaaaaaaaaaaaaaaaaagcacaagatgatacaaaacatatttttttaaagtacaaagctgcatacagagtataaacactttatgcttattcaaagagtaagtagtggcaaaaatctctttgcaattgggtaacaaaatttcaacttctaggaatgtttccctcttccttgtccttttgagagctgccaccatcaaacaattcagactcaactgaattagcatctcttcaagcacagagaccatatattattgatttttgtgtctcctgcataggattaactcagtgtttgttataactaagctaaactccaagacaggagcttcaaatcacctcaggcccaatccaaaactgaaaaaagacaaacccacttctcagagtttaggaacaaaaagatactgacaaagaacaaagccatagatacttgtgctatattatattcccttatcaccaaattcagagtcctttactaatactgcagaaataagtttgcagatgataaaaagaataaaaaacatggaccctaaagttctcctgtcaacatgttcaaataccatagactctttcatcttaaactcatactaacatccacacacccgaacaatgaaaatgaaaggttttcaaatgagacctaaatataaattggctctattttattacattttaagttcctaaaatcatatatataaatcatgtgattgtgcttatgctcatcttctaacttgagggcccagtgtctttcatcagattctcaaaaggataagtgaccccaaaaaattttaagaaccactcatctagcctatcaagaaacatcccatttttcagaagaatacggttaagtggcttagtttatgcattctttcttcatattcatagaggggattcttactatatgaaatgagtctttcaaaggattccttcagcccagccaagaagttccaacatccacaggcacatgtattaacaattaccagaacccaaaaacagttctctggttttaattccacaccgcctccctcaacttaatacccaccactgtcaaaacaactcccctcacgttgtacccaggctatttacagagacaccttgattatcctcacgccaaggcatggaccatttattgaacaggcagtcaacaaatatttgttgaatgaatgaaaaaggatccttcctcccacagatttcaagttaagctgtcagcacccatgcagctgctctggtacaagttaagctgtgaaagccttctctccctcacacatacaacctcaagtgtcagaaatgctctgcttcctccataaatccaaaataatatagtcatggatatgcatttcatacaggtcagactcggcaaggacagctacgttccacatacatatctgacacaatcggtctcccccaaatacaagccaaccagtcttatgtgctcctatctttccagcatactcagatttgccgacaaagacttcctgaggcaccatggtatgctgaatatactgctgcagtagtagtgaaaatatgggagttacagttccaactttgtcaccaatttaacatgcggccttggagaagttctctccttatgcctaaatttcctattttgtaaaatggaagaaagcatcctaccattttcacagagattcagtatcacaaaaaaactgaaagagctttcttattgtattgtaaactattactataaacccgcgacaacaaataaggccacccattctttacaactttgtagtaatgattctgttaaagatattttggcccttcacatttacacaactcactctaaccaaaggcacaaactattcttaagaccacaactggctatgccaagtttctcccctccctgacctcacagacacatgctgtacagaacactaccattgccgctctttcccaacaagtaactaggggctcccaatccctaaaatacacacacatatcaacctgcaaggaacctcccaacatttattcaagaaataagctaacttataaggggaactccattacacttacacaaataaaggcaaactcttacggaaacacttgccatcctcacatacacacaccaacacagccgctacacaccaacagaccatctgtctgctagaccaaaaacatctctttccatgtacaaactaaccagtgacatttattaaacttacaacactgagatcatcctgtcgttcccacataccgttcaacgcggcagggacaccacagaccttgtcacacaggtaaaatcccctctcaagatcgtgtcctcgaccactcttatcccttaattaaacacacacaaactggactatgggggaggctccgatcatgcctacaaacacaaactaacctgtcaggggcacagccgactccgcctccactcgcttacttcccagccccctccgggagtctgcctgtcagggacaccccttcaccccgcctggagggacttcccggtaggctcaggatccccctccctgctctcccctcccccatcttcaccactgctctctcagagatccaggtccgggagatgacagtggctcccagaaagcccaggattcaatcgctgagagagtgcttaggcccgaatgccggcccaaatcgttctactcaccgtgtcggaggccgaggccgaggccgagagcgatgagagtgcagggaagtggggaagagggggtggccgccaggctcctccgcttccctgggtccacggcggatccctcccgcttgtcaggaggcggccagcgggtaagctgactggcggaaatgcgagagaggagaagggaaaggtggaaggctaaagggggcaaactgaggggaggcgggtcccgcaaccgagactgggatcgtctcccctccgcaaagcgaacccaaaatggcggcgggagcggcggcggcggcggcggcagcagcagagtggcggcggtggcggcggcagctcctccagagggagggagcgaagggcgcctagcgcccccctcaaccttccactcct

SEQ ID NO: 1535 - DNA, 82404 bp, Homo sapiens
ttatatatacaacaaatttttaattatgtactgaaaataaattacaggaaataactttaaaatgcaacagaggacaaagtcacaataaacattcccattgaattcccttggtgggcggggggggggtgagattgcagtgctcaagataaatatcacaaatatatcaaaaacttcaaattgtctatgcattcacacactgacatgagccacaaacattcctttcacagggacagtacttatttagcctaccacaggaccagattttgccataaactacaaaacttttaatacaaaatcgtatttatatatttataagtcatatacatgccctatctgtgattttagaaaataaaagctacacactgtacagacactcttaactcatagctgtaggcaacatttttggatggaatttcttccccaataaaattaatggcatattttatatacatgaaggctaaactgcaaaaagacagttcagtttcccagatatgcatctccttttagggcaagtttataaatttaaaaaggcaagacaaatgtacacctcagaattactttcttagctacaagagttgccatgtaatttctgtgaagtttctgatacatgcattgatgtaatactggtattgaaggcagtaaagcaatatatacttttaatgtagtggctcaataaaggcttcattgtctttccaatctggttcttgaaacagtgattcataaattctctaaaaattaaaatttcaatgggacactgtgttaaagagactctaaatagatttctgaaaatatttccctgaaatatccttttacataagacaaattcactaacattagattaagtaaaaagaaataaaagagttaaacatggcacaaaggtgcatgattaaccaatgctcctcagtccatctgcatgtcttaggagccattaaaagaatgcttaaaactaacaaacaatcttcacactctgtggcagccatctgtgaagccagttacactaaactacttctacagttgattgtaaactttggtttatttttatttgagttctcattgtacagcaagcatgaaaaaaaaagagagtggagtccgtgaggagatgaactgtcagtctgtctttaatctggcatgatgagacacctggtcagtcaggcctgctttgatagagtttgttacagactgccttatgttttcctccatcaaattatcacccaggggcttcaatacctgtggtatgagaaatgtgcaaaacaaacaaaaacatgaggtaaaaaaagagttacatataaaaatagatataaaaattcaattcaaagcaatgatgaaaataaccaggaatatgggaaataaaaagatgcttctctcaaaaaaacttatgatgctactagacattttataatgcaacaaaaattactttcctcttattcaaaccatttacaattcctatgagatggatgtgcaattccataccctatatgcagcatcaaatctggtatgtatacagcatttatgcagaccggcccagacggtcctgcttattgtcctacatgtgtaagtgtgaacacttcagatagagaaaaaggttaaaaatactgtctaatttttcttcttgttattgttggatgacagtctctgtcgctgtgctgatgaaagagcacggtgaaccattcgacgtctagtaacttcaaacagtttggaaaacacctaaaacatgaagtgatttgttaggagaatgaatcagagtgcctcgaagctaaagagtttaagactacaagaatttgagactgtaggtttctcaccttcctgggactcctctgaagcaaaagaaaagagaaatgcaaagaaatttagacaaggtttgttgacacagcacagatctctgactagctgattaccttacctaaactatactgaaaatgattttatacactttagattcttccatttaattgttttgtaataatggtacctccaaaatcctagaatcaatgctgtttaagagatgaatatttctcaaaagaagatattgtacaattattgaaaattatattgcagaaaatgatccaaaattttaaaatagctaattttttcttaaaagtgaagttgcgatagctttgcatccatcttctattagaagatatcaaagaaacatcaagtagtgagattgagataaaaatttaaatagaataaatatccaaacataaacttcccaatcggatctgaatagagcatttctctaaagagtaaacacaaaatccaaattaatatagtgggtcactttataaaataacatcattacaagaaaagtcaatatccaatcaactttcttcaaaaaaaatggtctgcttcttcggtcttcaagtttatagccaaaacaaacatggacctgcatatcctagatcttcaaaataagctcaatatttcatgagcccaaaaatggcatctcaaatgcctattatagcgttcgtcattaataaccgtagctttcattctggtccttgacatgatgttcaagtatttcacgaagatcatcttaatgacatccataagcggtccacaggtaattccagcacaccggaggcagatacacaaaatggctttccttagcagatacttgcaggcaagagttcacagcctggggctttgaattctggttcgaggtaaaagattacgacggagcatggttctctgttcatggcgctttgctttactaattaatatttccaaaacacaaaggtcaaagtttccttggtaagaaatccctacgggattgttcctcatagtacatcaggaaatcactaccatcttcatggaaggcaatgaagacctgtctaccatccagcatttctcctgcattgctgcttgccaatattaggaagaaacttcttttgctttccgaaagcaccacttccaaacttcttttccttaccttgaaaatcattcattgtttatattttctttcctcaaagaaaaaaatcattacagactctgaccctgcccaccgtctgatacaatcaggcctacaactaagaatctatccagaggatagtacagatttaggctaaccaaagtacattaaaattataactttaaagaaaaaatcttcaattcataaagattctacatctgaacaaaacagaagacatccttttgacattcctcacatgaaggcaaagtcggagtacaaatactgcaaaggatggaaagtcacaggaaaataagattagtcactaaaaaaccaaaagatagataccaacctgttcccatagtgtttcagcaatctgatcaatcactgttccaatttctctgaactccccagagtatttaacatatgcccaagtacaaagaaatatcagtgctaaccccatgacaaggttacacaagacagctatagagtttaggccaatgaagccagtcagtcctgagattatatacatagcaaacatgaccgcaaacagtgtggctggggtacgagcagcatagaagatatttttgccatcattgtgctttataaaatttgcataggtttcttcaatttcagcttcaagctggtcctgataacgacggcagaactcatctccacccatcttttttactgaacgaaattgttttatcgccacttccttgagatccaagtgttttcgctccagatctgaaggtgcaatgtaaggcttgtcccctccacatacctggacagacagaattacagtattacatgctagaaataattaacacttgaaagaagttcctgttcatagtttttagtctcagaaagtcaaaccacttacatgattgagtcagttttaaactcacttacaatacctcacaggttatcataatctagttattgtttatatgttgaacctactcaagcaaaatcattttccaaatatgactaacggaaactgaagacaaaaaaattttacactgtgctctgtatctgccttcacttgaccatcatataccataatagcacacaaaattgctggcaagagaacgggtaaaagatgataatgccccaaaaagatattttaatgtttgagcaagcaagtacagaaactgctactggccttaaactaatgctaccaacatcagaagtcaccaataacagcactctgaatcacacatttgtcagaagatatttcagtagagtttatataataatttactaactcaaattctgctctcaaataatgtgaattattttcttatagtttatttccagcaaagaccataaaggggaattagggaataatgtaccataagctgcacaaattcgctcaattatttaaaaaatttttttaatttttttttttttaatttaaaaatcttctcactccagcatcaaatttaaattttaggtacaaacctgttccatacttttacaataggtatctcttgctcctgctactgcagcaagattattagcttcagctgttgcctaaaaaataaaatatgccattattatgcaaaaaatactctatgactctaaaaattctgattaacacaataagttatgtacaataaacaagtctgaaaatgaaccagagaaagtaacttccagtttttctttcctatgcaagggaacgttggtataaaggatataatggtaagtggttctaataggactgcctgcctgattttgttttgcttaggttgatgttaaagtgtgtctgcagaaaacaccacatatgctcaggaaatggataaagataaatagatataaccctaaaatatgtggatctccaggtgttaggaatcgagaattacccatatggttctctctctcataatcagtattatacaagacattttcaaacccacaaaccttactgcacgaagttttatcggcaaatactgtttaatctactataaaatggaaaaatagcctaaagtagtaaatgttttaaaatatgaatggggtaaaatgacactgtcccaaaagaccaccatttgaaagacagaaaaagaagtgagactatattcactagaagtagctctaaatcattaacaccaaataaaaataagacttattccaaacaacattcattgtcaaagactcagaatagaagcagcttagttcagagaggcccacatcaagccatcttatcaaatagaaattttcctatactttgagcatctgaagagaaggtactgaggactcttatttctggtggcctggacacatggaaggcctacaatctgcagttacaaaaaaaaaattgtatgaaaccttaggacccacgacacatacggccttaagcaaaatgtgtttgcatgcaaaaaagcaccccccattttcagcatttctctctaaagcaaagatttttattctccctcataaataagtatatgtacaacacatatcactctctctctctctacctgaagcatggactttggatgtggaagttcttctccttgatagattttgatgtaagcctaaaaagggagaagatttgttagactgacggattatgcaatttggctccacatccccaaagaaagaaaagtcattaaatataaaaataattaacaccattaaaagtaaattctaggctttaaaaatcaccttattccaacaaagttaaccctattctcaatattattaaattatatgctgctaaataatatcctaggtatttctataacaaatataacataaaagttataactcaaagttagatataaaatgccatcttctttatgaaaagaaattcacaattaccccctattgccagtgttttaatatttttaaaaaacttttttttctctttctttagagatggggtctcacactgacactgaggctggagtgcagtgggatgatcacagcttactgcaacctcgaattcctgggctcaagtgatcctcctgcctcagttttccaagtggctgaaactacaaggtgtgtgccaccacatccagctgaagaaacaattttatccagtattttactttgaccagcttaaattgtatttcagctcaagaaggaaaaaaaaaaaaaaaactaatttgtggtttaagagtaagaaggaaaagataagagtttgttagaagtccatatagggtctttcatctcaactttcttttttttttttgagaaggaatttcgctcttattgcccaggctggagtgcaacggcacgacctcagctcaccacaacctccgcctcctgggttcaagcaactgtcctgcctcagcctcccgagtagctgggattacaggcatgcgccaccacatccagctaatttcgtatttttaggagagacggggtttcaccacgttggccaggctggtctcgaactcccgacctcaggtgattcgcccactttagcctcccaaagtgctgggattacaggcataagccaccgtgcctggctcatctcaactttccactgacaagattcattcataactgggaaggaggcagagcaagatggccaaatagaagcctccagtgatcaccacctccaaggaatatcaaattgacaactatctacataaaaaaccaccttcataagaaccaaaaatcaggtgagcaatcacagtacctggttttaacttcagatcactgaaagaggcactgaagaggatgtgaaaaacagtcttgaatcacctacaccacccctcccccatcctctcagcagcaaccacatggtgtggagagacaatctatgtgcttagggaagtcgaaagcagtgactgtggaatttttgcattgaaactcagcgctgccctgccacagtggaaagaactcagccagcacccatggaggaagaatttagaccagccctaggcagccagtcctgccaccatgggctacagtgctctgaggtcctgaataaacttgaaaggccatctaggccacaaggactgcaattcctgggcaggtcctggtgctgggctgggctcagagccagtggacctggggtgcatatgatatagtaagactccagctggggcagccaagggactgctagtgtcactccccctacacaagctcaggcagtgtagttcacagctctgagagagagtctttccttctgcgtgaggagaggagaggggagagtaaagaggactttgtcttgcaatttggataccagctcagccaaagtagaatgcggcataaggcagagccctaaggccccaatttcagtccccagttcccagacaagatttctaaacacaccctgggctggaagggaacccactgtcttgaggggtatgaccaagtcctggcagggttcatcacgtgctgactcaagagcctctgggctctgaataagcagtagtggtagccaggcagtactcactatgggccttgggtgagattcagaaatgtgctggcttcaggtgtgacccagcacattcccagatgttgtggctatgaggagagtctcctgcttgagtaaaggagacaaaggccaggtgtgatggctcacacctgtaatcccagcaatttgggaggccaaggcaggcggatcaccagagagcatctctggacccacccaaggccagagggaacttgctagatttgccacctgctgattgtagaacctctgggccttgactgaccacaggcaataaccacacaatagtcacaatgggccttgggcaagacccattgctgtgctgccttcaggtctgacccagtgaagtcccagggatggtggccacaatggtgcttgtgtcaccccctcccccagctccaggcagctcagcacagagacagagactccatttgtttgggagaatgtaatggaagagaacaagagtctctgcctggtaatccagggaattctcctggatcttaccgaagagcaccaaggcagtacctctacaaatctgcaagagccacagcattatgggcttgaaatgtccctaatgcagatacagctgcagtgaccaagatcacaacacccaagtcccttcaaatagttagaaagccttcccaaggatgacaggtacaaacaagcccagactgcaaagactataacaaatacctaactcttcaatgtccagacaccaacaaatattcacaagcatcaagaccatccaagaaaacatgacctcactaaacaaactgaaataaagcaccagtgaccaatcctggagagacagagataactgacctttcagagaattcaaaatagcagttttgaggaaactcaaagaaattcaagataacacagagaaggaattcagaatcctttcagataaagtgaacaaagagactgaaataattataaagaataaagcagaaatcctggatccgaaaaatgcaactgacatactgaagaatgcatccaaacctcttttttattttatttttttgagacagggttttgctctgtctcccagactggagtgcaatggtgcaatcctggctcactgcaacctctgcatcccaggctcaaaggatcctcctacctcagtgtcccaagtagctgggactacacgcgtgcgccatcatgcctggctaatttttgtattttttgtagagacaaggtttcaccatgttgcccagactggtctcaagtgatctgcccacctcagcctcccaaagtgctaggattacaggcatgagccacctcacccagcctcagagcttaacacaagacctgaacaagcagaagaattagtcagcttggagacaggctatttgaaaatacacagctgagacaaaagaaaaaagaatgaaaaagaatgaagcatgcctacaagatctagaaaatagccccaaaagggcaaatctaagagttcattgccttaaagaggagtagctaaagagacagcggtagaaagtttatacaaagcaataacaaagaactacccaaacctagataccaatatttaagaacaaaagattatagaacaccaagcagacttgacccaaataagactacctcaagacatgtaacaagcaaactcccaaaggtcaacggtaaagaatggatcctggctgggcgtggtggctcatgcctgtaatcccagcactttgggaggtcaaggtgggggaactgcctgaccctggagttcaagaccagcctggacaacgtagagaaatgacgtctctgttaaaaacaacaacaggccaggcacggtggctcacacctgtaatctcagcaccttggcaggctgagatgggaggatcacttgaggccaggagttggagaccagcctgttaaacacagcaaggccccatttctattaaaccaccaccacaacaacaacaagaagcacgaatggattctaaatgcatcaacagaaaagaaacaaacaacatacaaaagagttccaacacatctgggagtagacttctcagcggaaaccttacaggccaggagagagtagcatgacataaagtgctgaagaaaaaaaacatttttcctagaatagtatatccagtgaaaatacttcaaacatgaaggagaaataaagacttcctcaaacaaaagctgaggaattttatcaacatcagacctgtcctacaataaatgttaaagagagttcttcaatctgaaagaaaaggattttaatgagcaataagaaatgatttgaaggtccaaaactcactgggaatagtaaacacacagaaaaacagaatattattaacaataattgtggtgtgtaaacaactcatatcctgagtagaaagactaaaagacgaacctataaaaaatattaattaacaaccacaacttttccagacatagacggtatactatcaatagaaacaacgaaaagtttaaaaagtggggggatgaagttaaagtgtagaatttttattagttttctctttccttgttatttagtttgtttaggcaatcagtgttatcagtttaaaataaatatattatagttgcaaacctcatggtaacctcaaaagacatacaacagatacacaaaaaataaaaagaaattaaaacataccaccagagaaaatcaccttcactaaaaggaagacaggcaggtaggaagaccacaaaaccaccagaaaacagtaacaaaatgacagaggttaactccttacttatcagtaacattgagtgtaaatgggctaaactctccaattaaaaggcacagagtggctgaatgggttttaaaaaatggtgatacacacttcatctataaagacacagactgaaaataaaggtatggaaaaagatactccatgcaaatggaaaccaaaaaaaaagagcagaagaagctacatttatatcagccaaagaaggtcattatataatgataaagggatcaattcagcaagaggatataacaattgtaaatatatatgcacccaacactggagcacccagatatataaagcaagtattattagaaactaaagaaagaggaccgggcgcagtggctcatgcctgtaatcccagcactttgggaggccaaggcaggtggaccacttgagggcaggtggaccacttgacgtcaggagtttgagaccagcctggccaacatggtgaaaccccatctctactaaaaatacaaaaaattagctgggcatggtggtgcgttactgtagtctcagctactcaggagactgaggcaggagaatcacttgaacctgggaggtagaggttgcagtgagccgagactgctccgctgcactccagcctgggcaaaacagcgacacttggtctcaaaaaaaaaatcaaaaaaattgaaattatatcaagtatcttctctgaccacaatggaataaaatcaataacgaggaattttggaaactatacaaacacatggaaattatattaatacaataggctcttgaatgaccactagatcagtgaagaaattaagaaagaaataaacacattcttgaaacaaatgaaaacggaaacacaacataccaaatatatgggatacagcgttaagcagtactaagaaactatatggtaataagtgcctacatcaaaaaagaggaaacacttcaaataaacaacctaaccatacatcttaaaaaaacagaaaaggaagagcaaactaaacccaaaattagaagaagttagcgaaattgaaataaaaacaatacaaaagatcaatgaagcaaaaagttgattttttaaaaagataaacaaagtcaacaaacctttagccacactaagaaaaaaagagatgacccaaataaataaaatcagagatgaaaaaggagacattgcaactgataccacagaaatccaaaggatcattagaggctaccatgaacaactatatgccaataaatgggaaagcctagaagaaatgtatcaattcctagacatatacaacctaccaagattgatccatgaataaatctaaaacccgtacagaccaataacaagtaacgagatcaaagccataataaaaagtctcccaacaaagaaaagcccgaaagctaatggcttcattgctgaattttatcaaacatttaaagaactaataccaatcctactcaactattccaaaaaccagaggaggagggaatatttccaaaccaatactacaaggccagtattaccctgataccaaaaccagacaaagactcagcaaaaaattacaggccaatatccctgatgaacactgttgcaaaaatcctcaacaaaatactagcaaactgaattcaacaacacattaaaaagatcattcatcatcacctagggtcaggcagggatgcaaggacagttcaacatacaccaatcaatcaatcaatcagtcagtcaatgagtgtgatacatcgttatcaccagaatgaagaacaaaaaccatatgaccatttcaattgatgctgaaaaagcactggataaaattcaacatcccttcatggtaaaaatcctcaaaaggtacagaagaaacagatctcaacataataaaagctgtatacaacagacccacagctagtatcttactgaactgggaaaaaattgaaagcctttcctttaagatctgaaacaaaacaaggatacccactttcaccactgctattctacacagtactggaagttgtacttcagtacaaactttgagaaaatgacagtggcttcaataaatggtgctgggaaaactgaatatccatatgcagaggaatgaaactagaccccatctctagccatatacaaaaatcaaatcaaaatggattaaagacttaaacctaagacccaaactatgaaactactaaaagaacacattggtggccaggtatgatggctcacacctgtaatcccagcactttgggaggcagatgcaggcagatcacctgagatcaggagttcgagaccagcctggccaacatggtgaaaccctgtctctactaaaaatacaaaaatcagctaggcatggtggcagctgcctgtaatcccagctacttttttgatgtgcaaaaccttttaacttgataatgtgcttgcagggtattactgaagaaatcttttcccagagcaatgtcctggagggtttccccagtgttttcttttctttttttttttgaaatggagccttgctctgtcgcccaggctgaggccaggcgaattgcttgaacctgggaggcggacgttacagcaagccgagatcacgccactgcagtccagcctgggtgacagagcaacgctccatttcaaaaagaaaaaaagaagaaaacattggggaaaccttccaggaaattggtctggtctgggaaaagatttcttcagtaataccctacaagcacaggcaaccaaagcaaaaataaacgaatgggatcatatcaagttaaaaagcttttgcacatcagaaaagtgaagacgcaacccacagactgggagaagacatttgcaaactactagtctgataagggattagtaaccagactatataaggagttcaaacaactctacagggaaaagaaaaaaaaatcaaatgatctgatcaaaaaacgggcaaaagatctgaacagacatttctcaaaaggagacaaacaaatgggatacaggatatgaaaacatcactgatcatcagagaaatgcaaatcaaaactacagaaagatatcatctttctccatttaaaattgtttttatccaaaagacaggcaataacaaatgttggcaaggatgtagagaaaagggaatcttcgtacactgttggcagaaaggtaaattagtacaaccactatggagaacagtttgggggttcctcaaaagactaaaaataaaacgaccatatgatccagcaatgctgctgctaggtatatacccaaaagaaaaaaatcagtatatagaagatacatctgcactttcatgtttactgcagcactagtcactacagctacaatttggaagcaacctgtgtctatcaatatacgaatggataaagaaatgtggtacatatacacgatgaagtactactcatccatataaaagaatgagatcctgtcatttccaacaacatggtggaactggaggactttatgttaagtgaaataagccagacacagaaaaaacaaacttcacatgttctcacttatttgtgggagctaaaaatttaaacaactgaactcatgcgatagagagtactagaaagatggttactagagtctaggaaaggtagtcagagggtggaggggaggcagagatggttaatgggtacaaaaatatagttagaataagatctagtatttgatagcataacaatgtagttacagtcaataataacttactatacattttaaaataacaaagagtataattggattgtctgtaacataaggaagggatacaggcttgaggtgatggacaccctatttactctaatatgattattagacattgtatgcctgtatcaaaaatatctcatgtaccccataagtatatatactacgtacccacaaaaattaaaaattaaaagtaaaaataaattttaaaaaattcattcataactaaacaaagataatatgagagtaactatcaagtatccaataagtgaacaaaatacactcttagttaaaactactacaaataatacaaccttccacagcggtcttgttctggcaggcaagctataaagactagagaagaacagagggaaaaaaaaaaaacctaagagtactttacttgaaccaatataaatactttcagctgttcttatcaagtcctcagaactctgagggagtgtttttgtgagaacttaggatgtaaaattatgctttccattcctattatcattcactaatgacagagtagtattagagtatgatgaatggcttgttctctccatatctgagatggagaaaaagtaagataattctgtaaataaattaaatcactgtctaggagacagaaatctgctataatcttttaaatatccttaaatacagatacatctaattcaaggcagaaagataaatcacaaatcttactcttttttgttttaaaataaagacaagaaatttcttatacatacagatgagttttaagtcaactacatttctatcttagacaaaactgtttaagagctcacctaccttaaaatattctacaagatctctacaagtgactttagatccacttatctctttttctaccaaattttcaggggcaagcagcaatggaaccagatttcgaagctctcgtttaaagtcttcatcaatatctagaaaacaaaaaattgagcaacatattagtccaaaaaaaattaggtccccactggtacgatttcataaaattctgttttatgaaataagaatacatagtatctattactgaagtggattcattttttaaaaaaaagctcatccaacatgccatatctcataggaaaaaatataatcccccttactctactagcccattttccccaaccccctagtaacactgccagttcaaataacaaataaaacatcaataaatttgtggactaccaagacaaatttcacatttagtattaacgaaaatgtccttttcaagaggcaaacaattcataaaattgtattaaattttactactagattatgttttaccagccatactgtaaaagttttgtcaatccccaaatgttttgccaacacactcaaaataatcctacaacatacataaactgtactatcactcctgaaacagacacttatatctgatttcatcaatataataaaatgataaagccttttagcagactgcaatcaattgaaaagaaatgctctcagccttcagaattttcaggacatcactgctgagcaacagacattataaaataggttaatcaatatgctagacagctgcaaacaaatcaatggaatgctagagaaacaacacagagcattacaaccacaacatgaacaatgcatccaaacattctccagtataagacaggacatttaaggcgtcatgtattttcttaaaaaactttccacctctaataaataagttcagattttagcaagaatgggaattcccacctttcaatctcccatcaaaactaggattagttgcaactttaagaccaggatgtggcaaaaggaagcaaccaagatttgagaaacaattgtgtatgtgcttccttacattctgaagctcttcatgttgattttgttttacctgagggcggagagagacaggtgaaattgtaaacagaagaaagaaaatttttttaaagaaaatgcacacagactcgcatgcacactatgcacacttaactcagatggtactcctaaggagtcttttttgacaatacaaaaaattatgaaggcccatttctgaccactttgttaagaccccacttttttttttttttttttttttttaaagacagagtttcgctcttgttgcccaggctggagtgcaatggtgcaatctcggctcaccgcaacctccgcctcccaggttcaagtgattctcctgcctcagcctcccgagtagctgggattacaggcgtgcaccaccatgcccggctaattttgtatttttagtagagacagggttggtcaggctgatcttgaacttccaacctcaggtaatccacccgcctcggcctcccaaagtgctgggattacaggcatgagccaccgcacccagccaaccccacattttcttaaaccacaaaagatgtttttcccaagtaagctgcctggaacagcaaaaactacaaataaggtagttaatcacagtatctaataaccaaataacaaattatggctgtgacttatacaccagtaaataaattaagaatttacctttaaagtacttacaacagcaacaaaacagaacaaaacaaaaaaaaaagtataaatttgcctacaaataaaaagtttagcccctgaacaaagtaaaagctaagataaaaaaaattacagtgcagtacaaagaccttagaaatgtgttagaatttcaggtccctctctacatgattatttatgatttatgctagttaccagaattttgagaagggaaactgccatgtattagggggaaaaaaatcttaaacttagaaacattttagataattactcatttatcccaatataactcacacagtctcctaaacactcttctggaaaacaattttaacaaaatatgcgctatttataattaaaacctggaaactacctaaatctcccatcaacagcagaatggaaaaactgttgtctattcattcaatagatactatacagcaatgagaataaataaattaaactatatgcaacatggattaacctcagaaacataatattgggtaaaaaaagctagactcaaatacattctgtatgtgattccatccacataaagtacaaaaacaaagcctgtgagaagtcaggatactggtagagggttttgggggaaggttgctgtatggaggtgagtgcttctaggtgctggctaaatggctatgttcattttttataaattcatcaagctacacacttatgatttgagcaattttctgaatatatgtataacatttcaataaaaagtttaaaaactttcttgtctttgagttacataattctgagtttagttagtatgtctattgtgctttgtgttaatttcttctgaacaaaccagaaacagaaaatgctgatgactgaaattatttccaaaagtggggtctggaaatgcctttcaaataatctaagaatgttgaattggttttaatctcattttaaaactaaaagaaaattatatcataccccaagtctttaatgcagttgagaaaccaaatgcatcattcccatagacaaataaaatcttatcaatgaaagacagcaccctcctaatgaataaaggggtctttatgtatcctttgtgtgtgtgagtagatgggtagcctgtaagtatctgacctgcaggtttcccaaattgatatggtttggctctatgtccccacccaaatctcatctcaaattgtaatgcccatgtgtcgggggaggggcctggttggaggtgattcatgggagcagaaatcccccttgctgttcttttaacagtgagtgagttatcacgagatctggttgttaaaaagtatgtggcacttcccccttcactctctctctcctgccatcttgtgaagaaggtgcttgctggctgggtgcggtggctcacgcctgtaatcccagcactttgggaggccgaggtaggccgatcacaaggtcaggagttcaagaccagcctggccaacatggtgaaaccccgtctctgctaaaaaatacaaaaaatatgccaggcgtggtggcgggcgcctgtaatcccagctacgggaggctgaggcaggagaatcgcttgaacccgggaagcggaggttgcagtgagccaagatcgtgccattgcactccagcccaggcaatagtgtgagactgtcttaaaaaaaaaaaaaaaaaaagaaggtgcttgcttttcccttcaccatccgccatgattgtaagtttcctgaggcctcccagtcatgcttcctgttaagcctgtggaactgtgagtcaattaaacctcttttcttcataaattacccagtctcaagtagttctttatgctgtgtgagaacagactaatacacaagtacttccatggggggctacctttaggaataaaggatcatgatccttaattttgattcaaggacactgtcttctttggtaggaatgcaaccactttacttttcatcaattacaaacagagtcacttgggctaacctggaatactttattccaacgacacgtaaatactggtaatgtgaccagcagtccggacagcccacccgtttgcctagcttggtgcttatgttctcctctttaagcattagggtcttacctgtaatctcttttcaagaaattgctttccaccttccaaaccatatgaatgttcataaggatagctccaatctcgaatcaaaaacattaatgtctatacacagaaaaaataaaaattgtttattttacaataaagaaaatttacgaaaaaatcacaactcttaacaattgaagcctctcttactctcctaaacaatccttatcaaaagttatagtaactaaatggtcagtactggtcatggttatatcaaggacccacttaaacaacattctcaggccctataccaagcaatcgctgccactgaagaacttcactaaatataaagaaagagtcaccacaagcagtaatacaggactttaaaaatgaaaaatgggtgtatcaggacacacggatcataattttaaatcatggttgtgtaactacaagaccaactaattctagatggctatctagactgattatagatctggggtcaataaggacattttcactcacagaggatgtttttactcatatagggttagatttctcaaatgctgacattttgggtcagcactgctgacattttgggtcagttaattcttagttgtgtgtggctgtcctgtgtattgtagaacgttgaaccatatttctggcctctatatgctagataccaagaggcactaagctctcccacaaaactgtgacaaccaaaaatgtctccagacattagcaaatgtccccttgggtggcaaaatgatcccagttcagaaaaaactgatataggccaaatagggtatatttcacctatatatccaaaaacgaaggcatcatctgctcaactacttaataaaagtgaccatactagccagacaagagtgaggcagaatcaatgtaaacccattaagattaacaatcagtagcaatgctgtcataccggaaaggcttcacacacttaggagcaaacatggtagagtcatgctctcctactgtaactgcagctcaccaaacagtattaatggcaacttacaaattacacttgcttcaaaaaataaactatctggaacttttctatatgaaaccaaaataaagagtaacagaactaatttcaacttgtagtaaaccacaaaaaagaaacctgtaacattctgtagttaccacgtataaaaaaaaaatggcatgactgtcatatatttcctattgtcttaagtttagaataacatctgttaagagaaacattactccccttaatctaagtgaaagcattaagaattagcctagattcatttattctatttatcctgttcgcctactgataagtatgctgatgatactaccaaaggttagtttcgattgcactgaatctgttgctagcaatgagtctattgtaatatcctggtgtctccaaaattacaaactgaggtggcttcacaacttctcataggctaatctttaaaatgttagaataacttttttacctgaaatggtttctggtagatttcttccatcgcaagtcttccatactctgtaaataactattaaatagagttagttaaaataatgcctctaaagagattgaaagaagacatgtgtaaacctgttccacaccaaagctccaggtaccagaacctttaaaatcatttcaaagccaaacatttaattttctaacacactaggtatgtacaaaatttcttccagttaagaagtcatacaccagtttaaacccatataacattcaatcgtgttaccagtattataggcttccaagtgtaaattcataataaagtgagaattaaatttcaatagttggcacattttctttaagaaatatgtgctcgcagacgggcgcagcggctcacgccgggtaatcccagcactttgggaggccgaggcgggcggatcacccaaggttagaagttcaagaccagcctgaccaacatggtgaaacttcatctccactaaaaatacaaaattagccaggcatggtggcacatgcctgtaatgccagctacttgggaggctgaggcaggagaatcccttgaacttgggagggggaggttgcagtgaaccaagattgtgccaccgtactctagtctggggaacaagagcgaaactccatctcaaaaaataaaaattaaaaaaagaaatacgtacttgcaaatgttgaagatcatcttcttgaatattctgagacagattatatacctgttgaaacaaaatttattttgttttttattagtgttttgttctgaatacccagcttctgtataactttacttgtggaaaaaaggttattttgtatctcagcgcaaaggaatcatttaactactatcttgacaactgacatgtgaaaaggattttctcttttttcctaacaatagtcaagatagaatattaaggaagaagcagtggtggtaaaatatgcaaaaagcatgaatatatgtatactcatggcctaaaagtggtagaagaacaagtgtggtatctagtaggtttcttgtactccttctctaagctctttaatgttaagatacgatcattttttaaagagtgtaggttatttccaccatcatttttctaaattagtgaatataaggggcaacagtttacaaagataaattcttccctggtacaatcagagtatacagttactcaggggtacctccactactactgactctagtgtggttctctttttactcacactcctcagtttacttactcatcagttttcacttacactcaacatgacaattttactggcctgtggaagctaataaaagtaacagtaggtggcactcttgccctttccagaattttttggaggagactagagttgataaaggagggtctaagtatcctcaggaaacggggattttcatccattaattctaagacagatctttagacagtaatctacactgccacaggagaaaagtggccatcaacaaatatcacctctgctaagaaataacttacatcttaggaaccagggtgactccgaagagagaacaatctgttctaggagcaaataagtgatactctggctaaaccacttggaggtcaagaatatagtcaatttaggccagcaaacctaaaatgatattcttagctactaattccaaacaaggatttaaaaagtaattgatgactgaggtgattaaactttagattttaacataaaccctgacaccatgaccaacctatgtgggcctctgcttttagaaaataggtctggatcctttcattgtcagggccaggttgcaaacagcaaacagagaaagagatttatttaacttagatcattagtacttagcatactgtcttgtatgtaacaggtgctcagtatgtatttgttgaaggaataaatgacaagaagatcaaattatcatttatctatcagccagatatcttacataaggaaagaaaactaccccccccacccaaaggcaaggaagaaaataatcataatcttaatcttcttggttatttatactttacaaagcactttcatatgcattatctcatttagctctcatttctgactgcacacaacaaccacatccaagataggcaagatgagtaaaactcattttacagacaacaaagtggctgcacagctttaagtggctgtctaaaaccaggtctcttactatcaaaaagttgaataaataaacaaaaaaagactaagggataagttttaggacagagaactcgagaactccctctagagccagctaacctgaggggcttctgcttgcttcaagggaatcacagctgtgccatcttgcaagatcagagaaaaaaagagacttagagggtccccaccagcgtcacttagtgggtaatgacaaatatcccaaccctataataaactgaagccaagctgaagagtattcttcttttagctcaggttaacagccaaccttctttccactctgatggctaggtacttcaaactgaggaaggaggaaaatgggagcttagagagacgagtcatatgttccagacattactggaaagcataaaaaaatccaagacactgtgacagcatcacctatgatctaccattgataagaacaatttcttatcttgggaggatcacatacccattttaaaaaaatatttgcaaatatacttcttgatacaccatcaccagctgggcctaaccgccatacttcaataattcatttttcagagatgtatcagccacagatgatctcagaaaagaaaaagtaaagaaacaccaaatgacatgtggtagtttaattcagtccaatccatctaaattatacagaaaagaaatggcctagcctgaagaaactagaaccggatagaacaccaaacacaatttgaatataagtgaaaaagagaagggattttatcccttcctaaatgaaggtgctaaaaatcctcagtttattattacataagccttgtctgggtttcctaaattaaacattaagtaattactctgcttttatctcctttagttcaaataactgagtaccacttgtcatagatacagaataaaaaactagacttctaagcttaattacctgggttttttgtttgttttagccaaaaaaacaaaaatatactctccatattactgtgtctggtagccatctatctgatttcaattacagataacatgtgatatcttttcctttaaaaaaaaaagtatgtattccataatgaaaaactaaagagactggttgttggtttattgcatcctttgtaactatccaaagtacaaaatttcacatcataagccagaaaaccatgcatggaaatgtaaataaccaataagaaatgtaaatagctctcaagaaatgtaaatagcttccttttttttcccttcaatcaaaaggcattttgccagcacaaggtggcatatgctgacagtcccagctactcaggaggctgaggcaggaggatcacttcagcccaaaagctagagtgtgcatgatcacacccatgaatagccactgcactccaacctgggcaacatagtgagaatccatctcaaaaaaaattaaaaaggcattttcaagaggggcaaatgccaggctcagtggctcacgcctgtaatcccagcacttggggaggccgaggtgggcgggtcacctgaggtcaggagttcgagaccagcctgcccaacgtggtgaaacccgtctctactaaaaatacaaaaaaattagctgggcatggtggcgggggcctgtaatctcagctactcgggttaggagaatgaacccaggaggcagaggttgcagtgagccgagatcacgccactgtactccagcctgggcaacaagagtgaaactctgtctcaaaaaagaaaaaaaaaaggggccaaatgattacgtgaactgatcgcaccacttaatcttgtgtctcacctggacagagctagtcatagtgctcagagcaaacaccgttgcacagtctttgatagttgactggctatcaaaggcaccctgggtatccataagcagcacagcaacctaggaatttgagagtttaaaatatttagtaaaacagttgccaaaaatgactataaaaaaaatcaaatgataaatttgaaaagcagtaattaaatcaagaaaagtacttatatctcatacatttgacataataatccgtatgttaaagttatcaaacattaatagttctgtgttgttttgatttttaatactggaaaatagcccaagaaagaatacagggtagaaaagtataaacagaattttactttagttccattaggtctgtcaatcacaaatacttcattccaaacttgtatgcctgttgtttctctttcacagccacctcgccatgtaaagcctgtcaatggttcattgtttccaccaatccaactttgagaatcctgttaaagtcaaggataaatgtaaaatacaacacaattaagaaataaaagaaaccaaaaaatcacccattctttattttacagatggggaagctaaacccggaaagacaaaaaaaacactgtgtaacaaacaagtagttacaaagcagtccttaaatcccatgtggggttctttttcttatagagacgtggtctcctccaaactcgaatcttctcaaatcagctcacactactactctctaggcttctaaataagtggggttatactcactttcccccttttctgaaagatatcctggctgggcatgacagctcatgcctgtaatcccagcactttgggaggctgaagtgggcatatcacttgaggccaggaatttgagaccagcctggccaacgtggcaaaacgccatctttacaaaaagtacaaaaattagccaggcgtggcggcacactcctgtagtcccggctactcagcaggctgaggtaggaggatcacctgaacctgggaggttgaggctacagtgagctgagattgtgccactatactccagcctgggtgacagagtgagatcctgcctcaaaaacaaaaaaaaaaaagagagagagagagagagacagagaaatatttcctaaaatgttaaaaatcataaaaaactcggcaccaattattttaacatgttgttacacagataagcaaaactaagttccaggtagaatgactgtcaaaacagcactgctttctcagaatagcttacagtaagttttcatactgccttcatttcctctttaaaaaataatcaattttaggctgggtgcagtggctcatgcctgtaaccctagcactttgggaggacgaggcaggtggctcacctgaggtcaggagttcgagaccagcctggccaacatggcgaaactccatctctactaaaaatacaaaaattagccaggtgttgtggcatatgcctataatcccagctactcaggaggctcaggcaagagaatcacttgaacccgtgggcagaggttgcagtgagcagagatcgcgccactgcactccagcctggccaaaagagcgaaactgcgtctcaaaaacaaaaacaaaaaaaatcaatttaaaaaataaccccaagacttgtttggagcctgatttaaacaaaccatctatttaaaacgtcttttttaaaccaacaggaaaatatgaacccaaactggttatctcattagatggtgttaaattagggtaaggaagattgtttggtgtgctaatgatactgtggttaggaaaaaaaagagtccttatctattagatactcaagtatctgcagtgaaaggatatgcctggcatttgctttaaaatattccgggaggtaaggaaaaaagagaacagataaaacaagaccagcaaaatgttgacaaatacattggagttcattatacaattctctttattttagggtatgtttaaaattttccataataaaagtttttaactagaaccacagggctaaattgttattatgaaataatacaaaagttaacatataaggtaatttttctagaaaattaaatgtgggacataataaatgaatacctttgacagacgtcaagatccctaaagtttagtatacttaaagcccacatagcctttactcaatgtaccccacaggaaaaacgcctttgtttcagaaatacttctaataagcttggatatctagtctaaaacaaattacaaagcgtgaattaggagtggagagatggttaagacaggaccaatgagggatgaagcaatttatgaaaagcagacacacagtggcaaaaacaaaaacaaaaacaaaacagtgtcagccaggcacagtggctcacgcctgtaatcccagcactttgagaggctgaggcaggtggatcacttgaggctaggagttcaagaccagcctggccttggtgaaaccccctctctaccaaaatgacaaaaaaaaaaaaaaaaaattagccaggcgtggcggcacatgcctgtaatcccagctacttgggaggctgagggaggagaatcgcttgaacccgggtttcaggtgggttgtgggaggtggaggttgcagtgagctgagatcgcaccactgcgctccagcctgggcaacagagagagactgtctcaaacaaaacaaaacaaaacaaaaagacagtatcattcagaccatcacctaacatagccttaaacttcaaaccatctttaattattattattattccacaaaactcccatccccagtaggccaccaatcctatcaattacaaacttctcttggattcatttctttttcttcagttttcaatacctacaacttaaagacctcatctatgctggtcagaaggggctgccacctgagacaattccattcacagtatatatgatggacttgtgtttcaggaggcacccttcacaggaatcagaagattattttgacactccccggacaagtaaaactggtgatcctgccccttgactacatatttggatacttcatattggtctctatgcaactcctgctctatcctctaacccatttttccatagtcactgaatgttcacaagaaatgtaatcgtgccactgtcctgctgaaaagtcatctgtggctccgcactaccaataagaccatctggagatctgctgcataacaatccttttttctctttttcttttttttctttttttgagacagggtctcactctgtcacccaggctggagagcagtggcacaatcagaactcaatgaagcctcatcctcccggactcaaaggatcctcctacctcagcctcctaagtagctgggactgcaggtgcacaccaccacacctggctgattttggtattttttgtagagagggggtttcgccacgttgcccaggctgataacaatccatctttaatttactcttcttgtctgtgctcctgatactccccatagatctcaacacacatcttcctgattctaccataccaaaaaaagttaccatttataaggagttacctttatatggttttgcagtttttttgtgagtctcttgagagcaaaggctacaaacaatcatctttgttcaccaaactgctcctatcaaagtgccttgcactgttgtaagttctgacatggagaatctcattcccccacaatgtcaaaaaaaaaaaaatctggtacttaatgaatttattatttgtaaaagttacaggctacacaaataattcctctaagagaactctggttttactctacattttacttatttctatctcctctacaagaaggtaagtttcacaaaagttttgtttgtttcattcttacaagtattcccatcacagagaagtgtgcctggcttgtagttggtactctaagtatttcttaaacaaacaaaaaagtttacttataagcttcaatgtactcccttttgagcatgggtaataaatccagaagaaatatgatctttgttattattcctagaaacaatacaatcataaaaagacagtaaaaataaatttttataagtatagatgactgaaatcataggcttatatgtttgccagccccctcttccaaagaaactttaaaaagaattggtgtctcataaaaatctactatgtatcatctcttcctaggttaccttgtaatggaaatgtttaaaaaaaaatactaaactgattagtcagcaaaaggatgaaagaagctgagtgtggtggctacacctgtaatcccagcactttgggaggccaaggcaggaggatcacttgagcccaaaagttcaaggctgcagtgagctatgatgatgccaccacactccagcctggatgacagagtgagagaccctgcctctatttaacaacaacaacaaagatgaaaaaataaatcagagaactaatcagattctttaaaacgtgtaaaagtgtataatttctctaacatagtgaacactgacagctttcataaaatacagtcattcattcattaaatatttgtggaacctctaccatgtgccagccatttttctagggatacagcagtgaacaagaataaacattcctgcccacaaagagaattttagtgggagctaaaggcagccttgctgataacagaccctatttgctgtgataatttactaaaagcaaacctaaaaactcaaaaacactaatctgatactatttactactatggagacaaaagcctcaaaactcagaaatgcaaaagtaatcctattccaccagacatataaagtaaataggaaaaaaagaagtatttatagaataaaactcaactgcaaaaggcaatctgaaatcaccagaagttttttttttttttttttttttttttgagatggggtctcacttgctatgttgcccaggccggtcttgaactcttgagctcaagcaatcctcccacctcagcacctcagcctctcaaagtgctgggattacaagcatgagccaccatgcccagcctgaagtttaagtataatcaaatagtgaataaatacagcccttgccaaaaagacgttctacataatataattatcagcaattaagaaaccttacctattctaaacagtaagaaacaaattcatattttaccaaaggaaaggtatactccctagcaacaaagtgaaacaactatgtaaccatttatttagttagttagacagagagaaagaaaacgagacagacagacacagacagggtcttgctctatcacccaagctggagagcaatggcacgatcatagctcactgtcctcgacatcctgggctcaagtgatcaaagggttggttgtcctgccaggcctacatgtatcagagcacacccgctcctgactgctggcaagctgactccctttcacaatggataggctggaagaataaaggttcatacaaaagccataaatcatcacaactgggagtaaaaggaataaaaagaatgaaattaagatccaagtgggccggtaaggtggctcacgcctgtaatcccagcactttgggaagccgaggcgggcggatcacctgaggctgggagtttgagaccagcctgaccaacatggagatacccagtctctactaaaaatacaaaaaaattagccaagcatggtggtgcatgcctgtaatctcagctactcgggaggctgaggcaggaaaatcgcttgaacccgggaggcggaggatgcgatgagccaagatcgcgccattgcactccagcctgggcaacaaaagcgaaactcagtctcaaaaaaaacaatccaagtagtgctacaataataagcgagatcctccctagttgcatgacattccccacaccaccacaaatgaaaatcttcatgtgtataaaactagtacctaatcaggagacaggttatgaacactcagcacccaaagtgatggacacaataaatactgtacacattctaaccaccaattgtatttactgttttcatttgaatatgtgagaatactctgcaagtcctggaacaaattataaaacatttaactttaaaacagtttaaaactgtctaacatcttatccaaccccattcccaccccatgcccaactcttcccatctggggctggacaaatcaatgaaattatgactgacccaagtcatgagcccagaaaaaggacaactctaactacttaggtacatgctgaagaggaatttaacatattttgataaaaggttctgctcaaaaggtgtctttgaccttgaagacactatgctaaatgaaataggccacacacaaaaggacaaatattctatgattctactcatatgaggtgcttagtcaaattcatagggacagaaagtagaatggtggatgccaggggattggggagagaaatggggagttagtgtttaatgggcacagagcttcagctggggaagatgaagcagttctggagatggatagtggcaatggctacacaacaatgtgaacagacttagtgccactgaagtgtacacttacaaatggttaaagaggtaaattttatgttatgtatatcttaccacaattttaaaaaaagttgcccttgagggctaacaaaacggaaggggcagacacgtcttgtaattaaactgagatttgactttagagtcttccattggacttccagtgtcagctttctcatgtaaaaagtttagaagtcatcagacctatctttacaacaagagaaaagcttagcaaactgaaaaatcaataaactctcctttcttagatcaaagaattgagatcacaggtcaaaccatccctgcaaaatcacaagagacaaactaacacaaaggatcaggagttgaggtcagcttaccagcaactgctgcagcaactggtaggaacacttaaatggcaatttcaatgaattgtcagaagctgagagtgaactagtttaagcactaaaaaccctagaggctcagtctaagaaaacaccccactttcctgaatattatctcaaagaactccacaaaattctcaaagtaattacggaagaaagtttccctcatgactgacaaggggaggggaagtaacactttttaagttcaccctgggaaagtaaccactatctacacacacaccagtacatacacacacacacacacacacacacacacaccagtacacacacacacacacacacacacacacacacaccagtacacacacacacacacacacacacacacacacacacacacacacacacacacacacacacaccagtccccacaacaaaagcctgccctcctgagaaaactactttaccagagctttatctgaccctagggaggagcaattaaattagccaactccagccccatctaggcttcctgtctagtttaaggttttgtttgtttgtttgtttaaaaaaaaaaaaaaaaaaaaaaaaagagggtcatagaccaggactcaggcccactaaaaaactaaggagccaggtgcagtggtgtctgcctgtaatctcagctattcaggagactgagctcaggagttccagaccagcctgggcaacataaggagactgtgtctcaaaaaagaataaaaataaaactaagatttaaccataaggtggcatacgatgcttctgctctcctacactttaccacctcatcaacaatgctccaatataatgacagtggattacaaataaaaaagctgcaagacacagattttgagttcaataaaagttcttgggaaaccccaaagacagtgagagaataaggagaaactgaagcctctaggacctgcagctaaaaaacacgttaaacacagcccatctcccaactagattaacatataacctcataatagaagcctaaatcttcagtctttattacctgatacttcatgtctggctttcagcaaaaaattacaagccatgccaaaaggcaagaaaaaaatagactgaaaagacaaggcaaacaacagaaccagactcagatatgatatatttcagaattagaaaataggaaattgatccaggaagaggacagaacaccaagcaggataaataccaaaaaaatccacactaggtatatattatagcctagctgcaaagtaacacaaaaagaaaatcttgaaagaagccaggaacaaaacacttttacctacagaggaacaaagataagaattacactggacttcccattacaaatcatgcaagcagctgggagcagtgactcatggctataatcccagcactcggggaggccgaggcaggtggatcacttgaggtctggagttcgagaccagcctggtcaatacggcaaaaccccatctatactaaaaatacaaaaattagccaggcgtggtggcacacacctgtagtcccaggtacttgggaggctgaggcaggagaatcacttgaacccagaaggcagaggttgcagtgagccaagatcgcaccactgcactccagcctgggcgacaaagcaaggctccatctcaaaaaacaaagcaaaacaaaaatcatgcaagcaggaaggaaatagggtgaaatgttgacaaagctggaaaaaagaaaaaaaaaccccaccaaactagaattctgtatccagtaaagttatcctacaaaagaagtaaagactttcttagccaaaaaccaaggaatgttgtcgccaatacgtcagcaaaaaggaaaatgatataggtcagaaactcaaatctacataaagagaaagagtatcagagaaggataataaggtaaaataaaatcttttaggtggttatagtatatagataagggaaacaaatgacagcaatgtataaaagagaggaggaattaggaatacgctaaggtaactgcactatccatgaagcagtataatatctgaaagtggacttagcttagttgtaaatgtacattgcaaactccaggcagccaccaaaaaacacgtttaacagatatattaagagagtacagaaaacgcaatcaagtaaaatgttcaattaaaattggagaaggcagaaaaagaggggaatataaaaaaaaaaaagtacaaaaaaaaaaaaaaaacaccagaaaacaattataagcatggcagctacaaatccaattatatcaacaatcactttagatgtgaatgacctaaatacaccaattaaaagaaactgttggccgggcacagtgcacatctgtaatcccagcactttgggaggcagaggtgggtggatcacctgaggtcaggagttcgtgatcagtctggccaacatggggaaaccccgtctctattcaaaatacaaaacttagcggggcgtggtggcgggtgcctgtaatcccagctactgaggaggctaaggcagaagaaccatttgaatcagagaggcggaggttgcagtgagccgagattgtgccaccgcactccagcctgggtgagagagtaagattctgtctcaaaaaaagaaattgtcacagtgggtttttaaaaaatagagccaactatatgctatctattttaaaaactccactttacaaagacagacacaggttagaagtaaaggtatgggaaaaacataccatgccaacactaatcaaaagaaagctagagtagctatgttaattacagacaaagcagttttcaaaataaggaaacataaaaaccacttcagaacaaagattaagagttgcattacaccaaaatatgtgaagcaaaaattgaactccaaagagtaacagacaaatccactattatactgggagacctcacacctctttataggtagctgacacacccagcaagtagaaatccaataacatagtcgagctgaacagcatcaacaatcaaatggatctgacattatagtatatttcatccaacaacagcacaatacatactcttctcaaactcacaaagaacattcaccaaggtagaccatatcctgagccttaaaatacacctttaaaaattttaagggatagataatacaaagtatgctctcataccacaacagaattaaactattactagaaatcagtaacagaaacacagctggaaaactccccaaatagttggagtttaaaacaactcacctcaaaatgacacaggagtcaaggaaatctcaatagaaattttaaaatatattgaactaaaggaaaatgaaaatactacctattaaaatatatgaaatgcagcaaaaaccatgattacagaatttatagcattagatgcatacagtaggaaagaaaataagatctaaaaccaatactctaagctgccatctcaggtaactggaaaagaagagcaatataaacctaaagtaagatgaataaaatcagagcaagaactgatgaaattgaaacaagaaaacagaaaatcacaacagaaaaaacaaatcagtgaaacaaaaaactgatccttcaaaaagatcaatataattaactgaagagagaggggagaaaaaagataagacaaactagtatcagaaatcaaagaagaatcttcattactaattccttgaacattaaaaaaataaaagaatactaagaactctatgcccacaaagttagtaacttagttgaaatggagcaattcttggaaagaaacaaactaccaaactcacacaaggagaactagatcatctatttaaaaaaaaaaaaaaaaaaaggccaggcgtggtagctcatgcctgtaatcccaacactttgggaggccgagatgggcagatcacctgaggtcaggagttcaagaccagcctggccaacatggtgaaacccccatctctactaaaaatacaaaaattagccaggcatggtggtgggcgcctgtaatcccagctacccaggagattgaggcaggagaatcgctggaactcaggaggcagagggtgcagtgggccaagatcatgccactgcaccctaggagacagagcaagactccatctccaaaaaaaaaaaaaaaaaaaaaaaaaaaagatcaataaataaccttccaaaagaaggatttacaaagcccaactgacttcactggaaaactctaccaagcatttaaggaagaaatggtagcagttctctacaaattcttttagaaaataagcagagggaatacttcctaattaattcaaagtattaccctaataccaaaaccagacaaagatactacaaataaaggaaaactgcagaccagtatatatcatgaatataaatgcaaaaatccttgacaaaatattagcaaatcaaatctaacaatgtacaaaaagaattacacaccatgatcaagtgggatttactccaggaatgcaaggctggctcaacaacttaaagtcaataaatgtaatccatcataacaatagtctaaagaaaaaaaatcagctgggcatggtggctcacgcctgtaatcccaacactttgggaggccaagtcgggcagaatacctgaggtcaggagttcaagaccaggctggccaacatggcaaaaccccatctctactaaaaatacaaaaattagccaggcacggtggtatgcacctgtaatcccagctactgtggaggctgaggcaggagaatcgcttaaacccaggaagcagaggttgcagtgagccgagattgtgccactgcactccagcctgggtgacagaacaagactgtctcaaaaaagaaaagaaagaaaaaaaaaacacatgataatatcaataaatacaggaaaactatttgacaaaatccaacattcattcaggatttaaaaaaaaaaaaaaaactcccagcacactaggaataaagaaaaacttcaattaaaaaaaaatctacaaaaaatcctacagctaacatagtagtgagaaactaggtgctttctagaaactaggttagaaaacagacaaggatattcattatttatcacttgtactcaatactaccagaggttctagctgggaccatcagccaagacacagaaataaaaggttcccaggtaagaaagaaagaagtaaaacaatcatcatttgcagatgacatgatgttgtatatagaaaactcgaaggaatccgctaaaaaaattattggaactaatgaacaaattcaatttgtttcaaggatacaagatcaatatgcaagtcaagtatatgaactatacacttgcatgaacaattcaaaaatgaaattaagaaagcaattccattcatagtaacatcaacaaaaggaataaattgaagaaaagtgcaaaacttatactcaaaaactataaaaaaatgtttggatctaaataaatggaaaaatatcccatattcatggactgttagacttaatattgttaacacagtagtatttcccaaattgatctttcagattcaaccaatcactgatagaatcccagctaacttcttgtagaaactgagaagctaattctaaaattcatatgggattgcaaggaacccaaaatagccaaacaatcttgaaaaagaacaaaatgggactcacttcctcacttcaaaatttactacaaagcaacagtagtgaagacagcgtgatactggtataagaacaagacatggccgggcgtggtggctcacgcctgtaatcctagcactttgggaggcaggcagattgcctgagcgcaggagttcgagacaaacctgggcaacacggtgaaaccctgtctctactaacatacaaaaaaaaactggccaggtgtggtggctcatgcctgtaatcccatcactttgggaggccgaggtgggcggatcacgaggtcaagagatggagaccatcctggccaactcgatggtaaaactcgatctctactaaaaatacaaaaagtagctgggcatggtggcgcacacctgtagtcccagttactcaggaggcggaggcaggagaatcacttaaacccgggaggcagaagttgcagtgagctgagattgaaccactgcactccagcctagcaacagagtgagactctgtctcaagaaaaaaaaaaaaaaaaaaaaaaattagccgggcatggcagcgcatgcctgtagtcccagctacttggaaggctgaagcaggagaactgcttcaacccaggaggcagaggtcgttgcagtaagccaagatcgcaccactgcactccagcctgggcaacagagcaagactccatctcaaaaaaaaaaaaaaaaaaatagaacatgtatacagatcaatggaatagaactgagagtcaagaaataaattcatatatctataatcaactggttttcaataaggtatcaagagcattcaatagtggaagtgttgaaaagtctttccaaaaatggtgctgggacaaatagatacataaccaaaaaatgaaggaagaaccctctttcacatcattattatgacatatacatatataaatatattttatgtaattaacattatatattaatatgattatagcattattcctaatagtcataaaattgcaaacaaaccaactgtccattaactgatgaatggataaagtgtggtatatccacacaagagaatattattcagccataaaaagtactgatacatgctataatatggatgaaccctgaaaacattatgctaagtgaagccagtcacaaaagaccacattttttaagattcaacttacatgaatgtccacagagacagaaaatagattagcggttccttcaggttgagggtttggagaaaggatctgggggtaacagccaaagggctgtcacagggattcattttgagatgatggaaactttgtttctttttgagactgtgacttgctctctcccagactggagtgcaatagcacaatcagggctcactgtaacctcaacctcctgggctcaagacatcctcctgccttagcctcctgtgtagctggaactacagatacacaccaccacgctcggctaattttttgatttttgtagagatggagtctccctatgttgcccagactggtctcaaactcctgggctcaagcaatcctcccacctcggcctcccagagttctgggattacaggcacgagccaccatgccccgccaatggaaacatttttaaattaattggggtaatagttgcacaactctgtgaatatactaaaaaccactgaaccgcacactttaagtgaatgacttatatggtaagtaaattatatctcagtaacactgttaaaggaaaaacaaaaaatcaaatacctttagtgtacaagttcaacaaagactcctagtcacacaaaacccacttgtataacactaccagagtccaggggagaatgaatggcccactcaagtttctgttgactgtccatatactagtacaatgtgacataaatcttatgccttgaacttgcttcttgatgaaagaattatggtatacattctccaatctatacaaaatgtatcctattaaaggaaagaaatttgtgagaacaaagaaattctgaagccaggctcaatggcacatgtcttgtaagtcccagctacttgggaggctgaggcaggaggattgcttgagaccaggagttcaaggacagcctgggcaacagagtgagacttgatctgaaaagaaaaagaaaaagagaaagaaaagaaattctgaactaaaatttataagctgggccacgcacagtggcttacacctacaatcccagcactttgggaagccaaaacaggaggactgcttgagcccaggagttcgagaccaagctgggctaaaaagtgaggcccttcagggtcgatcacctgagcccaggagtttgaggcttcagtgagctgtgattgtgcctcttcactccagcctgggcaacagagcgagacgatatctctaaaaaagttaaaataattttttaaaaaatgtacaagctaaatagcaaaattgtcctggcagagtgagggaaggaggtagggagttaattaccttaaaaaaaaagtctcctccaaaaacagttagtattaacacaaaaggaacttatattatacaagatggcttaactccctaaatgttctaaaactggtggttgagtagtcagtgtttatgagtaacagtttgttgcttgaggtatttttcaataaatagcctaaataaaaccagttactttagaaacagttaatgtaacctactggaacaaagagtttggaatgaaaaaagatctgtaatttatgttctctcaaatccaaaatggaaatatgtgatgataggggtgccataatatttatgatactgcaaaagaggcaatacatacatttgggacttaaagctggaaaagctgcaaaggacagagtattttcaggcaacaggttcaggaacgtaaccaagaaagtctctcctaaaatgctgcaataaggacttcaaacaatattgtaaacacttccatctcgtttatttctgattcctctagctttggtaacatttgatgaagcttttctgactcaaatctaatccaatttaaaacctgcatagggaagaattaaaacttagttttgattccaaaatcaaagtctcagcagcagggaccccaatatgctaaggggaagatagtccacataacctctgtatccaatcctctttttttttttttttttttgagacagagtctcactctgtcacccaggctggaatacagtggcatggtctcagctcactgcaacctctgcctccagggttcaagaggttctcctgcctcagcctcctgagtagctgagattacaggcacctgccaccacccctggctaatttttctgtttttggtagagacggtgtttcaccatgttggccaggccggtcttgaactcctggcctcaagcagtcgacttgcctcggcctcctaaagtgctgggattacaggcatgagccaccgagcccagcccaatccccttatcttatattcaggtaataataataagcagcagcagcccacaatttttatttccttattgactcttaaaaatctggtcaaggccgggcacggtggctcacacctgtaatcccagcactttgggaggctgaggtgggcggatcacctgaggccaggagttcaagaccagcctcaacatggagaaaccccatctctactaaaaatacaaaattagccgggcgtagtggtgcatgcctgtaatctcagctactcaggaggctgtggcaggagaattgcttgaacctgggaggcggaggttgcggtgagccaagatcgcgccattgcactccagcctgggcaacatgaacgaaactccgtctcaaacaaacaaacaaacaaaaaaatctggtcaaagtttgcctgcttctcacattggcaaaaataataatataaaattcaaattatcagcattttgttacataagttctatagtttcaataataatattcaacattatagttataatttatattcaatatttatatattatataatatatattatataatatataatatatattatttataatatataaatatatttatatattataatatataacatttatataataaatataattaaataagctaaacttctacattaaatctggcaaatagtttatgagcaaatgaacttgtatacagacgtatacagataattttaaatcaacaaaatacacatcagaatagctaacattaaaaagattgacaatacagttcacaagatatacagcaactgtaagtctctcacactgctgatggaagtgtaaaattaatgaaaccacttcggaaaaaaattttggcaatccctactaaaagtaaacgggtatttccccctgtgacccagcaattctactcctgggtataaacccaacagaattcagtgcttacatcacaaagactttacaaaaatgttcattagcagttttattcataacagaaaaaaactagaaacccatatgtctatcagtagaaagggtaaattatgacatattcatccaatgaaatatcactcagcaataaaaataacatacaacatatttctgacacatgtaacaatgtgcatacaccagccttaatgcttagtgaaagaaacaagacacaggagtacatactctatgattacatttatgtgaagttctatagtaggcaaaactaatctacattaatacaagtcagaacaaaggtggcccttgagagccggagatagcagtaactgggaaggggaattagagagcctcctagaatgcaggaaatgctgtcttgttctgagagacagtggttactataacatatatatatataaaaatgcactggctatattaaggtttatacactttatgtatgtaagttacacccaataaaaaataaataataggccgggcgcggtggctcacgcctgtaatcccagcactttgggaggctgacacaggcagacaatgaggtcaggagatcaagactatctggctaacacagtgaaaccccgtctctactaaaaatacaaaaaactagcagggcatggtggcgggaggtacttggcagtctgaaacaggagaatggtgtgaacgtgggaggcggagcttgcagtgagccactgcactccagcctgggcgccacagcgagactctgtctctaaatacataaatacataaataaacaaataaaaataaaaagacccaaggaagcagcatttaaaaatattgttcctcctccaaatacatttcagtcttgagaaagaacataagacagtttttcttcatgtatttgcacatttcccatgaaatctcagacactgttatccttaaagaggaaggtaaaatcaagttcaacatcccatagggctcattctgagatatttgtgcttgtggcaagttatatgtagcagtgcgtatgattcttaaagatagttttttactcctggtctctggcaacagtttggggagcagctctttaaatagcaaagaataaaaacataaaggacagtttttttaaaatgccattaccaaatatgctgtagaaggagtcaaaactcttgagtagcaaatacagcaaggatcctttatttattgagcttagataccagtgcatagcaagaaaagttacatttgtactcacacatatcctcccatcagtctagttcaactctgaagtaaaccaaagtaaatatttataaaagaataatttagtgtaggtatatcctataaagtaacctgtactttacttattgtagatatatgggaaaatgaccaaacataattttacataatagtttttagaataaaggctctggcatcaaattgcctagtctcgaatttaagtcttgccacttactttgagtctcgtttcttcaactaccaagttgaaatataattatcactgcacagggttatttctgaatactaagtaagataatgcctgctaaatgcttagtaatcaaaataccaagaattcagtaaagattcaaaaaccgttacatcacaaaatagtatgtgcttcctaatggaagaatacgtcatcatctatgaagtactcttgccaaaagagcgtcaaacttgagtctgatgaagtctctagattcaactaacaacttacagaagattcacagaatgcagaacatgtaaaactacaccaacgggatgtaatctgcaaatccagagtgggaaaccctataaccaacaatcagtatcttcaacaaataaattgccaagaaaaagagagggagggagggaaacctaaaatgcattaaaacactttgaagacaaccaatcacaatgtggactattaaaaaaaacaaaaacaaaaacgaaaagcagttgaggtggccaggcatggtggctcacacctgtaatcccaacactttgggaggctgaggtgggaggatcattagaggtcaggagttccataccagcctaaccaacatggtgaaacccctatctctattaaaaatacaaaaattagccaggtgtcgtggtgcgcacctgtaaacccagctacttgagaggctgaggcaggagaattgcttgaacccaggaggcagaggttgcagtgagctgagatcacatcactgcactccaaccttggcgacagaacaagactctgtctccaaaaaaaaaaaaaaaaaaaaaaaaaaaaaaaggcagttgaggcaacttgaaaattgaacacttaaaagacattaatattaagggattattatttctatattattgtaatgttcaaaaaagtccttatttttaagagacacatactgtaatatttataaattaattgatcacagggatttacttcaaaataatatataaggtgtagactgagttagattatagatgaaatgagattggaattgataagtgctaaaaattgtttagtatatgggcatttattatattattgcctacttttacatgtatttattaataaaattcttcataataaagttttacaaagaaaaaacaggaaatggtataaaagtagaagcaactccatagagaattaagaatccttatctaggagaatttagtaataatagctatcaccattacttagcatcaatatcgtaagcactgtgtttagtttcatgtatattatataattctactaaattaagttttgaccattgtaaactgattcctagatttcaaactacaacagcgagacgtgacaatctaatcagcatttttctaacagttcctacagacactggaataatctatttcactttgaaaaggtttaaaatcatgcagccataaaaaaggatgaaattatgttctttgcagcaacatggatgctgctggaggccattagcctaagcaaattaatgcaggaacagaaaaccaaataccacgattttacttaaaagtagaagctaaacaagggtactcacgtacacaaagatggcaacaacagacaacggggagtactagaggggagagggaggaagagggcaagggttgaaaaactattggttactacgctcaatacctgggtgacaagatcaattgtaccccaaacatcagcattaggaaacacaccctagtaacaaacctgcacatatagcccctgattctaaaataaaagttaaaattatttttttaaagtaaacactttggattgtaactcaagtataaatgagcccacactgatataaaggatggaatgaataaataaataaatagggagaagatacacctcttcccaacagaagaatcctaaataatatatttagatgtcttcctcctatcagaaggtagagcttaatcctcctctttccctgttctttgaggttggggtggaattaatgactaaaaaatatcaagtctgcagtggtgaaacctggcaaacactagcttaaccaacaggtgaagagtaccattcctagcagtaccacgtgactatacatacccccagatacaatgtgatgagaagggtacttgacctcaggagtattctttccaaaatcccatcaccccagtctaaccatgacagaaatgtaagacaaacttaaattgaggaacgttcttcaaaatagcttaccagtatgcctcaaaatagtcaagatcaccaggctcacacctttaataccagcactttgggaggctgaggcgggcagaatcacctgaggtcaggagtttgagaccagcctagccaacatggtgaaaccccatctctattgaaaatacaaaaattagctgtgtgtggtggcaggcacctgtaatcccagctactcaggaggctgaggcgagataatcgcttgaactcaggaggcggaggttgcagtgagccgagactgcgctactgcactccagcctgggcaacgagggaaactacgtctcaaaaaaaagtcaagatcatgaaaaaagggaaaggctgagaaactcacagaccagaagaaactaaggagacatgacagctaaatctaggaatcgtattctgtattagagatcctggaatagaaagaagagcaccaatggaaaaactgcagaagccggaacgaagtcaaggacttagttaatagtaatgtaccaatcaatattggtttcttagttttgcaaatgaatcacactaatgataacattagaagaaactaggtaaaggattcaggtatacaggctctctttgttatattccaatataaaaaatgtgtttgaaaacttaaaaaaatatgacctctaatattgtgttaaaaatgaaaaaaacacttctaaaaaatcagctgacaaaaaattgtagtatcaaagcaaaaacccatcaacagttaaatggataagcaaaatgtggcataatcatacagcagaatatttatttttattttatttatttatttttgagacagagtttttctcttgttgcccaggttagagtatgatggcacaatctcggctcactgcaacctccacctcccaggttcaagtgattcctctgcctcagcctcccaagtaactgggattacaggtgcatgccaccgcgcccagctaatttttgtatttttagtagagatgggttttcaccatgttgccccagctggtctcgaactcctgacctcaggtgatctacccacctcggcctcccaaagtgctgggattacaggcgtgagccccaacaccctgccctcatacagtagaatattaaagcaacaaaaataacgcaaaaacatgagtacatctcaaagttataatgttaacaaaataagccaaacacataatacctatggtatgatttcattcacgtaaagttcaaaaacagtgaaatgaacctgtggtgaaaagttcagaacagcagttagttttggtggggggggggggggggtagacattaactgagaaggaacacaaagtgggggttgttctgtattttcatctggatggtggtagtaagggtgtatacctatgtaaaatttcatcaagctgtacacttaagatttgtgcaccttttctgcatgtaaattatacttcaaaggaaaaaaatttttaaggaaaagatacatttatctaaagcacacccctaaataagcaaataagaattagaagtggggggggcagggcatagaatacttgagtgtaacatttatttaggaggggaaagccaacatcccccacaccataaccatacccaccaattctgtctttgattacagattttaatctcctcttataaaactactcactactttcatcaactgcatacttacatacattgactcaagtcaacactgaaaacttaaactgtcagtatgtcactactctacttctttcagctagcatcccacctgtgcaggcatacaggttaataaaataaatccaactaccccattatttctccttctttactttcatctcataggaaaagcatgacccaccacatgatcagtttaagtggaggcacattatccaaaaatcagataccatttaaatgcaatttttgattgacagaataaggtgatttatatcaggaattctatagggcaatactataaatgaaagccaataaagacatttcagcttagaagccactaactagatgtataacctcactcaagccatcataacctttgcatggcttctgcaactcccccaggaaaagagagttccgtttgtgcagagattgcaaatacacggcaatggggggctgctactccactctgaacagccactactaactgatcagagatggaaacagaaatggcacctgaggtgaaacttatctgtcattcctagataagtgatctaagcttccctccccttctaactttctactgtctgtgacctacttggaacaaaatacatttgcactaaacagcttagacacagatagatacaatatacacaagctaacttaaggacttaagaggacctcaaaatatagaaatcctttatcatctttaaatgtacagtttttttaaaaaatatgccactacttaaacatttctctatttcagatgtaaaattctagatcaagtctaaataggaaaactttagctgagcatggtggctcatacctgtaatcccaacacgttgggacgctgaggtgggagaatcacttgaggccaggagttcaagaccagcctggacaacatagtgagaaccccatctttacaaaaaatttaaaaatcagccaagcattgtggtgcatgcctgtagtgccagctacttgggaggctgaggtgggaggatcacttgagcagaggaggttgggctgcagtctactaaactgacactaaaagccatgttcacaccaccgcactccagcctatgtgacagagtgagatcacgtctcaatcaatgagacaaactttaaaatgatgtacctttctcaatgtcccaaacatgtaaaacaaagttttctaatataaactatgctattgatactcaggtatatttgagaaagcctgaaatgatcgccatgaaaaaactttactgaaaagcttcctggaaaaccaaatgagaatgtttaccttatttcttacctcgaagagaatgcacacccaattacaaatgtcacagaactcataaaggtgagcaccctgacaggtgtttagacaattacctaattctgtcaaagtattatttctaataattcatgtggcttctgaatgtcaaaagttccctatatagcaattccactaagtgctccactccaaaatttccaattccttctcctgttccctttcaaactcccattccctcagtccaacttgcaattatcagaaaaacattccaactcgagtgaaaaaattttttttgcttttttttttcaggagagaaagtcagagtcagggagagataggtaagtagcaattgtctggtaccatctcaaagtgaaaatgtatagaagggaaagagattcatcaattaaaatgtaagtatctcctaagacccagttcttgtgccaggtgcttgataatcaacagagggcccacccatgacagagattaaagtagccagaaaaaaataagcaactaaagtaatatcaataaaacatacaacctgtaccatgagttaggaagaggatgtaatatagtcctagatgtcagggaaggcccccatgaaaagatgagccaagaataccataatatttgaggaaaaaacatggcatactcaaggaacagcaaaaactatagtttatttgacatatgaagggcaagagatgagattcagagatcatggatggctgcagaagccactctaaggaactggactttatctccaaaggtaatagtcactaaaactgacttgtttgaggaacacagatatactttttcaaaggtctctatccacctactttactcactgtaaaggtggccaaaaggaaagtgtgaagaagtaacaaaaagggaaagaagataaacagtacttcagagacttctaggatatactcagacaacttgggttagagccacaatgcctggaacacagatgctcaattatatgtttccatatgcagtatatgcagaagggaattatggcgatgaagaatcaagagctcaaacttacattactgtattgaccaggaagtcctataaagaattatatttctatagaattaaaaatgcagttctgtcagcctggacaacaaagtgagacccccatagctacaaaaaaaaaaaaaaaagtttttttaagagttgggcatggtggcacacgcctgtagtcctagcttctcgggaggctgaggtgggaggattgcttgagattgggaggttgaggctgcagtgagccgtgatcacaccactgcactccatcctgggtaacagagtgagaccacttaaattaaaaaaaaaaaaaaaaaaaaaaaaaaaaagatatagttctggtttttgtctatttttttaacaggcatggttggtacttttttctttttaattgggttcaatttaaaagactattcaccttgttatacatgtatctaagcatgaagtccagtagaaatgacttccctttacgaaaagctcctgccacagataccactactatgttaagatctcgtatgtgctcctgtagcaatatctgctccaaagcttcttcatcaagttcaaagttatggtcatcttcatgagcaagaacaatctgtactggacatggtttcttcataacctcatcagaatttactaggtcatcatcttcataattctcacctagaatttaaaaagaaagaaactggttactttaatccctatattacgaactttcattaaggaccacaactaaagcaaaatttcaagtaagtaattgccccctccccccattatagatcattataatgttcctttggatttctcactccctctgtgacaggacaaagaatgctgataagatttcccacttgatatggttggctgtgtccccacccaaatctcatcttgaattgtagctcccacaatttccacatgttgtgggaaggacccagtgggaggtaactgaatcatgggggaggctctctcctgtgctgttctcatgatagtgaataagtctcacgaaatttgatgattttataagaggtttccctgcacaagctctcttctcatctgccaccatgtgagatgtgcctttcaccttccgccatgattgtgagacctccccagccacgtgaaactttgattccattaaacctctttcttttgtaaattgcccagtctcaagtatgtctttattaccagcatgaaaatggactcatacaccattatacatacagataaacaataatactaaatatggcctctatctcaatgaagtcttaacttcattgagaatgttcatgtcaacagcacctgtttctgagccctgtattattctgtaaataacttttccaactgtatgcacacataaactaaagaggggaaaaatcaatttcacctgatacttcaaatcccaattttccctgtaagcatcacctagaaaattcacaaacattactctactttacaaacattaaaaacatatattaaaattgttcatgtggctgggtgcagtgggtgtaatcccaacactttgggaggccgaggcaggcagatcacctgaggtcaggagttcaagaccagcctgaccaacatggggaaaccccgtctctactaaaaatacaaaaattagctgggcatggtagcgggcgcctgtagtcccagctacttgggaggctgagacaggagaatcgcttgaacctgggaggcagaggttgcagtgagctgagattgcaccactgcattccagcctgggcaacagagtgagtctcagtctcaaaaaacaaacaaaaaaaaattattcatgttatttttcattctgaaacttaaaggggaaaattagggttctaacaagtttccaaaaatgatacttacaatgagtccctaatttaataacagtaacctagtactactacagcctcctcattaaagcaaagcacaggattaatgtttcattaaagaagagtcagtgagatgcatttatatctcagaatttcatctcccactggagctctttctcaccaaacactacagctgttatagctcccgaaaacagccatataaacccttcctttgttcaccacaacacattaaaataaggtaacctttgcagacataactttactgaatagtgacgaagaagtacagagaatgtaaatagcagagataaacttccaaagtctaggtttctgttcttctttaaaaaaaacacctagcttcagaggacacataccttgtctgactttcttctctaccaactgcttgatcccacgtagcaactagttactcctggggaccttatcttctcccacatcaaaatttctaagagatcccctccttgagcctgtctactaagtgtcagtttccactctaaggacacatacggtatccactgttttcaatgcaatcaatgactgtcctactctgaggagaaagccagtccactaaggcgtggtacattattagtgaacagttcagtaataccttatccacataaccaatattcacagagcaaagattatataactacattagtggatttttaatcttattaccaaaagaagcatctcacttatctgatttgcaaagactattagagcctctacctccacatcacgaggcacctttaactgtatatagcaaagtcaacagcactatttcaaaatgtgctgaaaacaatgacaatgcattataaagagcaagccacttcaaaggagaatctttgaaagtaaaagcaatcaatatttagttaaaggggacattatcactgcctgtatcaatggtatatagcaatagtcaggtatgctatttgaatgcatgcaaaaagtgaactttccaggaaaagttgcaatacagttaaattctaaattaacgtctcattaggtaggtccagataaataacaaaacaggatgcaaacggtataagtttctaagcttaattagtggtttaagaccatgaagtagggagcaaactgcctcgatgcatgtcacttaacttctctgcacctgttttctcatctggaaaatgggtgtgtgtcaaacaggcatagcattacctaactcatagggttgtcatcaggattcaatgagttgaaatatgtatgctacgcagtaagcaccataggtgtaagttaacagtaatttcaaaataaccaatccaacaggagaagcttttattttccccttgaaatgccaaaatgctatggtgattttcacttgaccagtgtagctgcgtactgacactgccatccacccatctgctctggcacagacttgctggctgtccttgacatatagagatacgtctacgtgtcttttacttacccctaaatctaatcaataaccaccttcttaatttgtcttcatttctgaatctctattgataatattcctgcacttgtcactgccacagtacctcacactgtagcatctaactggtttcccttcattaatactcttgtcctcttacccaatccaatctaatctccacagagtagcaactaaataatatagttacatgtaaagttgaccaggttaccctccttaaaatcactgttacagaggactaatgactaaaatcctacacatgctctataaggtcccgtactcaccgccaatctctgttgcctcttttggtgctattcttctctttaaaccagcggtccccaaccttcttggtaccagggtctggtttcatgaaagacaagttttccacagaagggggagcagtggtttcaggataaaactgttccatctcagatcatcaggcattagttagattctcataaggagcacacaacccagatccctcacacgtgcagttcacaataaggttcgcgctcctatgagaatctgatgtcaccatgggtctgacaggaggcgaagctcaggcagtaatgctcgctcgcctgctactcccctcttgctgtgcggcccagttcctaacaggccacggacgagtaccagtccacggccctagggttgggaaccccaggtttaaactaggtagccaaactaacctttcatcagatcctcatgctgctaagctctttctagactctgctttaatattcctctgcctagagtactctttcctttgttgtttcctaataaattcacacttactccttaaatctcagcttaaaagacactttccaggaacaagaatcttccctgaggcttccaaccaagtttagtcattctatactccccaaattttaatctatcacttgaatatttatgtaagtacttatttattaaatgtctcccctcttggattgccaatttaccacttagtttcccatcataagcagaaaatagacaaacaaaagaagaaagcccttaaataccttaccatggcttctatagtcgtatgcgatctgggcccagcctcctctccatagcagagggccttataaagcacatgtcatcttacaacacactcctattcattcccaaagcctggacaatctggccttcttgctgttccctgatgaagctaaccctgtttcccaccttagaatttttgtcctgtgttgtcccctatctggaatgctctgtccctagaaattcacatggcttatgtctccatcatccagctcttcagctcaaatgttatctcctcagcatggccctccctgaccactcaatctaaatcacagatccctttccttaacactttaatgaaacaggtttattcatagtttttttcaattcctaaaacaaccttttttcattcgtttaaatgtgtacctgatatctcccactccacagaatgagtgtgccactaaagtaaggatcccaatcaccctgttaaccattctctaccagcacctacaacagtgcctgacacctagcctagcaggttccttgtaaatatttcctgaatgaatgaaatttaagcattttactcaggagtcttacatctgcccttaccttttttttttttttttttttaaggcagagcgctctgtcacccaggctggagtgcagtggtgagatctcgactcactgcaacctctgcctcctgggttcaagccattctcctgtctcagcctccagagtagctggaacaacagatgcccaatgcctcgccaagctaatttttgtatttttagtagagacaaggtttccccatgttggccaggctggactcaaactcctgacctcaggtgatccacccatctcagcctcccaaagtactaggattacaggcatgagccactatgcctggccctgcccttacctagtttataagcaaatatgataatcaaatagcttggggaaatacctccgacaactcaagagtattaagtatacgtaacacaaaaattccataaaaattatgaagcttggctaggcgcggtggctcacgcctgtaatcccaacaatttgggaggctgaggagggcggatcacctaaagtcaggagtttaaggccagcctgaccaacatggagaaaccccatctctactaaaaatacaaaattagccaggagtggtgttgcttgcctgtaatcccagatactcaggaggctgagggaggagaattgcttgaacccaggaaacggaggttgcggtgagccaagattgcgccattgcactccagcctgggcaacaagagcgaaactccatctcaaaaaaaaaaaaattatgaaccaagtaaaacactttaaaaaagaactcaaaagtaataactgctaaaatatcacaatgaccaagtgtggaggttggtgattttgctaaaacaaacaatagttttgctcttattgtaaagaaagcattagttggttttttagaagtttaagaaaaaaaaaaaacccaaaagccaaaattgacaaatggtatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattcacaagaaaaaaacaaacaaccccatcaaaaagtgggcaaaggatatgaacagacacttctcaaaagaagacatttatgcagccaaaacacacatgaaaaaatgctcatcatcactggccatcagagaaacgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagtcatcccattactgggtatatacccaaaggactataaatcatgctgctataaagacacatgcacacgtatgttcgttgtggcactattcacaatagcaaagacttggaaccaacccaaacgtccatcaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaactgaacaatgagaacacacggacacaggaaggggaacatcacactctggggactgttgtggggtggggggaggggggagggatagcattaggagtatacctaatgctaaatgacaagttaatgggtgcagcacaccagcatggcacatgtatacatatgtcactaacctgcacattgtgcacatgtaccctaaaacttaaagtataataataaaaaataaataaaataggaaaaaaaaaaccccactgggcagaaaacctttgttaactcgaaaattcacctatattagttggccagtcactatgcaaccaagtttattagcacagacaaagacaggcctttcaaatagacagaatgtgtctacatatttgtcaccatatctagtctacagccttttacagagaagggtagcaaatagatttcaaaagtataatggagcctaacaatgatgtgatacacctgcatctatctacttactccccatggtgatttctctaccaaatatggactaaatacagataaagtactccatcaaacactgatataagcaaatgaataaaagagaattgtatgtaaatttcattaggatacctgtaaatactgtactagcatttagtgattgcctacaattaaaagtctctaaattccacaccactctaagattttaaactgaagttacgtcctgtgtatagaatagtgattttatttccattcttcaatgccaaaaatttactaagacaagtagatttcagccccccaacacatttttgtgattcacagttccaagtcagttttccctacgctagcccccagatgggtctttcaaggtcaaagctaaaagacacctaaagatgatcacctgcttctcaaacatctctccacacattaacactaaggtacctacctaatatctatttgccacacggcctaacaaaagaaaggtgtcttagtaaaaggacctgtgattgccaggggttagggggatagggagggatgaacaggcataacacagaagatttcttagggcagtgaaactattctctataatacgaaattggttgatacctgtcattatacatctatgaaaaaaaccattgaatatacaaccccaagagtgaaccataatgtaaaactatagactttggatgataatgatgtgttagtgaaggttcattgattttaacaaaagcaccactgtgggtgaaacgctgatggcgggggacagtgtgtatatggagtggcagggagtacgtgaactacaatttcgcttcatattgctgtgaagctaaaattgctctaaaaaaaaaaaccaaaaaagtctatttaaataagacacctgtctttttgttgtctaatcacacattatcttaaatctgccaaattcagacactcagcatgtattccaacagcaaaatttacacttcagggctgacctagatcctcagcaaatttcaagcttaattataaactaagataataaaaaagtgctacaaatcttcattataataaaatgtagcattaatgttagattacatcaacccaaaactaaacttataaaaagagaacaaagaataattcacctttcaaaaggaatgaaaagtatattttattattcacattccaaacaaaaacttgaaacaaattttcatggaaagtaaccttgattcagtctattcagtctacttataaaaaaattagttatcccacaaaagctaagtaacgtgttagtgcctagtacttgaacctcaacatttatatttcatacccaagtgaaaacagtatctaagtattcaagtttattctagcacatattttttaagagccttaaagaggttatacgatggttaaatatatttctagggatttattataaggaaataaggacactaattttattctggtggcaaaaattaatgttgcgtacctcaaaactggaaagtggccgaacagttattttagccatatactgacatattatgcagcctaaaaaacacatttacactctaaaaaaattatacatatatatatttaatttttttttttttttgagacagagttttgctctgttgcccaggctggagtgcagtggcacgatctcggctcactacaacctccacctcccaggttcaagcaattcttctgtcacagcctccagagtagctgggacaacaggcacctgccaccacgcctggctaattcttttgtatttttactagagatggggtttcaccttgatcaggctggtctcagactgctgacctcaggcgatccacccgcctccgcctcccaaagtgctgggattacaggcgtgagccacctcacctagccaaaaaaatctatgtattattttaaacagcataaaattggccgggtgcagtggctcacgtctgtaatcccagcactctgggaggccgaggaagtcagatcacctaaggtcaggagtttgagaccagcctggccaacatgatgaaactctgtctctactaaaaatacaaaaattagctgggtgtggtggcaggcccctgtaatctcagctactcgggaggctgaggcaggagaattgcttgaacccaggggtggaggctgcagtgagccaagatcgcgccattgcactccagcctgggcgacagagcaaaactctgtttcaaaaacaaacaaaaacaacaaccaaaaaaaaaaaaaaaaaaaaaaaaaaaccaccataaaatcaagtgggaaaagggcagactacaaagtagtaaaaatcacccccaattctattttgcattttttaaaacacaggtatttgggggagggaggatatttgagacttctagtcattagagtaactggtatcagactggccctcgaccgtggctataaaattagacaaaatacatgaagcattgtttttcaagcaatggacaacaagtagcacaaggacactttcaaggtgagtgccatgatcactcccagctctctgcctgggaacaatttcctaactatagagtgaagaactagagcacaaagatctgaattcaagattgctagagcagtaggaatctgtgaggcaggataccagagaaaaaggatctatgcagaggtggagcccagaactccttggacaaggacaacaagcatcacaggtgcaggggaacacaacactatgcaatgcttaacagaaggaagctactacagggttgagagagaaacagaagtcaaacattactgagacactttggagttctggcccagccagagtggaaagaaacatctataccttaggcatcaagctgagacactagaatcgacatatcttagaattaagggtcaagttctagagtaaggcctactgacaatccatccaatcaaagcctaaataaaaccaagacttgaaaagatctgcaaggtacacagtttggaaatttagtcccactaagttagggagatttcctctaagctttccacagacccacactaacgaagtatgaagcaaagccaaggtcaagatccatcagtaattaacctgcttgccaaaccaaaaacaagctaagagaatccaaaatctctacaatgcataacatttaatatacagtatataaatcagaaattactagacatacaaagaaagaaggaaatgtagcccatagtcaagaaagaaaagcagttaacagtaccaattctgccatgacccagatgctgaatttagcagacaaatgcttttaaccagatactgtaaatacgttcaaggacttacaggaaaataaagtcttaataaataaatagatgaggagtctcagccaaaaaactatagaaactattaaaaaacaaatgaaaattctagaactgacaagtacagtaattaaaatgaaatactcactggatggacaacagcagactgtaggtaacagaagaaagtttgtaaacttgcaaagagatcaaaagagattttctaatctgaagtacagagagaaaaaagaataaagaaaaactaagagagtctcacgaacctatggaacactatccaacctgcatttagaatcccagaaggagaacaaagtgaggctggagctgaaaaaatatttgaagaagcaatagtcataatgttaccaaaatttgatgacagagatttacaggtccaaaaagctcagcaaacctccagtacggtaatacaaagaaaaccacatcagccagactgctaaaaaccaaaaaccaaagataacaggacacagagcagaatattcaagtaattattgtatagttatgtaataattatacaattatacagagcagaataattcaaataactgctgcttatcacatcatcactgaagcactggaggccagaagacaagggattgatagctttagagtgtttttaaaagaagtgtcaacctagacttttatattcagtgaaacgatcattcaaaaatgaaagcaaaataaagacagcaaaagcaaaagtatggccgggtgcggtggctcacgcctgtaatcccagcactttgggcggccaaggtgggcagatcacgagaggtcaggagatcgagaccatcctggccaacatggtgaaaccccgtctctatgaaaatacaaaaaattagccggcgtggtggcacgcacctgtaatcccagctacttgggaggctgaggcagaggaatcacttgaacccgggaggttgcagtaagcgaagatcgtgccactgcactccaacctggcgacagagcaagactctgtctcaaaaaaaagcaaagagtatctgtcattagcagatgtgcattacatgagagctatataatgttcttcaggctgaaatgaaacattatcaaatggaaagtctctttattccttcctattgatctgaatccaaaatagtaaacagatacaaatataaaagactggttctttcttccaactaatctccctaaaagataattgatcaatgtggggtttataaagtatgtagaagtacaaaattttaaaagacatgttatgaggcaaagtaaatgaaattacaccctaaggttatgattttaaagtggaaagtggtaaaacattgattctaaataggcagatatattaaagatgaatatcattagccctagagtaacggctttaaaacaaacaaaaagaaaaaaggtatagcttaaaaagccaataaggggccaggtgtggtggctcacgtctgtaatcccagcactttggaaggccaaggcaggagaatcacctgaggttgagagttcgagaccagcctgaccaacatggagaaaccctgtctctactaaaaatacaaaaattagccaggtgtggtggcacatccctgtaatcccagttactcgggaagctgaggcaggagaatccctttaacccaggaggcggaggttgcagtgagccgagattgtgccattgcactccaacctgggtaagaagagcgaaactctttctcaaaaacaaaaaccaaaaaaagccaataagaaaccaaaataaaatagtaaaaaatattcaatgaacccaaagtaaaaaataagaacaaaagacaaaagagatgaatgaaaaacacgcaagatggcaaccttaaacccaactaaattcaataattacatcaaatataaatacactaaacactccaataaaaacgcagagactgccagactgggtaataaaagcaaaactatatactgtatttctttgttgtttttgagatggagtttcgctcttgttgcccaggctggagtgcaatggcacgatctcagctcactacaacctccgcctcctgggttcaagcaattctcctgtctcagcctcccgagtagctgagattacagtcgccctccaccatgcccagctaacttctgtatttttagtagagacagggtttcatcacattggtcaggctggtcttgaacttctgacctccctcatcggcctcccaaagtgctgggattacaggcgtgagccactgcgcctggccatactgtatattagagatgtccttttaataaaaagacagagcttggttcaagtaaagtttcaaagtaaaaggggaaaaggtatactatacagacattaatcataagaaagctaaagtagctacataaacatcaaagctggcttcaagactaaaagcataccacatataaaatgtgtactcatcagaaagacataacaatgccaagtaagaaactcaaaatacacgaagcaaaaattcagagaactaaaaagaaaaacagataaatgcatagtcacatttgtttggttcttttttttttttttttctttgagtctcgctctgtcacccaggctggagtgcagtggtgccatctcggctcactgcaacccccgtcttgcaggtacaagcaattctcctgcctcagcctcctgagtagttgggattacaggcacgcaccaccacgcctaatttttgtatttttagtagagacaggtttcaccattttggccaggctggtcttgaactcctgacctcaatgatccacccaccacctcgccctcccaaagtgctgggattacaggcatgagccaccatgcctggccacatttggagagtttaacaactctaagtaatcaatataataagaaaacaaaaaattactattaagaatatagaatagacaaccctacccacaagaaaaattagccacatatgtaattttaagttttctaagtcacatttaaaaaaaatcatttaaataatatttttatttactaacccaaaatattagcatttcaacctactcagtattttttacttttctttcttttttcttttttttgagacagggtttcactctcatcgaccaggctggagtgcaatggtgcgatctcggctcaagcaattctcctccctcagcctcccaagtagttgggactacaagcgtgagccagctaatttttttttaaattttttgtagagatagggtttcaccatgttgcccaggctggtctcgaactcctgggctcaagtgatccacccacctcactcagcctcccaaagtgctgggattacaggcatgagccaccacgcctggcccattattactttacatacagtcttctaaatctgctgtgtattttacacctacagcacatttcaacttagacactaaatgcttatcagaaacacataatcatttaatttcataaaacttacaactgaaaaagtagacatgtataaaagttgttccaacaaagttttccagtataaccaaatcaaatattaatcattttccactcatatttgtatccatactaacaaaactgttaatgtaaataaaattaaataaaactgaaaattaagttcttcagtcacaccattcaaactgctttaatactcatttctttcactaacaaccatttctatacatgtttcctcttgtatgaacggtctattcacaatctagatagttttaaagaaatgtttaaattaccaccctaaagtccctttaattctacactaaatcagatgtttaaacagtattttacgacaggttttttaattcaaaaaactttgtgtttgctgtaaactggagtaccttgtatacagtacataatttaatgctggaaatctaatttaaaaggtttagccggctgggtgcggtggctcacatctgtaatcctagcactttgggaggccgaggcaggtggatcatgaggtcaggagatcgagaccatcctggccaacatggtgaaaccctgtctctactaaaaatacaaaaattagctgggcatggtggtgggtgcctgtaatcccagctacttgagaggctgaggcaggacaattacttgaacccaggaggcagaggttgcagagagccaagatcacgccactgcactccagcctggcaacagaggaagactccgtctcaaaaataaataaataaaataaaaagtttatagttactatatatatgtttgtttaatatacttatgatttacttcctacagaaccctcagtcagaaatgtttcctatcacatttgggattaaggaaaaaaaaaaaagaagtagcatggtgaaacctcatctctactaaaaatacaaaaattagctgggcgtggtggcacacctgtagtcccagctattcaggaggctgaggcagaagaatcgcttgaacccgggaggcggagcttgcagtgagccaagatcgcaccactgcactccagcctgcgtgacagagcaagactccgtctcaaaaaaaaaaaaaaaaaaaaacctctagagatacttttttatattggggaggaaaagcattttccaagaactacaaggttttaggcattaatagaacatacatatacaccctagaatatatatcaagatacatgacaacattcaagttctagtacatatgcttaaaaattagcctcaatacttaaaattaaaactattacatcactcccacaggctttatagattatgcagcccaatttactcattttaaaaataagaaaaacatacaattaaaccactgtttggggggaaatcaaggccaggtcttatttagtgttatttcctccacagcagtgctagtcaagcttaacatgaatacacatcacctgagtatcttgttaaaatgcatatcctgattcaataaaactgggattgagcttgaaactgcattattatcaatccaagatgatgccaaaattgctggtcctcaggatatatggactaacaagggtcactctatttcacaagtgtttaggatgtaagtgtcattcatttaattctatttcatgtagtttctaacaatattaaaataaaattttcaaggaagaaaaaaagttttcaagctaaactgtaatgctctatttttcctgggagactgctaatactgtgatacaactaaccactccagggttgctatcaagggtttgatataccaaagttcaaaaaagtcgaggtacataaaacaatctctacttaaaaaaggaaaaagctatagaaattattttaaaatggctgggcgcggtggctcacacctgtaatcccagcactttgggaggccaaggcgggcggatcacgaggtcaggagatcgagaccacagggaaaccccgtctctattaaaaatacaaaaaaagtaagccggacacggtggcaggcgcctgtagtcccagatactcaggaggctgaggccggagaatggcgtggacccaagaggcggagcttgcagtgagccgagaccgtgccactgcaccccagcctgggcgacagagcgagactccgtctgaaaaaaaaaaaaaattattttaaaacgttaacatgatatacggctaggattgaaaactatcagctagtttagctctattaaactattagtctagctcatccaatcacctgggtgagcttttataacagtgctgggtctcccccacaagactattgcagcctgggatacaagtattacaagtactgacaaagacacaaacttggacttcgataaattttttttgaaggaaaaaaacagctactagtcaaacagatactacaagaaaatattttaacttataatctggtcctgtaaaacattaagaacttataaactcatatttctctcatataaaattagaactacaatgcaaattacaaaaacaaaaattttaaagactccaggaaacgacttattaacaatttcagttatcaaatattttctcccttagacttgtccctttctagccaacaacaaaagaccatcctaaaatagacttttaaaaatgctttaaagagggcagctgcagtggctcacgcctgtaatcctagcactttgggaggccgaggtgggtggatcacctgaggtcaggcgttccagaccagcctggccaacatggtgaaaccctgtctccactaaaaatacaaaaattagccaggcgtggtgccacacgcctgtaatcccagctatttgggaggctgaggcagaagaatcacttgaaccccagagcccgggagagggaggttgcagtgagacaagatcccgccattgcactccagcctcagtgacagaaccagactccatctcaaaaaaaaaaaaaaaaatgctttaaagagtatataataccattcatctccttccttcattactattaaatcaggaaacaaagagttgtttttcctataggattcacatactattttccacttgaaatgtaccccgtttccatagtaactaccactgatgtcacagaatttttgctgttcccacttaaagaacactaaggcaaaaaatacttttatgcatttattaaaatagacgaagaaaaatgtaaaatggtttataaatgtataaactcaaaagtatttttccccaaagtttgtcatcaaatattacccagttcttaaaagcatacacctgaatatgtaagtgtacttaaaaaaaatactaaagttggccgggcgcggtggctcacgcctgtaatcctagccctttgggaggccgaggcaggtggatcacttggggtcaggagttcaaaaccagcctggccaatatggtgaaaccccgtctctactaaaaataccaaaaaaatagctgggcgtggtggcagatgcctgtaatcccagctacttgggaggctgagacacgagaatcacttgaacctgggaggtagaggttgcagtgagatgagatcgtcgtccactgtactctagcctgggcagagcaaggctccatttcaaaaaaaaaaaaaaaaaaaaagaatactaaagtaaatttaaatttggtattttaaatgacgttaaaatttaggaagtcaactttgttagctagtcaggagattctagaataagcgatggctcaggggattcttttttttttttttaagattttgggtgttttgcttatttgttttgagatggggtcttgctctgatgcccaggctgcagtacagtggcacaatcacagctcactgtggccttgacccccaaggctcaagacatcctcccatctcagctttctgagtagctgggaccacaggcatgcactaccacagtcaactaatttagtttttgtagagaccaggtctcactatgttgcccaggctggtctcaaactcctggactaaagggatcctcctgcctcagcctccccaaagtgctgggattccaggagtgggccaccacacccagcctcggggaactctataatcaacaagacagaaattcagacattttattcaggttctgcaagtctcttcattttcttctacagagaagtcttgaagaaaatctcacctcaagtcaagaccaaaaaaaagggtcttagacgggctcttaggtacttttttggggggaaatgagggagaacatacttttgttatgtggaccagatttttaaagaatgagagtacacaatattgaaactttcttactttaatattttttaggtaagttgtttatatcctagagaaattcctgcatacatatacaagaagaacgaaacatggttccttgttcaccaaagtattgttggtaactacaaaaaaaaaaattggaacaacctaaatacccatggataaataaaaaataagtcagagaattgaaattaatgcataagatctaaatatttacatatggataagcttccacaccaacgtggaatgaaaaaaattaaatcaagcagccaggcgcggtggctcatgcctgtaatcccagcactttgggaggccgaggcaggtggatcacgaggtcaggagatcgagaccatcctggctaacgtggtgaaaccccatctctactaaaaaatacaaaaaattagccaggcgtggtggcacacacctgtagtcccagctactagggaggctgaggcagaagaatggcatgaacccgggaggtggagcctgcagcgagccgagatcgcgccactgcacgccagcctgggtgacagagcaagactccgtctcaaaaaaaaaaaaaaaaaaaaaatttaaattaaatcaagctacaaaatacagtctgaaccactcaccatgttttaaacacaacacaatactgtatattatttatgaaatatacaaatgttataagctatttaaaaaccagaaagcatacaccactttcaggacaggtgcatatctacgaagaaagggtaaaagagaaaggttattgggtgaaccattcaactgcacagtaacattttctcttttaaaaaggattcaaaatcaatatggcaaatattatgtattagattaatgcaatggctacttgggtatctattttatctttctctgtcatttttgtaagtttgaaatacattacaattgtttttaatgaaacattttaatttgcctcaaaatttacttccacagacaggcaagaaaacttacctttactgaaatgactcaatgaaataatcctctcaacaacccagtaacttagctattagtcccatttcacagagaggaaatgtggatcttcgaagatgtttttttaaaaattatttaagattctacagttaaaaggtaatgcatgcatcaagatttctatcttttaaacccatgctgtttccactataccaaactgctattcgatgttataggataattcttaaacagatcaatcactgttccccagtgatacagccatagaaaggagactcaaatcagtccacataatgatgcttatcatttaaaataaatccctagtattagctaatcgactcttatgagtaaaaaactacaagcgcagaataagaataggtttaaagggcttgtttttgcttgggaaaggtggattcgctaacatctggtatttgagatttctagctccctaaagttccagattaaactagatgtttaggaaaaaactagagcaaccaaaataatcacaattacaaatacacataacccttccttaccagacatatcacggggcaaaaaactgcttactaaagaatggtcaacacatttgtaattcaattatttatcatgggcctatgactgagttaatactgtcaatatttaattagccacagccacaccgtacaacagtgagtctcacacccactagagtttaagaaccatctgggtaactggctcagaatacagattcttagaccccacctccagagtctgattcagctgatccatggagtccagaaatctacatttttaacaagcaccccactaaccagcaccatgctaattctgacacaaggggtgaaaggtctagaactggaggtgcataaatctttattctttcaatagtcactgaacacctacaacacagttctgagaactacagattcagtagtaaaacaaaattaagaacaacaacaaaaatcctgcccttaggagtttacatcctaaagacagagcaatagaaaacatatgtgtgatgtcagctagtgttaagtgctacagagaaaagtaaagcgagccaagggaaatggaggcaggagttgtcattgaagacagtagtcacagataacttctcctacaagatgacatttgagcaaagaactgaaagacatggacatctggaggaaaagaggaaaacattattagtaactttctcatccctcaaaataattcactgtatgaaataattttaggtgttgtagcttttactacagaagagtgaaaaacacagagtgccgactatgtgcctattatctctttaaacctcaaaatcactttgtggagtagctatgagtttccttgtttccataaaggagtacactgaagctcagataaagcaatctgcgaggatacacattttgtaagtaatcaactgaggatgcacaaccaggtctttctaattgtcaaaatgcatcatcctccaactaagccaaactgttagcatctttattatcaaatgagcatgtctgctgaataaactcagatctgaattcttatatgctcagtacttctagaaacctgaaaaaagctaccaaaaatacaagttgtttattaaaaaggtgggggggggggttatttatcatctttataacaaatcttggcatacagctatttttccaaaaattccctagttaatatgtatttatacagtcagcaaatcatttacacagtctcccaatatttggggaacaattttttcttcataaactttctagaagggcaagtattaaattgcatacctttaaaatataagatgcaataaaagtatatttgcccatctttggcaagataagcacatatatttaaatataagtaaatgtgtaactcactgtttcctattcaccaactccaacaattctcaggacacctactatccaatctgtcatgaattacgaggaagacctcccatcctacctacttcacactggtaactagagagcaaggcactatactagacagaagtataattcaataataacagtctttactcttaacggttctaacacaaaaagtataaaaggatactgtaaaataaaggaaatgctatttgagtacaaaagtagccctttttggattatctaaactagggttatcaataaagacattctgaagacggctgcacctcttaagccctgaggatcagattaaggctaactttaaaaatgtagtctaggccgggcacagtggctcacgcctgtaatcccagcactttgggaggccaaggcaggcagatcatgaggtcaggagttggagaccagcctgaccaacatggtgaaaccctgtctctactaaaaatacaaaaattacccgggcgtggtggcggatgcctgtaataccagctactcaggaggctgaggcagaagaatcacttgaacccgggaggcagaggttgcagtgagccgagattgtaccactgcactccagcctgggcaacagagtgagactccatctcaaaaaataaaataaaataaaataaaaataaaagtatagtctgagaatgttggacatcaaccctgaggaataccactgacaatttcagagcagaggagagagagtcaaagctgtgttgcagagataaactcaaagtgatgagtaagaagtgtaatgcgcaaatcagatataaggcaatttcaagagcccgaatataaagtgagaagcccaaagtcaagaggtgacagtaaaaatggaagagctagttcttaaacatcattctctgtggccttaggccaaattattccatatttgttatatgaaacactcacttttcttacatgccttataaaacgacaatgtactacattcctatttccggaagtatttttagtacaatgactctaagagctccaagattttgtagcacacggatcaagaattaatcgaaaacacagaaggtttccttgactcaggcatatagtttaagaattctcttttaggctcaaaaaataactttgttggctaggcacagtggcttgcgcctgtaatcccagcactttgggaggctgaggcgggtggatcacgaggtcaggagattgagaccatcctggctaacacggtgaaactccgtctctactaaaaatacaaaaaattagccatgcgtggtggcacacgcctgtagtcccagctactagggaggctgaggcaggagaatggcgtgaacccgggaggcggagcttgcagtgagctgagatcacgccactgcactccagcctggggtacagagcgagactccgtctcaaaaaaaaaaaaaaattactttaagagttgtaaagtatcaagccataaaagaactctgaaatttgggatagccagttagcaagggaatcatacacacacacacacacacacacacacacacaaatacacacacacacacacacacaaatacacacacacacaaatttagaatatttaaatttagaatagacacttagatcgaatagggctactatgacaaatttcaaaaagctttaagccaatactctggaaatttagacactaagttccattctgccacatctctctacctcagatgactgttacagcagcagtttaaaaaaagagaaggccgggcacagtggctcacacctgtaatcccagcactttgggaggccgaggcaggcagaacacctgaggtcaggagttcaaggccagccttggcaacatggtgaaaccctgtctctactaaaaatacaaaaaattggccaggagcagtgactcacacctgtaatcttagcactttcggaggccaaggtgggtgaatcacgaggtcaggagttcgagaccagcctgcccaacatagtgaaaccccatctctactaaaaatacaaaaaaattagccaggcgtgagggcgggtacctgtagtcccttgggagtagctacttgggaggctgaggcaggagaatcacttgaaccctggaagcagaggttgtagtgagcagagatcattcctgggtgacagaatgagactccatctcaaaaagaaaaaaattcgccaggtgtggtggtgtgtacctaaaatcccagttactcgggaggctgaggcaggagaatggtttgaatctgggaagcagaggttgcagtgagccaagatcgcgccattgcactccagcctgggcgacaagagctaaactctgtctcaaaaaaaaagaggtaagtattcactcaaattccagacttggctcaatacagacaaaattcctactacaagagcagccgtgaaaagaagggaatggtgccaaaaggagacaaataaacacccctccaactagataaaatgtgactaatttgaaaaaaaaaaaaaaaacaaagataaagtcagagcttcgcactatactctccttttgtcccctcttagtttggcaatttgagggtacatgacaggattccttgtagtaaataaacacacacgctcaaaaacaggatgaaggaaggagatgttagcacagtttttaagttgcattttgagctcctcagataatttttccaggaattatccagttacttaaaccaattatttgctctatttggctacaggaaaatagccccattcctttttttattaaacatactctaataccatttggtctttcagttgcctctatctaattgcttttaagtattttttaagcatctcttttagattgaaaattctcagaaatcagggtcaaatgtttaaattatgtcataaaaagttaccaaaatactgcctatcttttttatcttcaaaccagtggcatagcctacactttgctctctaagatctacccattcttcaaagcacgacaaagcctccctcttccatgaagtattcctcaacaactctagcacacggcaatttctacttcagaacatataagcttaacgataaacttaactcacaaatatgcataaagtctctatgatctacgtgaaagcttagaacaagcatctgtctacattattttttgtaggtattcactataagcagctcaaaagcccttttataaggtaggtacacagtatgtcaactaaaactatcaagggaaaaaagctaattatttgtctaagtatggtcctctatttgcctgtcccattccggcctctagtcccaaaagaaaactaaccccagccccttcatgtcctaccctcaagagaagagatgataactttgtgcacttagtacatgccaaacactttaagacattatctttattactattattattttttttagcaacagagtctcactatgtcgcccaggctcagctccatcctgcagcctcagcctcccaaagtgctgggattaaaggcacgagccaccgcacacagccaagacattatcttttaatcttagaacttttcaggtaggtttttttttaggttttaagaaactaaaacttatttgtagagatctgaacctagcttctaagcttgcttttcttctaccacgctactaggcactgaaacagatgcccactctccgacaataaaaagagatacgaataaacaatcaatatatgattaacaatttaaggccgggcgcggtggctcatgcctataatctcagcactttgggaggccaaggcgggcagatcacgaggtcaggagatcgagaacatcctggctaacacggtgaaaccccgtctctattaaaaatacaaaaaaaaattagccgggcatggtggcgggcgcctgtagtcccagttactacagaggctgaggcaggagaataccatgaacccggaaggcggagcttgcagtgagccactgcactccagcccggggaacagagcaagaatccatctcaaaaaaaaaaaaaaaaaaaaaaccgcccatttaaaacaactttttttttttttttgagacggagtttcactcttttcacccaggctggagtgcaatggcgcgatctcggctcactgccacctccgcctccagggttcaagtgattctccagcctcagcctctggagtagctgggattacaggcgcttgccaccatgcccagctaatttttgtatttttagtagagatggggtttcaccatgttgtccgggctggtctcgaacttctgacctcaggtgatcctcccaccttggcctcctaaagtgctgggattacaaacgtaaaccaccacgcccggcctaaaacaacttttttttttttttgaggagtctcgctctctctcccagtctggagtgcagtggcgcaatctcggctcactgcaagctccaccttccgggttcacaccattctcctgcctcaggctccccaacagctgggactacaggcgcctgccaccacgcccggctaattttttgtatttttagtagagatggggtttcactgtgttagccaggatggcctctatctcctgacctcatgatccacccacctcagcctcccaaagtgctggcattacaggcgtaagccaccgcacctggactctaaaataaggactttttttttttttttttaatttgagacggagtttcactcttgttgcccaggctggagcgcaatggtgcaatctcagttcacctcaacctccacctcccaggttcaagcgattctcctgcctcagcctccctagtagctgggattacaggcatgtgccaccacgcccggctaattttgtatttttagtagaggcggggtttctccatgttggtcaggctggtctcgaactccccacctcaggtgatccgcccgccttggcctcccaaagtgctgggattacaggcatgagccactgcacccagccataacaactttttaaaagcactccaatagcatgcctaaagactaagactaccactaataagttcaaaaaaattgccaatttatttaagaaaaacatgaaagaaaccaacacacacaattctcaccaaaaaaatacaaaattaaaaagcaaatatgaaaaataatttcctgcatgcaaacaggcttttacaaaacaataaaagaaatactgggaaatgctcaaaaaatattaaaaagcaattaataaaaagaagtcagagctgggcacagtaactaacgcctgtaatcccagcactgagaggtggaggttggaggatcgcttaaccccaggagttcgagactagcctgggcaacatagtgatacctcatctctaaaaaagtaaataaactaattcacattttcaatttccatatcactattccaacatcaactacaatcaaaaaattgcaaattaaactgtaatatgcccatttttacctatatgttggcatttatttttaattaacacccactgtgaacaaagatacttgcaaacaagcacaaacctaaccctgatgaataaatgggtaaaacctttctgaatggatctagctttttcttgaaaatgtacatgtcaggccaggtgcagtgcctcacacctgtaatcccagcactttgggaggccaaggtgggtggatcacctgaggtcaggagttcaagaccagcctgaccaacatagtgaaacccccatctctactaaaaatacaaaattagctgggcgtggtggcacatgcctgtaatcccagctacttgggaggcagaggcacgagaatcagttgaactcagaaggtagagtgagccgagactgctctactgcactccagcctgggcgacagagtaagactctgtctcaaagaaaaaataaataaatttttttagtagagacggggtttcactatgttggtcaggctggtctcgaactcctgactttgtcatccacccgccttagcctcccaaagtgctgggattacagtcgtgagccaccatgctcggccaattttttttttttaattagccaggcatggtggcacacacctgtaagtcccagctactcaggagactaaggcaggaggttcacttgagcccagaaggtggaggctgcatatttgagaccctatctcaaaaataagtacataaataaaaaataaaaattaaagtgctgataaaaagaaaacagcaatttatgaagatgctattaatagccatcttgaaaaaattctaagaacaggggtgttttcccgtcaaaactcctctcggatttgtcattaaaaaaaatcaaagccgggcgcggtggctcacgccagtaatcccagcactttgggaagccgaggcaggtggatcacgaggtcaggagattgagaccatcctggctaacacggtgaaaccccgtctctactaaaaaaaatacaaaaaattagccgggcgaggtggcgggcgcctgtagtcccaggtactcgggaggctcaggcagaagaatggcgtgaaccccggggggcggagcctgcagtgagccgagatcccgccactgcactccaacctgggcgacagcgagactccgtcaaaaaaaaaaaaaaaaaaaaagaaagaaaatcaagaccgggcggtcgctcacacctgtaatcccagcactttgggggccgaggtgggtggatcacctgaggtcaggagtttgaaaccagcctggtctgtctctactaaaaatacaaaaattagccgggcacggtggcgggcacctgtaatctcagctgctcgggaggctaaggcaagagaatcacttgaacctgggaggcggaggttacagtgagccaagatcgcgccactgcgctccagcctgggagacagagtgagactctgtcccaaaaaaaaaaaaaaaaaaaaaaaaaaaaaaaaaatcaacccagccagcacagtggctcatgcctgtaatcccagcactttgggagcccaaggcgggcggatcacttgtggtcagaagtttgagaccagcctgaccaacgtggtaagacccgtctctactaaaaaatacaaaaattaggcgtggtagcgggtgcctgtagtcccagctacttgggaggctggggcagaagaatctcttgaacccagaggtggaggttgcagtgagccaagactgtgccactgcactccagcctgagtgacagagcaagactcgatctcaaaacgaaacaaaacaaaacaaaacaaaaaaatcaacccctggcccagcagggtagtgcaagcctgtagacctagctacatagtaagctgaaatggcgggggtggggggtgcaccccagaagttcaaggttgcagcgagctatgattgagccactgcactccagcctgtgcaacaaggctagcccctatctcgggggggaaaaaaataaggaaaaaaatacaaaaagataaaaaagattaggaaatggcaaaaatcaactcccccattctgataaaggtgaaattaaaccaacttttggcatcccacaaattcattcactgaaatttttaaaaagctctccatttaccatgccaactttcctcctttgaggagtttctttatagaaggctttcaaatttctaaatggcatttatagggtttatctctttaattaaaaaaaaaaaaaagaaagaaagaaatggctgggtgtggtggctgatgcctgtaatcccaacacttgggaggcagagatggaaggatcacttgagtccagaagtttgagactaacctggacaacacagggagaccacatctccacaaaaaattttaaaaactagccaggtgtggtagcacactcctgtagtcttagttactgaagaggctgattcaggaagattacttgagccagggaggtcaaaaccgcggtgatcacgccactgcactccagccttggcaacagggcaagacctcgtttcaaaaaacatagaaacaaaacaaaatttttaaaaaaattactgtaagtttgctagggtagatattaaccactgggaaggaaaaaaaaaaatgttacagaaaaacattacagacccaggcagggtgcggtggctcatgtctgtaatctcagcactttgggaggccaaggtgggtggatcacctgaggtcaggagttcgagaccagcctggccaacatggtgaaaccctgtctctattaaaaatacaaaaattagctggacgtggtggcacgcgtctgtagtcccagatactcaggggctgaggcacaagaatcgcttgaacccacgaggtggagattgcagtgagccaagatcacgccactgtactccagcctgggtgacagagggaggctctgtctcaaaataaataaatacataaaaataaaacatcatagacctagtattaaaatccaagcctccattctaaatccatttcaaaaatcataggaagtttgcagaactcaagttaaaatgttaaagatggatgtagttctaatcactgtccatgactctattctaaaggattaaatgaagggaaaaataaggtttttatgagattcactgttagtatggtttcatgttaattgtttttttttttttttttggcaatcctgtgcataacagacccaagttagattttgcagatttactgtttgaaaagccaatgcactatacagtcaagtcagccctccatatctatgggttctacatccatgaattcaaccaaccaggaatagaaaaattatttaactgcatctgtactgaacatgtacaattttttcttgtcattattccccaagcatacagtataacaatgatttacattgtattaggtattatagtgtagagattcaagtgtacgggaggatgcacataggttatatgcaaatactataccatgttccagggactggaacatccttgaattctgtcatcagagggaggttctggaactaatttcccatggataccaagggacaactgtacttggaaactgccataaccttaaactatgaaattaactcatatgaaatcctgcaattgaaataaacaattccagaagaactactttgccacaggattgtctaaaatgcacatttattaaaatgaagatagctaagaagcatgaatgatcacatcttatgttaataactgaacaaacaccttccaagttgcctattttgaaaattactttttagttcaaagtctcatcttaaataaccacccattatggtaataaccacctccgacagaatatttggcagtgggttaagcacttttaacacatttgatacttacaataaccctatcatgaacatattatcagcattttacagctaaaatttaaaacttgcctaccacccttgcccaaactaaatctctgtccacaggaaaaaattataactttttattgcaaatatacacattatatataatagcataataacacaagtagtcacactggtacattcttacatatatgttactgtgccttaagacagttttacaaactttaaagtactacaaaacacttgcaccctatcatctgtttcccacgacagccttgttacggattatcactaccttatatgagggctccaggctctgagagcttaagtgaaatcactcatttgattcctcattcttttcccactacattatcctccctatgattaaagaagcattgccgccacaatcagagcatctttgcaataaaagataaaatgttactagagaacctagataagtattcttcaccagttacatacttctccaacaagttattagagttactggccagcaggatatccagctagcctctaagtggttgtttggggaccaatcataaagttgtatgaacaggagttgtatgaatactttttattaagctagtagcttagcaagggaatcccctacattctacttgtactggtccgaagaccaaatccaaggtcaatcaaaagtacatattatctccttgggaaaacagaggatgttagtcttttatgacttaaaagttgtttctagtaactatcatccgaccatacaccacacagccatttgtctcagagtaggtagtgaaggtggctacttaaatacacacatttttaaaaaactgtatccaagtttagcaatatgtgtatatacccaagcacacagagacacgttccataacttggaaaatcatctgtaaaagttattttggctttgcacttctgaatacttcatgcttctccatgaccataacaaacagaattgttctacttcctttactaattgttctacttctttctataatatctaccaagtattatcctattgccatcatattttcaggttggtactttcttcctgctatcctttttatgggggagacagagtttcgctcttgttgcccaggctggagtgcaatggcatgatctcggctcacggcaacctccacctcccaggttcaagcgattctcctgcctcagcctcctaaatagctgggattacagccatgcgccaccacacccagctaattttgcatttttagtagagagggggtttctccatgttggtcaggctggtctcgaactcctgacctcaggtgatccacctgcctcggcctccgaaaagtgctgggattacaggcgtgagccaccgcactcagcctgctatccatttttaaagccatagagaaagccctcgagtgttgtgtatcatgtgctgtgtggaggactaacggataggaagaaaactactaaagtaatgaattcactgtggaatcaagttcagttattctatgttcacatctacattccttaaagtaaataactctcaaattttctagaaagtaaataatacacctggactttgaaaacccaaaatgtctacaaaatcagaataccattacacgttaaaaacaagaaagaaaagaagaaagctgcttccctgcacctatctggagaaaatctttgcgctgtaaagctctaaaccaccattaccaaaaagtttaacttctactcctatgccttacatttctggctcttaactttttaagggcctgacaaacagctttgctgacaattgtgtgtgtcaaacaggtcttccaaatgaccatcaacaattttttaatacatcttgctatgaagtcccaaaatttaaaaaatatatgttgaactccatccagcattatcaaactagttaatcagtctccccgtactcttagcagctagctgcctaataccaactgtggaaaaagcctaattttggaaaaggtctaacaatttcaagaaagttacttatacttgtgaatattccaaaactttaaagttacaatacagtcacagaaaaacgaatcctgaaatacacctatgtgcactcgacttaaggccataatcttattttcactcagggtttcttttccctataatatctttactgtaaggcagctacttctccctaaataatttcgaagaatttcaaaacactttactaaatagatttaatcatatctacagaatcctatcaacttaaaaagccaataaaatgagtacttatttgctttctaaagatcctacattcctaaaagaataaacacaaagcctctccctaacactaaactactcaagtgacacttgaccccaacttggtttttgaagctatttctccaggaagcagagggagacaaagagtttctacacagtcaaaaatagatgagtccttttcattcagtctgtttcttctcactttaaacacaaatcctaccaagctcatttagtttttaactcattaatgagtgactcggagcaaattagcaggtacagggactgttttaggcaatcatttgctaggaatggctatcaagtgaaggtcttgctgatccgtcctaaaaaacaaaggacaaaaacctatgagtagcagacaaaagcatttattaaataataaatggtgggccctatttcaacaacaatctgaagagtatcatctcttctcaagataccacagcacaacaacgttcacaaccataactgaagtataaatttatgtttcttctaataaggtaaatacatagaatattttgaaactgcatctaaaactcttacctcaaaaaaaggaaagaaagaaagagaaagaaagaaaagaacacacacttcttcccctagggtccaaccaaaagagcgaaattaatccatccgcattccaaaacaattaattacttaagaaatccaaccagcacacatctaaggcgaagctgcttctttggtagttttttattctacagagtgctaccactgtacaaacagtcaagcgttttggttggcagacaataataaaataagctttatttccttttcttcttcccttagcaaaactccagtctgtcatcacctctgacatgcgccaagaactaccaggaatgatgaagtatatttcaaataaactttcctattaaagtgagtccttgtggttaacatcataccaaaatgctttacattttatccagcaaaacctttacacaccgtaaaaaaagaaatcttaagacacgagctcgtatctgtatttaataataaactcttatcttggccgtacttaccaaatcgtaggcttttactatttataagcctttgaaaaaactttatgcctttcttaagtaccatcaaaattttcaatcaggatttcatgcgatcaattcgcaccacagtgagagatcaaacgctaaactcctataaataggggtgttatgagtgagagggatacactgcgctgccaacgcaactgcgtcttcgagggggcaggggcgctcctggtacacgtacagtaggagctcacattcagcaaaaccagggagccaaggatcaggtgacttcacactacagacactttcagagtgatcaggccttactatcgtccaagtgactcgtaaacggctcataaccccagtttgacacgaaaatctagacttgcaccctagccacgcacaacccgcgcgaatgggttcgggagccgaggagccccgaaacgcgagcccggggacagagccctggcctgcggactgcggttccctccaggaagggtgtctaaggagctttcggacccggcagcaaggtgtctgctccccgcgcgacctcctcctccgcggggcccatcatgccctggccaccccttcctccctgtccgcgtaagggacagcgaacgcccaccagctaacgggtcgccccgccgcgtccggagctcgccggacggagcggagccgcagccgacctccccgcgccccgggcaggcggccacggctcaaggccgccccctaaggtcggggcggacacggcggcagccacgcggcgggctggcgggcagggggccgggccggtcgcagacgcgcgcgccactggttctcccagcagctactggagccgcggcccacgagccgccctttcaggccgcgcgctgcgggagcgcggggcgcggctgaggctaggcccggcgggcaggcgcggcggcgggaggagacctgaaccagccgcggactccgaccccgccgcctgcggccggtgcccgcgagcccgagcagcgagcgtctctccccatcagggccccgcggcctctgcctcgctggcccgtacctagggaggtcgtggacgagacgtggttaaccgcggcgcttgggtcgctggtccgtcgccggcgccacagcccctggtgcggttgctgccctcgcgctgcctcgtccccctccgccatcttgtaccgatttaaaattaactccccact

SEQ ID NO: 1536 - DNA, 82404 bp, Homo sapiens; identical to SEQ ID NO: 1535

SEQ ID NO: 1537 - DNA, 82404 bp, Homo sapiens; identical to SEQ ID NO: 1535

SEQ ID NO: 1538 - DNA, 146268 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccaggtacagataagacaactacagtggatgataatgtatgtggtgataggggagtactctgatggtagaggagtgactttggttctctgcaaactcagcctgagactatcaattcagtttgtggtgagacctcgcagtgttaccttggcagatggtagaagccttccagatggaaggaaaaatgcgtgtaaaggcacaaagtgtagaaggaccctgaagctccagcgtgaggcctggcattgaatgaaatatattttgtgggttttcagctgctgaagtcataggaatggatgagaccaagaaaacaaagctgtttttgaggtatgagcggaagaagagatatcaggagactttcgaaacagtcataacggaagttaatatgatcattgctaacatttgctgtgtttcaggcactgtaagcatgtatatgggtccttaaagggactcatagaggtaggtactagtattgtttttccttttatcattgagaaactgaggtttgaagagattagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataaatgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaaccataaggaatggaaaaacaaaaatgataatacttgtccacaggaagtatataatcaaatgaaaagaactcaaataacaatctgtaatctatagcagagtaaagcggaagttgtaatagtgttgggggatgggggaagtcagaagaaccaccagtgaatataaaaggagaagagaatcagagccatctgctaataaaatgggtagtcagctctttttgttttttttgtcttgttttgttttgagacagtctcgctctgtcgcccatgctggagtgcaattgcgtgatctcagctaactgcactttccgcctcctgggttcaagtgagtctcctacctcagtctccccagtagctaggattgcaggcacatgctaccacacctggttaatttttgtatttttagtagagacggggtttcacgatgttggccaggctggctggtctcgaactcctgacctcgtggaacgcccacctcggcctcccagagtgctgggattacaggcatgagccaccacgcctagccccggtagtcagctcttactgagaatattcaaagacagggcattcattttgtaagagacattccttccttcataggaagattggacctggtcttttagttcctcccaattttgagattctgtgagattgaatcggggcagagaaacatacttaatcttgaaagattaagtagaatttagatggatggataggagaaggactttccctacctttttacttcttgagatatagttatttgtaggtataatatacataaatatatgtattttttctctgtttacagacattcatagtttaataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttggtgtacgaatgatcctgtcactcaggtagtgagcatagtacctgataggtagcccttcaagccatacctccctttctttccaaccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagacaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaaatccttgagtgctcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagtaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggttgatgcatttttacattgagacatcattttcaaccgtgaaatccatttataactagaaacagattgtaaggattaggaaagatgaataaagtattttaaatactgagagtattaaataaactagaaataacatttgtagtcaagaggaagtgtgtatttagttgtccttcagtgtttatgacagattctgttttatttttagctcctgtttggtattagattgactgttacagatttgaaagcatataaaatgaaacatgcatgctgtttttcctctgattttctagtttattttaaataccacaaatataattacaacctgaagatgaatactattttgtataagctgatctggtaggtcaaatatgcacccagcattcctggctagttatgaatatcttctaggcaggcttaatttattggctggcaacattaccaactgcctaagaaacaggtagatcctgtacagaataacagaaggagttgagagaggattgagagggtccttactagcattgtaagcttttaatgacaaatttagaaaacaggcagtaaagcaatagaaagtcatagaagattaagagctttgcagaccagatattaaattggtcttgtaggagttaggccttgaaagagagatttaattgttttatttgtttttttcagctgatgtagtaatctaagcaaggtggtttaaaagttgctctttgtgatggcatgaacagcttttgaaattattataatttaagtattcaacgagtttctgaaattgcattttgttttcttgaagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattactgtcgcgtgagttttttttttttttcagatcattttaaggacttaactgttgcataagtttgttctaaatagaataagataaaagttgagtgtaagtacatataatgatttttatttttattaaaaggtttttttttagggctagtcaagtgaagcagtgggagtttagaaggaacaaagaaatctgtaactggttgtgatcaattcgttgtaaacaccactgcactcaggccagcctgatttttaatattacaagttcaaatatttggggaaatttatgcaagcatagaatgacagaaatctgaggattgaagggatttatttatttaagagatagggtgtcactctgtcacccaggctggagtgcaatggtgtgatgatagctcactgcaggctgaagcttctctgttcctaagtgatcctcctgtcttggcttcctagtagctaggactacagaagtgcatcaccatgccaggctgatttttttttttttttttaagaggtgttatttcactgttctgcccaggctgatcttgaactcctggcctcaagcagtcctccccctgctcagcctccctagttattggtattacagatgtgagccaccatgcccagtgaaggaattaaaaattactgtttaaactacccagtcttggatgccctctctacgtccctagcctttaggtagaagtgcagtcttcatgattgaatatactttcaaggctttcttttccatctttgaatagcattaacagtattaaaaactggccaggcgcagtggctcattcctgtaatcccagcactttgggaggccaaggcaggcagatcacctgaggtcaggagatcgagaccagcctgaccaacatggcaaaaccccgtctctactaaaaatacaaaaattaattgggcattgtggcgcacgcttgtaattccagctacttgggaggctgaggcactagaattgcttgaacccaggaggcagaggttgtggtgagctgagattacgccactacactccatcctgggcgacagagcgagactgtcaaaaaaagaaaagtattaaaaacctgtcttttgttactgcttctcccttctgagagtatatcaaaaactcctatttatgtttttagtgtgacatccttagagatgtttgaaagtagccacaatatttcctaagtcctcatctctaaagttcataatctcactttcttcagctcacgtgacctaggttttatgctactctcctctgaatattcttcactttaattgtctgtcttaaagtgtgggcctctacttacagggaagaggccagaaaaacaaacaaaaaagtgtgggactcattttttttaatacaggctcttgctctgtagcccaggctggagtgcatgcagtggtgcaatcttggctcactgcagcctccgcctcccaggctcaggtgatcctcctgcctcagcctcccaagtagctgggactataggcatgggccaccatgtctggctaatttttgtatttttaatagagacagggtttcactgtgttggccaggctagtctcaaactcctgacctcaagtgattttcccgccttggcctcctgaaatgctgggattacaagcgtgagccactgcacctggccaggactcaatcttttaggtatattctgattagtacagagtgaagcaattcttgcttatctttcattctgtactcttactgattaattctaagatcatgtgagcttccttggctgtcagaaccaacacttaactgacattttacttgctatgatttgaggaaaaaaacaacccccaaaaatatttttttctcctgatgagccaaatagttcccatctttaacttgtacaattaatattgtgaagagttgatttttcggaaccaaaatgcaggatcctggcaagcttttgtaaggaaatgggctttacacatactgaaaagctagaggcagaagtgtgtgttcagggactcctgggctcttcacagataaggatgttgctttgtgataccaactcttaatttaagaatcaggagtgtgaggcgcggttgctcacacctgtaatcccagcactttgggaagctgaggcgggcagatcacctgaggtcaggagttcgagaccagcctggccaatatagcgaaaccccatctctactaaaagtacaaaaaatagctgggtgtggtggcgggtgcctgtaatcccagcttctcgagaagctgaggcaggagaattgcttgaacctggaaggtggaggttgcagtgagctgagattgtgccattgcactccagcctgggcaacaagagtgaaactctgtctcaaaaaaaaaaaaaaaaaaaaaaagaatcaggaaagcccccaaattggtaaatatttagtagaagtatgcagattattagtgaatatttcagattggtggtatgagacttgagtccaaagaataatggtttagtcaattttctacctcctctgagatgcgagttcgtgtggatagcttcaaccccttgtcagagactccagcagagacaaaggaaaactacaccaaaatattctgcactcacttttgctctgtgtagtagctttgtatccagtaaaatattttatttgctaataatgctgggatatagtaggtacttactgaaagagtgaatgagagaaagataacatgtcaattttgtagcccaccagaaaagtttgcaatgtgtacagtagttttgccttgcagtgaacaaaccttttaattgcaacattaacaatggagattacgtttgaaaatgcatcagcctgttggtttataagaaatagttggtgaaattatcaatgctggtcatgtaagtagttgaaaatttgtttttttatttacggcttccttttctttcaaatttgactttgttacttaaacctttttaatattggggcaaaaccagggagttactattccctcaccccacttcagttgtttttgtttgtttgtttgtttgttttttacgaaaagattggagggttgatggaaatttaacatatgtctaaactttgccattcttgcttagcattggtatccaaggtatgatgaaagaaatagagattagtaaaaaagaagtaaaaggcagctgagaagaaacaagtaagcaaatattgttgatttctctccttttttttttttttttttttttttttttttgagacagagtcttgctttgttgcctaagctggagtgcagtggtgcagtcttggctcactgcagcctcttcttcctgggcgcaagcgattctcacgtgtcagcctctagagtagctgggactataggcacacgccgccaggcccggttaatttttgtatttttagtagagacgagggttttgccatgttggccaggctggtctcaaactcctggcctcaagtgatctgcctgcctctgccttccaatatgctgggattataggtgtgagccaccacactcacacacccagcctactgttcatttcttttctttttttttttttgagacagagttttgctcttgttgctcaggctagagtgcaatggcgccatcttggctcactgcaacctccgcctcccgggctcaagcgattctcccgcctcagcttcccaagtaactgggattacaggcatgccccaccatgcccagctaattttgtatttttagtagagacggggtttcaccacattggtcaggcttgtctcgaactcctgacctcaagtgatccacctgccttgtcatcccaaactgctgggtttataggcgtgagccactgtgcccaccctgttcatttctttatgttagcatttgtctgcttttgtacaaagcttaaatagagtctagatagtgcaaaactcagctgcgaaaaatgttaagttccataagattcctgaaagtctctgtaagtaggctgggcacagtggctcatgcctctctaatcctagtactttgtgaggccaaggcaggcagattgcttgagcacaggattttgagaccagcctgggtaacatggtgagacctcatctctacaaaaacacaaaaattagccaggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagtgagtcataatggggccactgcactccagcttgggtgacagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaaatgttacaaggactataagagaaatgcacagggtactagaaaaaaggatcacatggttgtgcatttcataactggacaatgcctaaaattatgaagtgagccataagtgaagatgattttgcagttatatcagtgtatatttgtttaccatagcctgtgaatataactagtttcatcataggaaaaccctaatccagaatatattcatatttacatgagttgtgttctgctcatagttatggcaataaatatattcaattttaagattgtcagtatggaaaaatggcatttctgctgtgacgtaaatataatttactgaaaatgataattaaattatttttaaatgtaattttgttaccttcaagaatatgtgtgtagtcatgccaagttttcagaatctctagtaagtaaataacatgctgttaaaaatgacacaggtacaggggtcaagcacagtggctcatacctatagtctcagcactttgggaggccaagacaggagaatcccttgagctcaggagttcaagaccagcctggggaacattgtgagagattctgtctctatgaaaaatttaaaaaattagctgggcatggtggcacaacatctatagtcccagttgctcaggaggctaaggtgggaggatcccttgagcctgagaggttgaggctgctgttgggtgtgatcatgccactgcacaccagcctgggtgatagagcgagaccctgtcttaaaaaaaaaaattacaacctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaaaaaaaaaaaaaaaagtgaaagcaagagagttgaaagttcaaaggggcgtggccaacattttaagtgttgtagaaaggataagacacaaaagtatccattggatgaggcagttagcacgctacttctaaggtaatggaaatcaaatatattagaatagaatgcattagaagacaatgtacagaacccagtgattcattagatgtgtagagtgtgtgctagggaggaatctggtgttgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcaggtgtcaaagtcttctaatacacgaactctaaaagtttagaagcttttttttttcatggaaagtatttaagctaaattttgctagctaaattaaaagacatttgtccatattctttattgccattttattatttcaaaatgagatacatgtgaaccacaaaactactacctaatcagtaccctcactcctgcattacactctactgttcccctgagaataaatgccttctcagctaatttcttaggagtcatttgtagcctttacgttactctgaacacaagataggctgtgtctgtaacagggccctcaacaagcctagagacagcctttgggaataggctggtgatatctaggttacctaaccagatctttccccagtatggctggtcatatttaggtcattttacattatcacttacaaccatggctgtcactgaaacaaaggcagtctttcccctagtctgcttactatattctgtcatctagtttgttctctgaaaccccctttttatttttaaactaactactcttacttctttttttttcttttttctttttatttaagctaacctttgccacttcttcccggatgttacttcttataattagcttttttgtcaaagtatttttttacttagcttccttttaaaacttgcttagatgaggactctgtggaagaagcgaagtctgtgctcaaaatatatatttggtacaggtggtgactgaagccatgactatggatgagatttgtatatagagtttagtgtgagatgagaagaatggcctaagattgagtcagcatttgcatataaattttggaatcagcttactgatttctacaaaagatcttgctgggattttgatactaattgcattgaatctgttgcacaatttgagaagaatagaaatcttaacaatgtggagttttccaatccatgaacactgtatatctctccatttacttaggtttttttttttttttttttttttttgcttctttgtttgtttttttgagacagagtctccctctgttgcccaggctggagtgcagtggcacgatctcacctcactgcaacctccacctcctaggttcaagcgattctcctgcctcagcctcctgagtagctgggattacaggcatgtgccaccacacccagctaatttttgtatttttagtagagacagggtttcctcatgttggccaggctggtctcgaattcctgacctcaggtgatccacctgcctcagcctcccaaagtgctgggtttatagacttgagccaccgcgtctggccacttgtcttttttgatttctttcattagtgttttataattgtcagcatatagattttttgttgtaaattgacaattttttttctttaattttatatattaaaaaaaatagagacaggatctcactgtgttgcctaggctggtctcaaactcctgggctcaagtgatacccttcccttgacctcccaaagtgttgggattataggcatgagccaacatgcccagctgcaaattgacatttatttataattgtataaacataaagattttgtatatgttttgttagatttatactgcagtagtttgtaattgcattgtttttaacattttgattttcaaattgttcaatgcacaaaaattatacagaagtccagttaatttttgtatagtgaccttgtattttgggaccttgctaaaatcacttactaaatctagtagctttctttgaatgttcttttggattttctttgtagacaaacatgtcttctgtaagcagtaatttttttttctttctttctgagccatgtggcttttattttatttttgtgctttattacattggctaggacctccagtgtgatttattgtggtaaaatatatataacatttataattttaacttttttaagtgtacagttgtgtagtattaagtgcattcatattgttgtgtaatcatctccaccatccatctccagaacttttttttctatactcagtaaacaatgatttaccattttcccctcccctatcccctggcagctaccattctactttctctctctatgaatttggctatttggggtacttcatttttatggattgaatgttgtgtcccaccaattatgttgaaatctaactcccaaagggatggtatttggaggtgtgggatttaggaggtaattaggtcctgtgggtccagccttcatggatgggattaatgcccttatgaaaagaggccagagagctaacttgctgtctttctgccatgtgaagatacagttcaaagtcagtagtctgcagccccaaagagggccctcaccagaaacccacaatgctggcacctgagctgctttcagcctccaaaattgagagaaataaatttctgtggtttctaagccacctaacctataatactttgttatagcagcctgaagtagaggactcctataagtatttgtccttttgcaacctgcttattacacttaccaaaatgtctttgaggctcatcagtgttacagcttttgtcagaatttcacccttattaaaaactgaacactattctgttctgtgtatatgccacattttgttaattcattcgtccattggtggacatgggttgtttctaccttctgattattgtgaataatgctgccgtgaacatgagtatacatctcctgagtttcctgctttcagtcttttgattatatacccagaagtagaattgctagatcatgtggtaattctatatttaattttttaaggaaccaacatcctgttttacacaggagctacgccattttacattctcaccagcagcccacaagggttccagtttctctacattctcactagcacaactaatagaaaatgaggattcctcttctaggccttgaaagtgctgcataattttgcttcttcctacctgtctaacttaactaaagcgcttctaatttctgtgctcaagctacactgtcaattattcagtttctcaaacctagtggtttccatttttttaaattgacttttatcttttagaggaattttaaatttacagcaaaacggagtggaaagtccactggacacacacagcatgccctactgtcaacatcttgcaccagtggtacatttgttaccatcagtaaacctatgctgggacacatcattattatccagagtccaaggttcacttttggtggtacatatgctatggattttgacaagtgttttgacatttttaaagatctttttctgtatctaatgagatggtcatatttttttttcctctgggagagaatggtaacaatttttcactattacagaatcatacagaatactttcactgtcagaaaaatcctctgtgcttcaccttttcatctcttccttcttgtaaactgtgggaaccatggatctttttgctatctccatggtttagccttttccagcatgtcatatacagttgtgcgtctcttaacaatgtggatatgttctgagaaatacatcattaggcaatttctttgttgcgtgaacgtcatagggtgtatttatacaaacttagatggtataacactacgcacctaagctatatggtattactgctcctgcactacaaacctgtgcagcatgttactatactgaatactgtaggcagctgtaacacaatggcaagtatttgtgtctctaaacatatataaacatagaggaggtacagtaaaagtatagtataaaggataaaacatggtacacctgtctagggcacttaaccatgaatggagcttgcaggactggaagttgctctgggtatgtaaatgtgtggtaatgtaaaggcctgggatactatatactactgtagaatttgtaaactcttattctgtaccaaatttaaaaatttatgtttttctttcttcaatactaaagtaacattagctactataacttttttactttataaactttaaaaatgtttaaactttttgactcttttgtaataacacttagcttaaaatacaaatgcattgtacagctgtacaaaaatattttttccttatatacttatagatgttttttcttttgttctataagctttttaaatgaaattattattactctattttttcctttaaacttttttgttgaaaacaaagacacaaacacacacatgagcttaggcctacataaggtcaggatcatcagtatcactgtcttctgtccctgcatcttgtccccctgggagatcttcagggacatgcacagagctttcatctcctatgataatggtgctttattctgaaatacctcctaaaggacctacctgagactgttttactgttttgttttgttttgttttttaagaagaagaaggaggaatatagtataaaatggtgataaaaagcatagtagagtaagtacataaacctaacattttaccagtaacttagtcatttattatcattatcaaggtttatgtactatacatgattgtatgtattatacttttatatgactggcagtgcagtgggttttttttacacaagtatcaccacaaatgcttgtgagtaatttcttgtgctatgacatcactaagtatttaaataggaatttttcagttctgatacaatcttacggtaccaccttttcatattgccatttgtcattgaatagaatgttgttatgtagtatgtgactgtggttggaatcataacagtatgtatcattttcagattgccttctttcatttagtaatatgcatttaaggttcctccatgtctttctctttctttctttctgtctttctttctttctttttttttttttttttttttttttgagatagggcctcactctgtcacccaggctggagtgtggtggtgagatcatggctctgcagcttcgacctcctgagctcaaatgatcctcccacccccttccaagtagctgtgaccacagacacaagccatcacaccctgctaatttttcatttttagtagagataaggtcttattatgttgcttatgccagcagcttgaactcagcctcccaaagtgttgggattacaggtgtgaaccaccgttctcagctcctcgatgtctttttatggcttgataggctgaagtgggaggatcacttgagcccaggagtccaaatctagcctgggcagtgtagtgagacttccgtctcttaaaaaaacaaaaaacaaaaaaaagaggaccaaagttactgatattagaaatgaaatgagatctaattgcagatcctatagatattcaaaggataataaggaaacactatgaacatctattaatttaaatgggccagttcctcaaaaccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagtaaaatttcatacccttcataggtctcaacacattttttgcatattattaatcaaacagtattattattttaaaaaactgtggaggccaggcccagtggctcatgcccataatcccagcactttgggagaccaaggtgggtagatcacttgaggccaggagtttgagaccagcctgaccaacacggtgaaaccccatctttactaacagtacaaaaattagccaggcatggttttgtgcgcctgtggtcccagctacttgggagactgaggcatgagaatcacttgaacccaggaggcagaggttgcagtgagccaagattgcaccattgcactccagcctggacgacagagcaagattctgtctcaaaaaacagaagaaagaaaaacccatggagcatgtactgtaagtgctttcttaggcctagatgatggaacagaggcttagagaagttaagtaatgtttctgcgacctggctcttaaactggtgctctcacagcagtttatagttattcctgtcttaaaggcattttatataagataaaattaaatactgatggagtacttttactatgttaaaaataaattagtgcagttttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgatttttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtataaaggaaatgtttactgttttgaatttgcttcttcattcaaacatagaagtctaagtataaaattagtgttctttaggaggatatgactttcctctggatttctctggttgataatgttacttagccatgagaatgtttttcatagagtttttagaatttgaagcagtggtagcagattctgttatgcctttctatttgttcaatacaatattaggtattatgggaaatacaaaaaaatctgagacattgttccctctaggagctacttatgcatcaatacttagatactaaggggtctgacacagactgtagggcaaaagaatttaaagaaagcaggatcttgtttatccacctattacttttattagaagataaaatacgtaaattggactaaaaccagtcagattattcagctcctgaggaagatacatacatattactttaataggaatttgaggcagaaacagggaaattgctgccttaagcctcatagttactctagggccctgtttgccctagagtatcacttgttaaggagaatcacttattctccttaattccttcatatatgtcctataccaagagagtattgcccagaaggtatagtgcttttctgtagttaggaactttattggctggaactggagtttcctcttgctctgtctatgattgcctttgggcttatactagcctttggaccaactcatcatggctagtatagtgactttcttaaaacagcataccacattgagtaatagcagctataatggaggaaatgtcttgtagccactttttttttttttttttttttgagacagagtctcactctgtcgcccaggctgaagtgcagtgacgcaatgttagctcactgcaacctccgcctcctgggttcaagcaattctcctgcctcagcgttctgattagctgggattacagatgcctggcaccatgcccagctaatttttgtattttaatagggatggggtctcaccatgttggccaagctggccttgagctcctgacctcaaaccatccacccgcctcagcctcccaaagtgctgagattacaggcatgagccactgtgcccggccgtgtagccactttttatcaaaagtagctgtgtatttgttttatgggctcttctaataagtatatctagataatatgtagcccatgaaactactataagtgaaagaatagtgacttttaatagtttttcatcttttactcacctcttatctccaggatgaagatcaggcttattaggaggtgatatgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccacgcccagctaatttttgtttttttagtagagactgggtttcaccatattggccagcctagtctcagactcctgaccttgtgatcctcctgcatcggcctcccatagtgctgggattacaggcgtgagccaccgtgcccagcccagaacttttttatcatcccaaaagaaacctcatcccttcttagcattcagtcccaattccctgcatctcctagatcctggcaaccagccactaatcaatcttggtttttgtggattttcctgtttgggacagttcgtttaaatggaatcatacaatatgtgagtcttttgtgtctggtttctttcactaagcataatgttttcaaagttcatgttttaccatgaatcagtacttcattcatttttattgctgaataatattcagttgtatggatatactccattttacttacccatccatcacctgatggcctaatgtttcttaaataaaactctgttccccagagatttggttaacatcctgagtagtaatttcactctgtcaaatattttcttaatatttcttaaaatttcttaaatttaaaaacttgaatccctttgaaagtaaaggtttttgctttacttttagatttcttagtgcttttagtaaatgttcccaggaaataaaactaatgcattacttggtaatacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagagaggttaagcaacttctgtagggacagagatttatagattatagtcaaactcgtgatcagtgctcttttgattaccatgttgatggaatgtttaagtgtaagtgacttctggggaaaagcatattgatttagatacctattgcttaagctcatttttatatagttaagagtagctatttaagattcttaatttgtccttttagtcaagagtaatttattgaacacctgttatgggctaagcgttagatatacagagatgaataacataagactcctattcttaagtatcacacattctagagaatacacagcaaatgtttattggattaactgaattaatgtaaaggaaaaacagttttttgggtttctttgttttcctgttttagaggaatcgtttggtgactaaagagcaaggatgtacaagataactcagaaataaaatattgctaaatatatatatatatatatatatattttctgagacggaggctcactctgtcacccaggctggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatggtaagttcagcatgcattatgtctgacttacagataaacacacacagacacacacacactcacatatccctgatcattttcatagtttgttacttcagttaaagatgtcaaattctatttcagatgcttttcttgtttggccgagaagacttaataaatgcataagtgaatttagtttcaaatgttgacaaattattaaagactaatgttaaggaatttcttttttagttaaaaaatttttaattgatctataatagagttatatattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagtattctttacatggcttttggtcttctaagtgaagctttttgtttttctttgtagtaattttcctcatcttgtactggagaaaattcttgtgagtctcactatgaaaaactgtaaagctgcaatgaattttttccaaagcgtgccagaatggtatgttatctaataatgctctttatcattttaagctatagctttaattacaaagatgataattttagctgggtagtagctgcatcttaataattgtaaactaaattggtccaaaaaaattgcaactgttagccagggaagaggttgttttaattcagtgattgtaatctatgttatataacattagaccaagcttactattttttaatgctgtatagtataatatgtgacaagtgccaatgagaaaaactgaatggttatgctgggaaattaagaatataaaatttatatgaaataagttcttaaagatgttacccatttctgtacatcaactatgatttgactatttgttagctttaaaaactaatgataattgaaaacaaaaataaatctaaacctgagtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattgtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgaggtgagattttttaaaaaaagaactaagcttatatatgattcaactttggtaaactgttaggaaggagaaataggggcaggaaaaacagcaaggatggtgggaggcttcattttaaaagcaaagtggcagtaaagggctctaaattggacaacttagcataattaaaggaaaactcaagaataataatttgagtacttcctttgtactggaaattatggtagacataaaataattccttgtgtaggttagtgaggaatagtaagagtttgagcatagggattatatgatgaaaaaaacctctaaatacaaaggagggaaatgttacagtaatagaaaagaacacgatgtaaacaaatctaatagattttggtggcatctgaagagagatgagtgattagtaaagacaataaatggactagcaattattttagacgtcatctaggaatttcctttagcctcaaaatcacgagttctcttcatgtatactattctcttgccaaaacttgcattttttaaaatgtgaaatgtctttctacctatttctgtgtattcagatcatccacatgtgaaaatccttgctaacgcctttcttagaatctcagaaagtaagattctaagaatttttatttttgagacagagcctcgctctgttgcccaggctggagtgcagtgacgtgatcttggctcactgcaacctccgtcttccagttcaagcaattctcctgcctcagtcttccgagtagctgggacaggcgagtgctaccacgcccaggtaatttttgtatttttagtagagatggggttttgctatgttggccaggctggtcttaaactcctgacctcaggtgatggacccgcctcagcatcccgaagtgctaggattacaggcgtgagccacggtgcctggcctaataatttttcatcttttaatttcatagtacttaatgtttcacatttttaatggcagttagcatcttctttataccatggatatttacatatggtttgtatacaaatatctcttgaactataactcttaaacataaactcttaaaagggcatacatgtttttatttatctttatatcctccacagtgccttattacatggtaaatgattaaataaagcctacaatccattcaaaggagtgaattcggtagccagggaaaatgacttgaggacatgagaggggacagtgtgcctctttatgatctttactgacattcttctgcaccacaattgtaaccactttcattacaaagtaatttagttttgtatattttctcctaaaatgccgtttcctaccctgtaggaacaaaaaaaatctgaacattttgtgtgtaacttagcagattcttagtaattctataaaattgtctaaactttttttttttttttttttttgagatggagtcttgctctgttgcccaggctggagtgcagtggcctgatctcggctcattgcaaccttcgcctcctgggttcaagcaattttcctgcctcagcctcctgagtagctgagattataggtgcctgccatcacgccctgctaatatttgtatttttagtagagacaaggtttcaccacgttagccaggttggtctcgaactcctgacctcaggtgatctgcccgcctcggcctcccaaagtgttggggttgtaggcgtgagccaccatgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgtagagcatgcaggtttgttacatagatatacagtgccatggtggtttgctgcacccatcaactcgtcatctgcattaggtacttctcctaatgttatccctcccctagcccccgaccccctgtcaggccctggtgtataatgttcccctccctgtgtccatgtgttctcattgttcagctgccacttatgagtgagaacatgcagtgtttgtttttctgttcttgtgttagtttgctgggaatgatggtttccagcttcatccatgtccctgcaaaggacatgaactcatccttttttatggctgcatagtatatcatggtgtatatgtgccacattatctttatccggtctatcattgatgggcatttgggttgcttccaagtttttgctgttgtgaacagtgctgcaataaacatacgtgtgcatgtgtctttatagtaaaatgatttataatcctttgtgtatatacccagtaatgggattgctgggtcaaatggtatttctagttctagatccttgaggaattgccacactgtcttccacaatgattgaactaatttacactcccaccaacagtgtaaaagcattcctgtttctccacatcctgtccagcatctgttgtttcctgactttttaatgataggctgtaagcatgaaactctttcttatctcttggtagtactctgtcactggtatgatttgcaagaacagagtataagatttgccattttaaaaaattgttaatgagttttgcttatactgtatgactacgtggaacttctaaaaacatttcattttttctcttaagtgcactttattttttattttatagtatgtccaagatcaaagtacactgtaaaaagcaatactaaactataattttaactggaatttgcatttttccttctattcacaatagtctctaatgcaatgtgcaggagaaagtatcactctgtttaaaaataagacaaatgaggaattcagaattggttccttgagaaatatgatgcagctatgtacacgttgcttgagcaactgtaccaaggtaagattttcttcttcttgttttgttttttgagataggatctttctctgtcacccaggctggagtgcagtgggattgtcacaactcattgtagccttgacctcctggtttccagcaattctcctgcctcagcctcccaagtaattgggactacaggcatgtaccacctagctaaaattttctttttacttgaaagtgtagcctatgcagggaattgatcactggttggtgttactgttttggtgtccactcgtaagtttattttttacttttatttttcttttttttgagacagtctctcactctttcacccagagtgagtgatcacatcactgcgatccagcagcctcgacctcctgggctcacagcagcctcgacctcctgggctcaagtgattctcccacctcagcctccttagtagctgggactacaagtgtacaccaccatgcctggctgatttttgtatttttgtaattttttgtattgatggggttttacacattgcccaggctagtctcaaaccctgggctcaagtgatgcttacatctcaaagtgctgtgattacaggtgtcagctaccatatctgttcacattcataagttatacaaattgatttaaaattcagttgaatggtacataaaggtaatatccagacaaataagcaataggaatctgagtttctcatgaaactaattttataatttcaggaatttttctgagattgccttatgacttttatatacaaccatatagatgactcttttattcctgggacactttcattcatttaataaaaattttttgacccaaactatgtggtatgcgtagcggggctagtgagcaacacaacaataactccagcacatagtttactttcttttgctcagatcaccttacataacatttggtagaaagagtgctactgtgtttaatctttgtttttatctgcagcagcctgtgggatagccaagccaggccccagagtattgataataattggaaatatatttcaaacctagtattaggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatcaatacctagcatagtagtgcctgcctttagtttctcaataaataatacatttaaaaattgggaacgaatcatccaggctcacagctatatctgcgcaacattgtaccaaaatttaaaataattatttgttctttaaaagtgaccaaaaatcttgccaggcaagcaacatattcttattgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtgtggtgatagtgaatagtatatatgtatatgaaagcttatctgctcttttttttttttttttttttttgagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgtgaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagccgaagcagggcgaggcattgcctcactcaggaagtgcaaggggtcagggagttccctttctgagtcaaagaaaggggggacggacggcacctggaaaatcgggtcactccccgaatactgctcttttgcgacgggcttaaaaaacggcgcaccacgagattatatcccgcacctggctcggagggtcctacgcccacggagtctcgctgattgctagcacagcagtctgagatcaaactgcaaggcggcagcgaggctgggggagggatgcctgccattgcccaggcttgattaggtaaacaaagcagccgggaagctcgaactaggtggagcccaccacagctcaaggaggcctgcctgcctctgtaggctccacctctgggggcagggcacaaacaaaaagacagcagtaacctctgcagacttagatgtccctgtctgacagctttgaagagagcagtggttctcccagcacacagctggagatctgagaacgggcagactgcctcctcaagtgggtccctgaccctgacccccgaacagcctaactgggaggcaccccccagcaggggcacactgacacctcacatggcagggtactccaacaggcctgcagctgagggttttgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctccaccaaaggaacgcagttcctcaccagcaacggaacaaagctggatggagaatgactttgacgagctgagagaagaaggcttcagacgatcaaattactctgagctacgggaggacattcaaaccaagggcaaagaagttgaaaactttgaaaaaaatttagaagaatgtataactagaataaccaatacagagaagtgcttaaaggagccgatggagctgaaaaccaacgctagagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgggaaaagaccaaatctacgtctgattggtgcacctgaaagtaacggggagaatggaaccaagttggaaaacactctgcaggatattatccaggagaacttccgcaatctagcaaggcaggccaacattcagattcaggaaatacagagaatgccacaaagatactcctcgagaagagcaactccaagacacataattgtcagattcaccaaagttgaaatgaaggaaaacatgttaagggcagccagagagaaaggtcgggttaccctgagagggaagcacatcagactaacagcggatctctccgcagaaactctacaagccagaagagagtgggggccaatattcaacattcttaaagaaaagaattttcaacccagaatttcatgtccatccaaactaagcttcataagtgaaggagaaataaaatactttacagacaagcaaatgctgagagattttgtcaccaccaggcctgccttacaagagctcctgaaggaagcattaaacatggaaaggaacaaccggtaccagccgctgcaaaatcatgccaaaatgtaaagaccattgagactaggaagaaactgcatcaactaatgagcaaaataaccagctaacatcataatgacaggatcaaattcacacataacaatgttaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccactacaggagcacccagattcataaagcaagtcctgagtgacctacaaacagacttagactcccacacattaataatgggagacttttaacaccccactgtcaacattagacagatcaacgagacagaaagtcaacaagtatacccaggaattgaactcagctctgcaccaagcagacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaccgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagcaatacaaactaccatcagagaatactacaaacacctctacgcaaataaactagaaaatctagaagaaatggataaattcctggacacatacactctcccaagactaaaccaggaagaagttgaatctctgaatagaccaataacaggatcagaaattgtggcaataatcaatagcttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcatactgataccaaagccaggcagagacacaaccaaaaaagagaatgttagaccaatatccttgatgaacattgatgcaaaaatcctcaataaaatactggcaaactgaatccagcagcacatcaaaaagcctatccaccatgatcaagtgggcttcatccctgggatgccaggctggttcaatgtacacaaatcaataaatgtaatccagcatgtaaacagaaccaaagacaaaaaacacatgattatctcaatagatgcagaaaaggccttggacaaaattcaacaacccttcatgccaaaaactctgaataaattaggtattgatgggacgtatctcaaaataataagagctatctatgacagtcccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttcttcacagaattggaaaaaactactttaaagttcatatggaaccaaaaaagagcccgcatcggcaagtcaatcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgctgcatatctacaactatctgctctttgacaaacctgagaaaaacaagcaatggggaaaggattccctatttaataaatggtgctgggaaaactggctagccatatgtagaaagctgaaactggatcccttccttacacctgatagaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacagaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaatccttttacactgttggtgggactgtaaactagttcaaccattgtggaagtcagtgtggtgattcctcagggatctagaactggaaataccatttgacccagccatcccattactgggtatatacccaaaggactataaatcatgccgctataaagacacatgcacacgtatgtttattgtggcattattcacaatagcaaagacttggaaccaacccaaatgtccaacaatgatagactggattaagaaactgtggcacatatacaccatggaatactatgcagccataaaaaatgatgagttcatgtcctttgttagggacatggatgaaattggaaatcatcattctcagtaaactgtcgcaagaagaaaaaaccaaacaccgcatgttctcactcataggtgggaattgaacaatgagatcacatggacacaggaaggggaatatcacactctgtggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtgtaataaaaaaaataataatttttaaagtttgcatattattttgttatgtagacatattacaggttatatatccattttactattgttggacatttagtagaaaaagtactgtagttttcatacttacacatgaaccttgaattgtttgattaggtaaattttttttttttttttttttttgagacagagtctcgcttcgtcaaacccaggctggagtgcagtggcatgatctcagctcactgcaatctctgcctcctgagttcaagtgattctcctgcctcagcttcctgagtagctgggattacaggtgcccaccaccacacccagctaatttttgtattttaaatagagacaaggtttcaccatgttggccaggctggtttcgaactcccgacctcaggtgatccacctggctctgcctcccaaattgctgagattacagatgtgagccactgtgcccagcctgattaggtaaattttgactacagcatgctcctgcaagaagccatcttgaacatctttgtttctcttccttgaaggcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtaaatacatatttactacttgggatttcttttacttctttatattgatttggcagtataagaggcctcattgatatcaattttgtgcttatttcattttctcttagtatagccttttaggattgttcctttcttatatactttattttttttttatttttacttgaatttattagtttcatattttattcttcatagaaggaacttaagataactattaaagaaataaaaccaggccaggcatggtggctcacgcttgtaatctcagcactttgggaggccaaggcgggctgatcatgaggtcaggagatcaagaccatcctggctaacgtggtgaaaccccatctctactaaaaacacaaaaattagatgggcgtggtggcgggcgcctgtagtcccagctactcgggaggctgaagcaggagaacggcatgaacctggggaggtggaggttgcagtgagccgagatcatgccactgcattccagcctgggcgacagagcgagactccgtctcaaaaaaagaaataaaatcatatgataggttatttcctcaatagaaagcaggaaatgaaaacacacctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacgcagatacacacatcattttctctgaaccattttgagatgaaatcgcacacgtgatgctccttatacttcagtgtatatttcctaaaaacaaggatacacttctgtttagccacagtataatcatcaaaatcaggaagttaacattttgtcattgcatttaggtgtgtagtctgtttagtctccttcaatctggaacagttcttttttttatttatcatgaccttcatatatttgaatagtacaggtcccttgctctgagtttgtctgatgtttccttatgattaaatttatactttgacgagaatgttgcaaaagtaattcctcttctgccttcaccctgtccatttatctgtctgttgatagatatcttcaaatccaagccaacatcacacagtttatctttttttctgtccaaatttataaattgctttactagcagttaaaaaaaacaccccaaaacctgactatccactcaacctgaatgcatttacttatttgctcaacaaccttatatataactaatctaaccatgtgggccattttcttagccctagccccagtgtatgtggaggtagagcctctggcctagcgagtagcaagttgggtcctaggtcatgtccccagttccagcaaattgtcacacatgcctggtgagtccctaattagaacctctgatcacagtaaattgtaggctgagtcattggtggaatccctggtcatgtttcccacccttggtgaaaatgcacgtcaatcccttagagtgagaagacaagtttggttgtgccctgtttgggcccctggtttaggtcctcgcagatactcaagtctctatccctgaccaagaggaagttacatgcttttcttgaagtattgatgtttcaagtcacttcagaacattcagtaacctcatgtacatgactctcatgtcaaataatgaaaaggatcatttaatttcctttgttaatatctgaaaaggattaagaaatatattattctatatgtaaataggaaaaaaaatcccttattatttcagtatagccagaaaattatttggtagttctcggaaactggctgcccagataataactaccattataactggtcgttgcagcagccctttctgtgcatagtaccataaagagccttacaagattgccttatgggaagataggtcaaggtttttgacttcttccctgcccatgattatctctgctttccaaaattcattaatagttttcaaccactggtctattatccccaagcattattttgggagagtggagacttacagtttcagaatcttgctcaagctcttaactgcaacagtggtaataatgatcatttattgaattccacaatagaagctagacttttacgtttattttctctaatcctcacagttatctggccaggtaagtgatatatcttcactctactgatgagggtacgaaggccctagatgacataaggcaagttttttaccagaaaagttaaggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaacccttgtactatctgattgctaagtaattctaaatcaatagactgttttttgtttttgtgtttttttgagatggagtctcactccatcacccaggctgcaggctggagtgcagtggtgctatatctgctcactgcaacctccgcctagtaggttcaagcaattgtcctgcctcagcctcctgagcagctatgattacaggctcccaccacaatgcctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtggttgactcgagtgaggtgtgtctactatcatgtacaggagatacggactgtttggaaattactgtgattttatgtgagtttatgaaatgataattagcacattttacattgtgctaattacaattatatttacttgagtgaacatccagtgaagcactggaaggattctatcatgaggatcttttatatttgagtactggaataaacatatattaatttcattctttttttttttttttttttttttttttgagatggagtttcgctcatgtctcccaggctggagtgcaatggtgtgatctcggttcacttcagcctctacctcctcggttcaagcaattctcctgcctcatcctcctgagtagctgggattacaggcgcctgccaccatgcccagctaatttttttatttttcgtagagatggagtttcaccatgttggccaggctggtcttgaactcctgacctcaggtgatccacccaccttgtcctcccaaagtgctgagattacaggcgtgagcctttaatcatgtagtttttgtcattcgttctgtttatgtgatggattatgtttattgatttgtgtatgctgaatcagccttgcgtcccagggatgaagctgacttgatagtggtggataagcgttttgatgtgctggattcagtttgccagtattttatcgaggattttcacatcgatgttcatcacggataatggcctgaaattttctttttcttgtgtctctgccaggttttggaatcaggatgatgctggcatcataaaatgagttagggaagagtccctctttttctattgtttggaatagtttcagaaggaatggtaccagctcctctttgtacccctggtagaattcggctgtgaatccctctggtcctgggctttttttggttggtaggctattaattactgcctcaatttcagaacttgttattggtctattcagggattcgacttcttcctgctttagttgggaggttgtatgtgtctaggaatttatcactttcttctagattttctagtttatttgcatagaggtatttatagtattctctgatggtagtttgtatttctgtgggatcagtggtattatcctctttatcattttttattgagtctatttgattcttctctctttattagtcttgctagcggtctgttttgttaatcttttcaaaaaatcagctcctggattaattgatttttttgaaaggttttttttgtgtgtgtgtgtctctatctccttcactcagctctgatcttagttatttcttgtcttctgctagcttttgaatttgtttgctcttgcttctctagttcttttaattgtgatgttagggtgttgattttagatctttcccactttgtcctgtgggcatttagtgctataaatttccctctaaacactgctttagctgtgtcccagagattctggtacattgtgtctttgttcttattggtttcaaagaacttacttatttctgccttcatttcattatttacctagtagtcattcaggagcaggttgttcagtttccatgtagttgtgtggttttgagtgagtttcttaatcctcagttctaatttgattgcactgtgatctgagagactgttacgatttccattcttttgcatttgctgaggtttgttttactttcaattatgtggtcagttttagaataagtgtgatgtggtgctgagaagaatgtatattactctgttgatttggggtggagagttctgtagatgtctgttaggtctgcttggtccagagttcggttcaagtcctgaatatccttgttaattttctgtctcattgatctgtctaatattgatggtggggtgttaaagtctcccgctattattgtgtggaagtctaagtctcttcgtaggtctaagaacttgctttatgaatctgggtgctcctgtattgggtgcatatatatttaggatagttagcacttcttgttgcattgatccttataccatcatgtaatgtccttctttgtctttcttgatctttgttggatgtttgttttatcagagactaggattgcaacccttgctttttttctttctatttgcttggtaaatattcctccacccctttattttgagcctatgtgtgtctttgcatgtgagatgggtcccctgaatacagcacactgatgggtcttgactctttatccaatttgccagtctctgtcttttaactgggacattttagcccatttacatttaaggttaatattgttatgtgtgaatttgatcctgtcattatgatgctaactggttattttgcccattagttgatgcagtttcttcatagtgtcaatggtctttacaatttggtatgtttttgcagtggctggtaccagctttgcctttccatatttagtgctaccttcaggagctcttgtaaggcaggcctggtggtgacaaaatctctcagcatttgcttgtctataaaggattttatttctcctttggttatgaagcttagtttggctggatatgaaattctgggttgaaaattattttctttaagagtgttgaatattggcccccactctcttctggcttgtaaggtttctgccgagagatctgctgttaagtctgatgggcttccctttgtgggtaacccgacctttctctctggctgcccttaacattttttcattcatttcaaccttggtgaatctgatgattatgtgtcttggggttgctcttctagaggagtatctttgtggtggtctctgtatttcctgaatttgaatgttggcctgtctcgctagattggggaagttctgataatatcctgaagggtgtttccaacttggttccattctccccatcactttcaggtacaccagacaaacgtagatttagtcttttcatatagtcccatatttcttggaggctttgtttgttccttttcattcttttttctctaatcttgtcttcatgctttatttcattaagttgatcttcaatctctgatatcctttcttctgcttaatcagttcggctgttgatacttgcgtatgcttcacgatgttctcatcctgcatttttcagctccatcaggtcatttatgttcttctctacactgattattctagttagcagttcctctaaccttttttcaaggttcttagcttccttgcattgggttagaacatgctcctttagctcagaggagtttgttattacccatcttccgaagcctacttctgtcaattcgtcaaactcattctccgtccagttttgttcccttgctggtgaagaattgtgatcctttgcagcagaagaggcattctggtttttggaattttcagcccttttgcgctggtttttcctcatcttcgtggatttatctacctttggtctttgatgttggtgacttttgtatggggtttctgtgtggacatcctttttgttgatgttgatgctattcctttttgtttgttagttttcctttttacagtcaggcccctctgctgcagatctgctggagtttgctggaggtccactccagaccctgtttgcctgggtatcatccatggaggctgcagaacagcaaagattgctgcctgttccttcctctgggaaggttcgtcccagagcggcacccgccagatggcagcgggagctcttctgtatgaggtgtctgtcgacccctgctgggaggtgtctcccagtcaggaggcacgggggtcagggacccacttgaggaggcagtctgtcccttagcagagctcgagcgctgtgctgggagatccgctattctcttcagagctggcaggcaggaacgtttaagtccgctgaagctgtgcccacaaccacccctttccccaggtgctctgtgtcagggagatgggaattttatctataagctcctgactggggctgctgcctgtctttcagagataccctgcccagagaggaggaatctagagaggcagtctggctacagtggctttgtggcactatgttgggctccacccagttcgaacttcctactggctgtgtttatactgtgaggggaaaacatcctactgaagcctcagtaattgcagacgcccctccccccaccaagcttcagtgtcccaggtcgacttcagactgttctgctggcagcgagaatttcaagccagtggatcttaacttgctggtctccatgggggtgggatccgctgagctagaccacttggctccctggcttcagccccctttctaggggagtgaatgggtccgtctcgctggcgttccaggtgccactggggtatgaaaaaacactcttgcagctagctcagtgtctgcccaaatggccgcccagctttgtgctttaaacccagggccctggtggtgtaggcacccaagggaatctcttggtctgcgggttgcaaagactgcgggaaaagcgtagtatctgggcaggaatccaccattcctcacagcatagcccctcacagcatagtccctcacggcttcccttggctaggggagggagttccccgaccccttgtgcttcccgggtgaggctacaccccaccctgctttgactctccctccgtgggctgcacccactgtctaaccagtcccaatgagatgagccatctacctcagttggaaatgcagaaatcaccaccttctgcgttgatctcactgggagctgcagaccagaactgttcctatgttgccatcttgctgttcccttgttttatttttctctagtatttatgataacgtgaaacatattttaatatatttacttctccgtattccactagtatatatgttcctaaaggcactggtttttgtctgttctgttcattgttgtatttttagcacctaaaacaatacttggcatgtgataggtatccaataactgttttaaaataaatgaatgtacttgaaaaaaaattacatgatgcttcaaaaacatcaaagctgaaaatcatttgagtaactttaaaatgtaagcaatcaataataaaagattactatattgttcagcagtcacataaagtattaaaactaatatttcagtatttgaatatgccgacagtaatgttttcataaactagattttgtgtctaactcctcaggtttggaactgtttttagtaagaccataatgcattgcaaggatttctaatgaatatgtttagtagttcaagcccttattaaatttcacagataaaagcaaatgtatgctgaactttaaggactgaggtaatataagactgaattgaatgtaataaggcggcagtgtagtggtggcattaaaaaaactgaagattcaaaaagtataaattcaagaataacatgcaagtagcattcttttttttaattttacacttgttagattttgtcttagtccctttgtgttgctataaaggaatacctgaggctggatatttacaaagaaaagaggtttatttggcatatggcgtctacatctggtaagggcctcagactcatggcagaaggcaaagaggaatcagtgtgtgcagagatcacatggtgagagaggaagcaagggtggaggcggggaaggccatgccaggctcttttttttaataaccagcccttgtgggaactgaatagtgagaactcactcattccttaccctcaggccttaatctattcgtgagggatctgcccccatgactccgacacctcccattaggcataacctaatggggatcagatttcaacatgacatttggaggggttaaacattcagacaatagcagatatctaatgttcagctattttaagagcagtgagtgaaactagaagaatcagaggaacataaacaattataaaagcttcgattactaaaaaaggataaaagacaaagttgattaaagagttatccttaaatatgtgggtgttacgcaaaaggtgtactgatcaacttttttccatcacataaaacaaaatttaaatggtacataaaaacattaacttacccgctttcagagtgattaaatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttacaagtatttaaggtagttaaataactgtcaagtctgtgatagcaggaaattgaaaggaacaattgaaagaatgtgagtttagaaaagaatttcaatagattagaaagataagtgtaaataacataaaatctaatgagataatgtatattatacattttaaatcagcctgtcatctgcaaaaagggaaaatactgatctgacagcaattcatttagaaaaagacctaggaagttttgtatcttgtgattatagtatgaatcaacattgtattacagttaccaaaaaggctaactctgtcttacactgcattaatagaagcatattgtcatgaacaaagttaatacaagaacttggatcttttatactttttgctttatttttagatcttttaatttttatgggtacatagtaggggtgtgtgtgtgtgtgtgatacgggtatacaatgtgaaataatcacatcatggagaatggggtatccatcccccaaacaaatatcctttgtgttacaagcaatccaattacactgttttagttattaaatgtttctgtattttttagaggataactataatgtttggtttggttctgagtaaagtaaaagatttttagccagaatgttatagatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggtatatatggatgagtattttattagaagcttccttaggtcactgtgaaataatttaaaaagttaaagctagattttctgagtggcacttatttaagactaggaaacaattttattttttaggttgggaatattggaaagcagttatacaaaaactattcaaatggtatatttatggtatgcactgtttcttacattccatttaagagcatttcacaaggctttcattgtactaacaagagtgaatgacttgtccaccagactgaccaggcttttggaaatagtatttattgagggaaacacatggagacaagagcagcataggtgttttgcccggtagattctggggcagcacattgggatccagcagggccagaagtcaaattttagagctatcaggcttttaagttcagttatcaggggagaaggactagggtccaagccttataattactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttcggtgtttcttaaaagtatacaaatacattacctaataatcataagtgttatgtattgtttggatttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagtctcgctctgtcgcccagactggagtgcagtggcatgatctcggctcactgcaagctccgcctcctgggttcatgccattctcctgcctcagcctcccgagtagctgggactacaggcgcccgtcgtcacatccacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtagaagaaaaatttgaaaatggagaggtttgaaacaactaaaaagtaatgtttaggtatcaggatgatgggaaggcatctcatatttgttgaacatgctctgtgttatggactttgctatgcattttacatgtagtgtatcacagatctgagtttcagacttatcctaatagagttttctaatagattatgagttgtatgtaggtagtttcctttaagaaggatattcctacaaaagtaaatttagtggtccttatagttcattcattttggcaagaacaatatagctatatctctgtatatgcgagggattcattccaggatcccccatgtatgcctaaatttacgcgtactcaagtcaccaagttggccctgcagaacccacgtatatgaaaagtcagtcctctgtatatacagactttcacatcctgtgaatactgtttttctatctgcatttggttgaaaaatatgcaagtataagttcaaacccatgtttttcaagggtcaactgcatttatgttagttgattatgcagaagaaataaatataaattcaagtctccatttttatttgtttattgttttgttttttctttttgctaagggtgctactgaacaaggtcccatttttaaatcccataattatggtggtggtatgttctaagctttctaatttttttaatgtgactatttagaatttacttaatttttccatttataaaattaaagaatgtttaataatctggataaagtatgatactttaatgctgatggtattaaaacagtttttaagaactattttataaaattttacttggaaaagttatatataacctgtattttaaatttttctatttttagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttttgtttttgagacagagtcttactcttttgccaagactggagtgcagtggcatgatctcagttcactgaagcctctgtctcctgggttcaagcaattctcctgcctcagccacccaagtagctgggactacagctgcgcaccaccacacccagctaattttcatatttttagtagagacggggtttcaccatgttggccaggctggtctttaactcttgacctcaggtgatcttcccacctcagcctcccaaagtgctgggattacagatgtaagccaccttgccagaccataatttacttttgaattatgtttattatttaccagtcttctccagtatacatttttctctctttttttttttttggctgatgtatctctaatatattttgagtattcattaaatgtttgtcaaaagaaggagtcaagtaaggaaggatttaaaaagcttcgtttgttttataatcatttatatacatttccaaaattttttgaagcaacttatattaaaacatacatacaaattttttaagataaaaaagctgtggtcaccccacatttatgtatgtatttatttattttggatataagtaagggataagtaaccaaacttggtcaatattagataaacttcaagggaccttttttttttttagtttcctagttatctatattgaaccaagaaatggaacagcaagttccttagttgcttaggtggacctattcagaactggttgtaagtctgcagtctgaagggaaatggtgagcagaggactcctttcccaaagacagctggaacagaaataggcactccagaggttatggaatttgagagagatactcagcctctagccactcccattcaatctcccagcttagtcttctgagcattcttaatcttactattcttttcttaatgtattcaaaccaaaagacagcaatttttagagcctgaataggttttggagggaaaagtaattacgttcaacttcgattgaaactcttgcctcaagaatgaagaacagcaaaaattaaatcacagtttcttagctttttggttaaagatgtaagttaaattcttggccgggtgcggtggctaacgcctgtaatcccagcactttgggaggccaaggcgggtggatcacctgagatcaggagttcaagaccaacctggccaacatggtgaaaccccatctctactgggtgtggtggtgtgtgcctgtaatcccagctgtttgggaagctgagtcaggagaatcacttgaacccgggaggtggaggttgcagtgagccaagattgtaccactgcattccagcctgggcaacagagcaagatttcgtctcaaaaaaaaaaaaaaaaaaaaaaaaaagaattgtataaaacacacaaacaaagcaaggaaagaatgaagcaacaaagccagagatttactgaaaatgaaattatactccacagagtgggagtgggccctgagcaagtggctcaagggcctggttacagaattttctggggtttaaatacccttcagaggttttccattggttacttggtatacaccctatgtaaatgaagtagtggtctgtaatcagtctgattggttataggaggggaccaatcagaggtactttcaatttcttatctgccacagtaaaagggagggggttgcaaagggagtagcctcttgtccttttgttacttgagcatggaaagttggggttttccttttgatttcgttctaggaggtcagcatggattgaccttaggttccctgcctccagaccttattgccctgcctcatttacgttaggtttctttcttgtcaccttctaaaatattttttgttattaggaagtatgtttttgaacttccttatgcattaagtaaattagccatttatcactgtaattccttatttggaaagttgttatattcacccttaagacttcacaattctcattcatttaactaaagtgcaacatagcagacttattctttatatttagagaatttgtgtcttttgtgaagctacctgtctatagtgggaagtagattaatgaaaagtccaaatctgttggggagggttttattctactattgatgaaaggggatgtggatcgcagctagccttagaatttgggatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgacagatgcacatcactgcgcctggctaattttttatatttttggtagagacggggtttcactgtgttgcccaggctggtcttgaacttctggcctcgaatgattcccccgtgttggccaaccaaagtgctgggtctacaggcatgagccgccgtacccagcctcaccttttctttattgtgcgttattatctgtacaatttaatttggatgtgaatgtctctgagttgtatatgaacatcagagttgtttccctggcttgattgtaagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaagtactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaacaaaactttttaaaacgatgactgtattttttcccttaactctgttagggatttggatcctgctcctaatccacctcattttccatcgcatgtgattaaagcaacatttgcctatatcagcaattgtcataaaaccaagttaaaaagcattttagaaattctttccaaaagccctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctaggattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggtaaataacatatttagaccaatatataagcagtctttctatcctgttcttcctgtttttttgctttgttttgttttgttttgagacaaagactcactctgtccgcccaggctgggtgcagtcacggctcactgcatcctcaacctcctgggttcagattatccttcctcctcaccctgccgggtagctggggctacaggagcataccaccatgcctgactaattttttgtgttttttgtagaggtggggtttcaccatattgcccagggtggtctcaaactcctgggctcaagcgaactgtcagcctcagcctcccagtgtgctgggattacaggcatgagctactatgcccaacctatcctgttcttttaattgaaagtttatatgcttctaagaggtagataccagaatgttgctttctgaattttgctttttaagatgtctattatatttacttattagtttttaaaaattgcgctacttgcctgggaaacatagcagacctcgtttctactaaaaattttttaaaaaagaaaattagggcaaggtgtggtagctcacacctataatcccagcactttgggaggttgaggtaggtagattgcttgagcccaggagttagagaccagcctgggcaacatgatgtgaaaacccatctctacaaaaattttttaaaaaataagccagggattgtggcatgcacctgtagtctcacctactccagaggctgaggtgggaggatggcttgcgctcaggaggcagaggttacaggttacagtgagcaaagattgtgccactacactccagcctgggagacagagcgagactcttgtctcaaaaaaaaaaaaaaaaaaaaaaaaaaaaagaaaattatccaagtatgatgatatgcgcctgtagttctagctacttaggaggctgaggtaggaggatggcttgagctcaagagtttgaggctgccagtgagccttgattgcaccactgcattcatgcctgggcaacagagtgagactttcactcaattaaaaaaaaaaaaaaaagcactacttctccaattctagaaatcttaagaaggatcttcaacattttaatactaatattctagctattgatggcctcaaataaatgttactatagaattggggttgttcggccgggtgtagtggctcacgcctgtaatcccagcactttgggaggctgaggcgggtggatcacaaggtcaggagatcgagaccatcctggctaacacagtgaaaccccgtgtctactaaaaatacaaaaaaattagccaggtgtggtggcaggtgcctgtagtcccagctactcaggaggctgaggcaggaaaatggccagaaccaggtaggcagatcttgcagtgagtctaattcgcaccactgcactccagcctgggcgacagagcaagactccgtctcaagaaaagaaagaaaaaacaaaaacaaaacaagaattggggttgttcaatttagcatctctgatcttttccattgattttaatgagatttctattttttaaggtcttttttattgtggtaaactatataacataaaattttttattttcgccattaaatggccagttcagtagcatcaattacatttccattgttgtgcaaccatcaccactgtctatgtccaaactttcattatctcaaactgaacctctctactcattccacaataactccacattcctcctccccactggccattgagaaactaatctattttctgtctcaatgaatttgcctattgtagatattttaatctagagttgtacaatatatgtccttttgtgtcttgccttgtgtggtcactgaaaactttgtaccttagcttgtgtttagatagtgtttgatagagatttccttggataccaagagtgttgggatgaggaagcatgagaggagaaaacttttcctagtgtttgcagattggctttatgctaggattcttcttcaacacttagccatgcttgcattgcttgggatcagccccaaatacaagcttagggtcttctctggtcttttctgagcaagagtcttatcttgagcatgtgtgtggctttctgaattccccctaatttgtgggtgcttttgaatatactaatttcccaaagaaatacgctccccagctactcctaggctttaggcagcctcttgtatgtctcaacagtaatcttttgccctatgcacctgcaggttgttggtctgccttacaaagtttcaagcaacacccatatcttttgtagctggtatgaagttaaacaaaacagagctacgcactttacatcagtccttggttccagacaggttagaatagacatatacaatagtttgcaactaatctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataattttttctttttaaattatatttaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggtaataaaaatttcatcatctactattttttattagagaacatagtagtacttttcaaaaatctgtaatgctctagcagtaaaaaatggaatcttttctttaattgtgattaaaaatatatacgtaggccaggcacattggctcatgcctataatctcagcactttgggaggctgaggcaggaggattgcctgagcccaggagttcaagaccagcctgggcaacatggcgaaaccccgtctctacaaaaaattagtcgggcatggtgatatgtgcttgtagaatcagctactcaggtagctgagatggaaggatcacctgagccctggaggtcaaggctgcaataagccaagattgctccactgcattccagcctggatgacagagtgagaccctgtctcaaaaaaaaaaaaaaaaaatatatatatatatatatatatatatgtgtgtgtatataaacacatacttgtgtgtgtgtaacgtgagatctacctacttaagaaataaaaaaatgaatcttaatgtatctctttgcattgaagccaaagtataaataacaaaacttcctggtaaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacatatttaagtatgttaagatgtaaagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgtaaaagaaaattttaattccttagagccagacatacaagttagtcttgtcttctagtccagtttacctgaatgaaagaaatatgtctcattttaatactttagtcatatgtgttatgtgtgtctatatatatgtaagtatgtatttgtaagtttttctagcttgcttgttaatttgatttgaaatgtacattattacagtatttgggaaactttctactttgtgttttgattttcatcttcctataccaattaatttcatatttcttttttttttttgaaacgaagtctcactctgtcgcccaggttggagtgcagtggcacagtctcagctcactgcaacctccacctcctgggttcaagtgattctcctgccccagcctcccaaggagcagggattacaggtgtgtgccaccatgcccagctaattttttgtatctttagtagagacggggtttcaccatgttgtccaggctggtcttgaactcctgacctcaagtgatccatctgcctcggcctcccaaagtgctgggattacaggcgtgagccaccacgcctggcctaatttcatatttctcttgtgttgtttttactctcagtactttttaaaatgaattttagttttgactatctgagcatagagtttctaatacatttgagatatataaaatgtatgtaaatagaaacaccattatttcttgtacttgtgttcttgagtattttatgggctagagatctgccttgtgcattacagccactagccatttggctatttaaatgaagtaaaattaaatgaaatttgaagttcagttttttcattggtactgaacacatatcaagttctcagtagtacatttggtcagtagtgatcattggacagtgtagattatagacatttccatcattgcagaaagttctgtgggacagtgctggtctaaactctaaatgttagatgttaaaaagccaagcaggctcccaaagtcccttctagctttagtgttgaatgattcttgtgcttctgtttgtgattttgctaaggtgttgacttatctgcacaatttgtttaagacattttattttctctgttgtcacatattgctaatcactttcaaaagaatctgttgtattaaggaagttcagattcattccctacatattttttgagctactcatgacttaaaaccttttttaaactttatagaagttttctagtcagataatttaatatatatgcaattataaacaaaagtgttgtcttcatgctagtttaaactaatttttaaaaaattatttctagataatccgcaagatgggattatggtgaaactagttgtcaatttgttgcagttatccaagatggcaataaaccacactggtgaaaaagaagttctaggtaaactacagtcatgcgctgcgtgacatttcagtcaactgcggatcacatataggacagattataatactgtatttttactgtatgttttctgttgcctgtagtattcagtatagtaacatgctatacaggtttgtagcctaggtgtgtagtaggctataccatctaggtttgtgtaagtatattctgtgatgttcacgcaatgacagaattgcccaatgacacatttctcagaacatatctgtgtcattaagcaaagcatgattgtattggcggaatgaatgtgagttatgcggtggtcatctttattatatgagtggttatctttattatatcttcaaaataagtgagggtttgtcatttgggatattggggaaatatgagatgctagctaagttacatgcctatttaattaaaatgtccctaaaaaggccccttttgtacttttcttccttaaatattcatataaaatgaaaagttagagatttacatatgtgtataacttaatttgaaaatgccttgtaaatatttaggaaagtcagaaatacttgtttttagagttaagttgcaaataaattgactgccgatatattttataaatacattataactgacaggtactcagtgtcttttgttatgtagcagacataagaatgaagacttggagggctagattaaacttaaataattaaaaaccattcaagtcctttcctacagccatttgaggggaaacctaatgtaaaataagaagccaacatcatctctagtttaggtgtttagatttagtgaccacgggatggagaaatcacctggttaaagtcagcttgaagctctcgtgatggtttttgtttctaattagaaaaataggaataagtagtgtttcacagattctactatctttcttcaacagccttaacttctcattaggagcctaatatctacagtacttccttttttgtagattttaaaaaattgagatatatcctaatatagaaaagtatacagatcaaaaatatctagcttgaagaatgtttgcagagtacgcttgtacatgtagcacccagactaaaaaacagaatcttaccagaactgtagaagttttctttaaccaacatacttacctccttgtccatagtggcactgcttttatggacagacctgatttacaacagaagccctaagtggctttcctgtgtagcataaaattaatgtggtttgttctcacagctttccccctaagatcaggaatgagacaaggctgtccactttcactactgctgttcaacagtgtactggaagttctagccagagcaattaaacaagaaaaagaaattaaaagcatgccaattagaaaggaagtaaaactatctgtatttacagacgacatgatcttatgtatggaaaatcccagagaatccacaagaaagctactgtagtgctaataaatgaatttagcaaagttgcagggtacaagatcaacacataattagtggtgtttgtatatactagcagtgcacaatccagaaagaattagaaaagcaattccatttacgatagcatctaaaagaaataaatagccaggaataaatttaatcaaagaggtgaaaaacttatatacattctgtttgttagacgtgagtcactaagtacagaccacactcaacgggagggaagttaggctctaccctttgaaagaagggctctcaaaaaatttgtgaacatattttagtaaataccatcatgatggaaagagcacgaagagccctctgggttgctgaaaatgtcctgtcttcatctggttagggagaacacaggcagaaaaaaatgtgtatttgtatgtataaattttcattgaactgtgtgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccgcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattggtgagtatttattgataccttatatgtaatctcaatatgacattcatggagaatgatacttcacacaaatagatattctcagtaactaaagctttgtccttttttaaatctcagtgtctttatgaaaattcttatatttttattaattcacataattatttaccctactatgtgccagacacttgatataatggtgaacattccagacaaggtccctgttaaaattttagtgggactagacaaataaacgataaataagaaaaatgccagatggttctacacagaaaattaagataggggaatataaagggagatgttttaggctcttgtcagtatcagaggtgccactctcctctaagcgaggccttattttgatccttttaaaataagtcgtaaagcagagaggttgttttataatcctagaagtcttaagctaatcagacagggtcttctattacttattctctgtgcaaagcagaattgcaccacatatcaaaatttcaactggttggttgagattacttttgcgtgcatgctctttctctctcttatttatttgttgattgattgattggtatctttgagtactccatcaccaccatatttgatggtagcctcaaagggttttcctcacaaccaggcacctttctaagataaatacgtgttttgatttttttctgtacttcccttcctccttctcttgaggaataaatgattggcaataatgtctaactgccatgtttccgttattgatttaatgtacctgtatatttctttcttttgttgttgtttttgtttcattaaacaaatttgtatggtttctttccaaacattttattataaaaagtttcaaacatacagcacaatggaaataattttatagtaaacacccatatgcttatcatatagtatctatattttatgctgtccttgcttaatcacttctagccatccgtctatccttgtgttaacatgtattaattcatctctctcttttttttttttttttttttttgagacagggtctcgctctatcacccaggctggagcgcagtggcatgataatacatcatagatcatagctgactgtaaccccaaattcttgggctcaagcagtcctcctgcctcagcctcctaatgtgcaaagtttatgtgcttgagccacaccacactcagccagttcatctcattttttaaatgtatatcaaggtatatcaagcacagtttttgaagagagtgccacagaaaatttgcgagcattaaatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtgaaatataggaagacccatagatttctccctttttccatgttgatatcgtaataaggttccactgtaagtattctgtgaagcatgtttaagaacacttgttccttccttagtctaagcattcctctttactatcttcttttcataaagtgactgagaaatacacagtttagttttcaccaatttaatttcagggcagaaacccaacattgaagcagtactttcagtgcatcataaatataattttagtgttagtaaaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataccaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatactacaccgcactcataccaattcagcagagtggtaccctgaacacacatacagcttatttctcattagtgaacaaagctaagatttttataaagttttacctttgagccagaaaataaaatgttccaaatatacatatgtacacaccccatttgtggtactttaaattctctagctctaaaactggtgttttgccttgtctttggtttgaaaaagaaaaagggtgcaattagtaatctataacctgtcttatgtgtgtgaagtatgatgaatatgatggatatggagtgtaatgattcattcatatgttaaatatggagtgcggtgaatagcaaaagtaaagctgaatactgttttaatgtgccagatgtattggagcacttttctgctctttggaatataccacaaataattacccaaattttatgcccagaagttgggcttattaaaaaataaacatttttaacatgactgttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttggccgggcacagtggctcacgcctgtaatgccagcactttgggatgccaaggttggtggatcacttcaggtcaggagttcaagaccagcctggccaacgtggtgaaaccccgtccctactaaaaatacaaaaattagccgggcatggtggcaggcgcctataattgcagctacttgggaggctgaggcaggagaatcacttgaactcaggaggtagaggctcctgaggctcactagccaagattacaccactgcattccagactgaacgacacagcgagactgtctaaaaaaagaaaaaaaaccctttgtataactataattaacatttagtgtatatccttctaattgtttaaaacaaaaattgaactgtactttatttactcttataacctactttccttctatgacatataatgggtatttctcatgccaagagcataatagcaaaagaaattccaccaagggttgggtatgtataatacatatatgcatgcttgaaggctcattatgggtcagttttttaaacctaaattttataaaaggatacaaaattcacagatctttattgttaactgtctttattatatattattaatgtgttttatatgcaaacataaagctaggtgcaaattcacttgttgtacttaaagaccaatcaattctaatacaaatgttgatttaatgtgatattttgccacaactaatctgctcctcccaatccttccagtcacttcagcaaaggttgtgattactcagttcttccaattgtttcttttagttttactgctacaaccttcatttgacatgactctaatgtcatttagacttcagtttgctatgctttatattttatgtattttattttctgttggctaacagcaattacaaatctactatttggaaaaatataaattataaacatagacatagatgcccatcctgtgatcctactagattataggctgttctctaaatgatctagaatgtgcttatatgaattttccttaggccactgaaatgaaaatcctaaaataaaaattctcatagaggctttgtaaactatctaaaatgtatctcttatctttaattgggaaaatacaggtataagtgatttaagcatttaaaactttaatatgtaatttacagtactattaaaaacaatttttattacatagtttaaggtaatcattgtttatgataatctggtaatttgttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcccttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattactcttctttcagatatcactttttcttttttcttttttttttttctttttttctcttgagacagagtctcgctgtgtcacccaggctggagtgcagtggtgcaatctcggctcactgcaacctctgcccctcaggatcaagcaattcccgtgcctcagcctcctgaatagctgggattacagatgtgtgccagcatgccctgctaatttttgtgtttttaatagagatagggtttcaccatgttggccaggctggtctcaaacttggcctcaagtgatccgtccgcatcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtgtggtctgacatgatctgtcttgttcatgcttatatactgaggacctagcacataaaagatcttattgaatcaattaattagtcctcctttgaaataaaatataaattacaatgtaagttctcactttttttaagataacagtttcttttaaaagcaaaagaaatcctattaaattccttcagaaccaattttgtgttaggtactgcccaccagaaccttatagcatagtgggagacagacacataaacaagaaggaagaaggtgtgtaagcaagaatgcctgggactgaggggagatatttttgtttgtcagagtcagagcactttttccgatgctgtttggataaaaaatcacaaagaacaatgcttgctgttgtggactacatgagaagacaaaagaggtaatgtaatgagtgttgcttcttacgtttaggatctagagtgtaacttgttaactatcggctgaattttaacatgattattttaggtgaaggtgttgcaaagtgttatatttaatttgtgtgatatttatatctccttgcagtaatccatattcaggatagcagtttggttaaatcagtgtcaagaactctcaattctagtaccagctgtaccagtaaccatgttacctttgttaaattatgcagccttcttggctccaatttatttcatctatgttagggataggagcaagtgtttttccaagttacatttagctgtattacccctctttttacttttctctttgctttagttctaagaagtaaatagagttgtgtaaatgtcttctttatgtatctttattttaagatgtaagtttctttactgtgtgcagtggtctcaaaatctgtggcaatactgtgctgtgacaatgtttattttcttgtttctggtaaattgttttatagtatagtatctttgttcctgttatttctcatgagatttttaacagtgcatacagaaattgctagaatggatggtctgactgatgagtactgcttgagagttgaccagaactctgaagaaatagtgtagtaggcctataatttgaataggtaggaatcgatgtctcataagtgtgtatggtggtggtaggggtggttggtaaagaatgagagggagaggtgagtgaaaaatgaaatgtttttaagcctaaatgcattaatatcttaaaaaattaattcctatgtagtcttaaaccattcttcttctctagtagaaaaagaagttttatgcttttcagtgtctttgcttctggttattttaccttagagttttataccagattatcttctgaggaggcctatcagaagctttaatgtagtggagagcatttgttttcttggtgttgggaggcagttttacctttgagtcattcatttcagacttaccattggggtagaatggtgttgacattagcaggagttggagaagataaaaattcttcatattccattttaatgctgaataagatcctgaagaatattcctggagaaagtatgaatgggatatagaaaaacgggtaaagacatgcattcaagtccaagcttgtgctgtgtaaaaattacttgttatcctgtacagtatgttgggcaaaaacaaagaacaacaataaaacaacaacaacaaaaaaattgcttgctgtctttgaacctcagtcttatcatctttcaaaatcagaataatgtctgtagtgtcttcctttccatggggaaattatttcacttctctgaacttaacattcatcggaaaattaactttagttgagtgcttgctgtgtagtagggtgtgccttattcatcagctttgcaggcattatttaattgttgcacccattctccaaggtccatgttgttccagcatttgcaagtaaggaaactaggaaactgaggtttaagaagttaagttgctgaagatcacacagctggtagtaggcaatatagctagatttgaacctacctgtattgtacttcaacactagtgctcttaagcactaccatgtcccatctctacaatgctagttttgaaaaagatactatctatggtccctttcaatcttgacctacctattaacacagtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaagaaaaaccaaaaagattaattaaataggactcttcagccatgttatcttataatgtttataggtatatattggggaaatgtggtttttgggaatttgtaattttctgttaagcagtcactaccattgtattctatatcaacatgcttttattttgatattgaagtttaaaaaagtgaatgacattatatctcatttttctttagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaaggtaatggaatttagaatttttggtttttaaaattaatgttggcattgtctcaataagggtatatagtaaagatttattttgcctcctgttccccatttaaaagatattttagatagaaattttgttttaaagtgaaattataataaatttttaaaaaggaatatgtaattcctgttctgaaataataggaatgcttattacttaggtattataaaaatttaacagatagcaaattcctataggacagagtccatacttaattttctgtatattccccataatagccctagcattgagaacttaatttaagggtgataaatatttttcaaatgattaaattatttcctaacttcagtcagattagatttaccactaatttctaaactattcaagattcattttggatataaaatatccaaaattataatccaaaatggctataatgtgactgatttatttctgtgactaattaagtttcatttctttatctacctatatttctagtgaatttaattcgctttcctctgactgagttagaactgtcataagaatctaataaatatactcctagatcatggggaagaacaaaaaataagaaagtaagagtaaaaaataaagtaaaacactttattatcccaactgctcttttcaaatgtttgttcgtttgaaatggcctgggtctcattatttcgcccaggctgtggtgcagtggtgcgatcatagctcactgtagccttgatcttccgggctcaagtgatcctcctgcctcagcctccaagtagctgggactataggcacacaccactgcatccaactcattttttttaatttttatttttaatagagacaagatcttgctatgttgctcaggctggtcccaagctcctacgttcaagcagtcctcccacctcagcctttcaaagtgctgggattacaagcatgagccgctgcacctggtcccaaattgttttttaaagcggttatacccatttgtgtacagaaatgtagttgataaggaagtggatcggtaggaagccttatatttgaagaagggtgccaaagtataactgttcctagtttagttaaaaaagtaaagaaggttgggcacagtggctcacgcatgtaatcccagcactttgggaggccaaagtgagaggattacttgtgaccaggagactgagaccagcttgggcaacatagtgagacctcagctctactaaaaataaaaataaatcagctgggcatagtggcctgcacatgtagtcccagcaactcaggaggctgagggaggaggatcgcttgagcccaggagggagaggctgcagtgagccatgattgtgccactgcactccagcctaggcgacagagcgagaccctatctcataaacaaaaaaaaaaaaattaagaaactggaatatgtatataggtaaatattagaggcagtatcacttatgatagtatttattttatgtactagattattactgttatagacaccacagctgtcatggttttagaattgaagttacttacagaactgaatgttatatgtataaaatgcataaagttaaggccttgaagtaggcaaatctgagttctaatcctgactgtcaaactttctagttttatagtcttggtttaagtggatcctactgatctacttccttttcaatagttaatatcagatgtcttaaatttatatctgttaagtattaaattctgtcttattgtggtctttatttgtgtgtctgtaattattgattgggttgaatttcaggtgaaaccactgacagagtatatagtacctgaattggatggcatctgctctatttttaaacaatccaatctctttataaataatcatatttttgcatataggcttcccatatgtagattattcttaaaatataattttcattcacaaattccttttccatcctaggtataaatggtattatgttttaaagtataagtgatttattctgttttgtttgccaccttcattagtttttttctgtcaaagtctatagtatatgtattcaggagcttccaaatagtatgttctcattaaaagaggtgttcttgtgacaaacagaagtcttgcatttgaagaaggaagccagaatacaactatttctagcttgagtgaaaaaagtaaagaagaaactggaataagtttacaggtaaatattagaggctctattatttatgacagtatttatctcatactttgggttattttgttatagacactgtacagatgccatgtgatttttaaactgaatttacttactggactaagcatcatatatataaaattatggtctgaagcttaagccttagagtagacagacttgagttctaatactgactctgccacttcttgagttccttatctgaaagacgaaggtaaaaccacctgtctcagagtttatgccatgcattttctgccatagcaccctgttcatttcctttatagcacttagggtttataattatatatttatttgtttgcttgtttattgtatgttacagaagaagcagattgcctcttctataaatttcttgatatccattcttaaattggctcatgttactgtctgggatgcttgccgaatttctttggtcaactcattcctccacaatgacaatttcagcttctccattctgcttaaacctctcatcttctcttctatgccgctgctttcagcctgcctcctacttggagaaaatagaaggcatagagaggaaatctcgccacatcccactctcaaacattgaaatctcctggcatctcctcctttaataatcttccgtcatgttacagaaacagtttatccttctatttgagactaattcttcctgtgctttgtttttttatctgctctttctcaggtgctttattttttaatatgctgttctccctctgaactatgttctgaacattttaaaacctctcctgtttaaaaattccctttctcacaaagacaaaataatttccctcttccctatgttctcttttaggtatcaccctctctcttccttcctctcacagacaaactttgtgaaagagttgtccatatttgctgtctgcatttcccccccttccatttattccagtaaaatagcacttgctaatgtctctcataaacttcatgttgctaagtctggtggtcacctttcattcttccttttccttaatgttttattaatacttcacatcatcaaccatgccttgcttgaactgtgttctgtttacctttttgatccactctcctgatttttctcctttcacttttgccttcttcataggctcctcctctctactgagtttttggaatatcgtgtgtgtactaagcactgtgctaagcatgggtactgaacttttctactctgaggacttgatttcacgttatgaatagaaacatttgagttggaactatagaattatgccaatataaatgaatttgtgtgtagaaaatatttcacagagcaagcaccatataggcagttcaattgcttgatcaattttctatgcagtatagttcctagttttttctattttattttttttatgttttcatttttatttaactgagattgttttaaacagaatatatcttttctgtgtaaattttacaacaaagatttcagtaaccaaactactttatccatatcaaattttaccaattccaatacagttttgtgctatttttcaaagaaaaatccacgacctttattcttaccaaattgagttttcaagagtcagactttgtaggactgtattttctaatgtacagtttttttgtttttttttccagacaggatctggctctgttgcccaggctggagtgcagtggtgcagtcataacacactgcaagctctgcctcccaggctcaagccatcctccaacctcagcctcacaagtagctgggactacaggcatgccccaccatctccagctaatttttgtagagatgggtttagccatgttgcccaggccgatcttgaattcctgagctcaagcagtctgcctgccttggctacccaaagtactgggattaaagatgtgagccactgcacccagcccatgtacagttttaggtgttgacaagattgtttggttttgtttgtgtgatttttttttttttatgtgatataagcctggtaggtcggtacttatttcttatctaattcatgaaattgtaggcaattcttctcgggtagactacagtcctcctgttgtctaggaccagtctactgtgttgctgatccaaatcattagtatatacagttgacccttgaacagtgtaagggttagaggtgctaaccccctgtgctattaaaaatcagggtaaaactaaattagtagtcaaaagttaactactaatagtctactgttgaccagaagccctaccgatgatataaacaacacaattttgtatatgtattatatactgtattcttaaataaagtagcttgagaaaagaaaatgttattgagaaaatgataaggaagagaaaatgcatttacagaactgtactgtgtttatcaataccgtaagtttatatcatctgtttacaaagaatcatctgtctgaaattgtaggcaaccactgctggttgatatgtactttaggcctcaatctacagaatgtatcaaacaattcacctttttcttgtaatggcatgacttttctctgcatcttggaagcacctccagccactgtggtgttaatcaaggcttatagtattgcagtaaacacagtgaaaaaatacatgagaacctggagagattacttttcatttctggatacaatttactagagaaatgaactgctcatgtggaaattattagtgtcacatggcattttaagcagatactcacaacacaataatgcttaccacagtagcaactgaggtagctgcaaaattattacaatagtacaatatgtacgatagttaatcttatgcaattatgatttaatactgcatctttacatttgtttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggattaaaaaaatgtttttggccaggcgtggtggcttgcgcctgtaatcccagcactttgggaggccgaggcgagcagatcacgaggtcaggaggtccagaccatcctggctaacacggtgaaaccccgtctctactaaaaatacaaaaaaaaaaaaaaaaaaaaaaattagccgggtgtggtggcgggtgcctgtaggcccagctacttgggaggctgaggcaggagaatggcgtgaacctgggaggcagaggttgcagtgagccgagatcgcgccactgcactccagcctgggcaatagagcgagactccatctcaaaaataaataaataaataaattttagagataaggtgtcaccctgttactgatgctggagtgcattagcgtgatcatagttcactgcagccttgacctccctggctcaagggcacctctcgcttcagccacccaagtagctggggctacaggtacacactaccatacccagctattttaaaaaaaaaaaaaaattgtagagacaggtcttggtttgttgtccaggctggtctcaaactcctgggctcaagtgatcctcctgcctcagcctcccaaagtgctgagattacaggcatgagccaccacacccagctgatattttgggattttaaatgatattgtgaactaaaatttgtctaagttaatttgtatctttgctgtttttttctctggttttctgttgatatctttgattacttaacttaaaaacaaaataactcctgtttaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcaggtaagaaatttgacttgatttttttttttttgcctctctcctcattctaaacaacaactgtttttctcttctatgaatataacaggagttgttttatatatatatatatatatatatatatatatatatatacacacacacacacacacacactatatatatatacataccatatatatagtgtgtatgtgtgtatatatatataaaaaaatatatagtagatgttgcaagctatagatagccctaaatccttcagtaagatagcaataagcagttaatgcacctaggcttgaattttactctcttattccattaggacaacttcaccccacccctaaatatttctaaaaacagaaatatgaaaagggttttcgaaatgagtatcatctcgcatagtttgttggactgaggcatgccaagaaaagtataggcattcctctttctacttcctgctacaaacattttagtcagtaagatagcacttatattggctggaggatccacaaaggactgcttatctttatttatgaaatattttcttttattaaaaaataatacggccaggcacggtggctcatgcctataatcctagcactttgggaggccaaggcgggtggatcgcctgagctcaggagtttgagaccagcctgggaaacacggtgaaaccctttctctactaaaatacaaaaaattagccaggcgtggcagcatgcgcctgtagtcccagctacttgggagcctgaggcaggagaattgctagaacacgggagacggaggttgcagtgagctgagatagcaccactgcactccagcctggacaacagagcgagactctgtctctaaaaaaataaataaaataaaaaaaataatatgcctactcagggctgggcacagtgtggtggctcacacctgtaatcccagcacttggagagctgaggcagatggatcacttgagatcaggagtttgagaccagccgggccaacatggtgaaactccatctctactaaaaatgcaaaaattagctgggtgtgctggagcatgcctgtaatccaagctactcgggaggctgaggcaggagaatgcttgaacttgggaagcagaggttgcagtgagccaagattgcaccactgcaccccagcctgggcgacagagtgagactctgtctcaaaaaaacaaaaaaaacactcagttacccaggaagataacatttataatctgtatataaggtcaccatgttttctgaatgaaaagccaagcacctaatctaataaaggatttcatatttatgtaaagttttttgataatgtaaaccctaaaaaattaattatgtttaagtatgttttgttgcctttgtagaaaaaaaaaattattggccgagcgcggtggctcatgcctataatcccagcactttggaaggctgaggagggtggatcacatgaggttaggaattcaagacaagcttgggcaacatggtgaaaccccatctctacaaaaaaatacaaaagttagctgggcaaggtagcatgcatctgtagtcccagctgcttgggaggctgaggtgaggggatcccttgagcccaggaggtggaggttgcagtgagccgagatcatgccactgcactccatcctaggcaacagagtgagactctgtctcaaaaaataataattattggaatgcctttcaaatatttcagactgtaagactgctataaaattagagatatatcctcatattttaaaaaccttttcctgtgcgagttgattcttgcttgcctctgtaaatcaatatatactattcttctccttcctcttgtatttcagctacacagacctctctgtgttttcttgtcaggccaagctgtttctatccaagggccttagatgtatcttctccttttcccccagttaccatgcgggtggcttcttttcattcggaccctagttaaataataatgtatcttcagagaggcctttcttgattacccattctataatagccatctagccattttgttttgttaccctgttttaattctctgcatgtcccttgttactttccaatacttatttattgtctgttcctccaaaccagcacataaattccatgagagtaaagacctgatctgacttgtccacttgtgaattccccttgtgcctagtgcctggcacataataggtatttattgaataaataaatgaaagtagagcatatttagaaccaggcagagtatctgagtaatttcctttttttctgcttaaagaatttaaatgactcataaaatttgtatttcttaccaaaaattctagaaatgcattttttagaatggagaaatgttaatttaaaaattttgtcctttggtgaagctatttatacatgtatatcttagggttctgtttttaagtatatttttttctttgacttatctcacagcaaagaagtagaaggaaccagttaccatgaatcattgtacaatgctctacaatctctaagagacagagaattctctacattttatgaaagtctcaaatatgccaggtattatgaaaagacaaagttactgtattttaacatttaatgtcatggcttcttttctgaaaacttgagaaacaattttaatgtaaggatttgcattgatgaagagataaagacttggtggctgtgatcagatgtttccttgtaattctctgccctccttcaaaacaaattgtttctgggattccaggttcattctttaccctgacccttcaagaaagttttggtgattccctctttgttctcttcctatacaagtatcctgagaattatatcttgtctcttttggtaattgtatggcatttagtgttctaatttataaaattgtaactcacggttaatacttacaaacttgttttgaggcacaaatgtgatgaggcatgaggaaataattataatggggtaaacaaatgcagcatttttaaagccgtagtgacttaataaatcctatgtttatcacagaaataaaatttactatcatttaagtgcctatgatatgctagccactgttagactcttttcatatgtattctctaatcatgacaataactatggatgtgaaaaaaggcttagagaagtccagtaacatgcccaaagttacacagctataagtgacagaactgcaatttagatctaggtctgtgtgattccaaggtttacagttgatccttgaaccacttggaggttaggagtgctgagcccctcctcctcacacatttgaaaatgtgagtattactttgactcctcaaaagcttaactactaatagcttactgttaaccagaagccttaccaataacataagcagtagattaacacatattttgtataagtattataataccatattcttacaataaagtaagctagagaaaagaaaatgttattgaaaattataaggaagagaacatatatttactagtaagtggaagtgggtcatcataaaggtcttcatccttgccaccttcatgttgagtaggataaggaggaagggttggtcttgctatctcaggggtggcaaggtgggagaaactctgagtgtaagtggaccatgcatttaaatttgtgttgttcaagggtcagttgtattttgtttccactgctattttgtattcactgttgcttgttagtattattagatcagtagcaaagcctatgatgagaactctttaacaacaaatttaaacatttatttccctgaaaacctcttctttattttcagagtgtcttttcttttttgctactagagtaaaagaagtggaagagatgtgtaagcgcagccttgagtctgtgtattcgctctatcccacacttagcaggttgcaggccattggagagctggaaagcattggggagcttttctcaaggtatgtaattcgtatgactttgttatcctaaagtgcagcttttctgttaccaatagtgactttaaaaaataaaaactataggccgggcacggtggctcatgcctgtaatcctagcactttagaaggctgaagtgggtggatcacttgaggtcaggagttcaagaccagcctggccaacatggtgaaaccctatctctactaaaaatacaaaaattagccaggtatggtggtgggcgcctgtaatctcagctattcaggaggctgaggcaggaaaattgcttgaacccagcacaacaggcagaggttgtggtgagccgagattgcgccatggattccagcctgggcaacagagcgagactctgtctcaaaaaaaaaaaaaactatgtagagaccaaatgtgtgtgtttctttccttttatcaagatataagttgattagccctagtgaattgtgcttttattaaacattttccaaaatagtcattgtaaaaatttaagttttaaaaattcagcttaagtgtgcttttctctttataactttttccctggcctaccaagataaaattgtttcctcatgtttttgcatagcatgataacactccattcagttttagcactacattgtattactgtcattttatctctgccttgctaaactagaagctcccttaaaagtgggaaccattctattgtttattgttgtatacctagtgtttttgttttgttttcttttttttctttttatgtttttttgagaccaagtctcgctctgttgcccaggctggagtgtcatggtataatctcagctcactgcagtctccacctcccaggttcaagcgattctcctgcctcagcctcccgagtagctgggattataggtgccccgacaatgcctggctaatttttctacttttaatagagacggggtttcgccttgttggtcagcctggcctcgaactcctgacctcaggtgatccacccgcttcagcctcccaaagtgctgggattgcaggcgttagccaccatgcccggcccccaatgttttctcttctggtgactgataattatgtttagtaaacattcagtggatagtggatgtcagttaatttgtaaaaggtgttcagaaggaattgcttcttataatggtgagagggaaatgatccagggattttggaagatgaaatagtatagttactcaggatgctgtagatctaaattctttccttttatcaagatataagttgattagccctagagaattgtgcttttattaaacattttccaaaatagtcactgtaaaaattcaagtttaaaaaattcagcttaaaagtgcttttctctttataactttttccctggcccacccagataaaattgtttcctcatgtttttgcacagcatgttacactccattcggttttagcactgcattgcattactgtcattttatctctgccttgctactagataaaagaagtggaagagttgtgtaagggcagccttgagtctggcaggatgacaaagtaaagtgttttgggtcctcagtttcctcatttctaaagtcagggatttgtattcgatggtctctaaagccccttttagccctgctattttgaattactattattattatacgagggaagaaagaggatataaatgactaaggtcactctacctttatgcaaaaataaaatttggaatatgttttggaagtagaaaagagaaggaaattttagagtcagaagaaaataataatagttttttcaaaatgacatagcagaagacatacatattaatgtggcttaggaggaaaataaaggaacaaaagtcttttctgctttcattcataagtacattggcagtacttactgccagaaatcaagaaatttttcctctgaatgaaagattatcctgctgaaaagagtacagaattctttaagaaacagtgaatagaatggtagtaaccagaggcagggaagggtgttgtggagggagaggatgaagaggggctggttaatgagtgaaaaaacacaggtaaatagaagaaataagatctagtgtttgatagcacaatagggcaactgtagttaacagtaatttactgtatatttttaaatagctacaaaagaagatttggaatgtttccaacacaaatgataaatgtttgagatcatggatatctcaattacccaaatttgatcattacacattgtatgcttgtatcaaaatatcacacgtacctcataaatatgtacaactattatgtatccataaaaattaaaaataaattttaaaaagaaacacctaaagaataatctggctgtttctttggtagagaaataggaagaagagaagcagagggaaggttggatgaactggtgcacaaatgcttatgctctcagattacattccattcatatacatcaaccaaaacattaaataataacaaactaaatgcagaagcagagataagaattcatctcgttctgttaatccagacattaaagagatttgcaaaaatgcaaaacagtgccatgctcactaagttttgttttgttttgggaagtatacagttgaaattctttatctacaggtttccatctatggattcaaccaaccgcagatcaaaaatatttgaaaaaaaaattttaaagaatagggtataacacttatttacatagcatttacattatagtaggtataatatgtaattagagatttatgtataacctgtgcacattctcctattacacgtaatctagaggttatgtgtaatactttttggaaatgtttaataaaagcacaatctagaggttacgtgtaataggaaaatgccctgccattttaaataagggactttgaacatcagcattatcaaggtgtcttggaaccaattttctgcagatacagagaaactactgtagttatttttcctaaaaattgttatttatgatatatagtagatttattatttttgaataaattaatacattttagatttttctcagtctttctaatatgatatcatatctaatatcagtagatatggtccaacgatcgaaagttctttggggtcttcaataatttgtttgattgtaaaggagttccgcaaaaagtttgagacctgctgtggtagggtcatttagagaggaattgaagttttggttcctagcatttttgttactgttccttccctatcaagcaactaaaagagctttcatttcttagtcatcactttgtcatcttactctccctgcttcctctttcttatttctttcaataaatgtccctgaaggattgggtagtatttcatagttcagttatttgggaaggatactattcatataaactaattgtgcaatatgccttttctgttcctttaataatgttggtaaatgaaacctttgccagatgccagcttttccttcactggattgtgatttttttgacagctataattatgcatcaagtcatccccagtagggggtccctcatttccttgctgacatgtcctcattactacaggcagtattgaagcaggactaaagatggaggcattctttatgataggtctgatgaatatgttcttgtttcagaagagtatttagaagggctgctttttgtaatgtcagagtattaaaaattttttttgatgtttgtcatctgtgacctctctgctaataactcttaagagctctgaccgcatagcattttgtagttttctaaattttgatccatatgtaggattatttacaagttctagtcttgtcactacaaaagttcctttgtattattataatattatatcgtaagttccagaacttacatagtttttttttttttttttttcatttctcttgcttacatgaactctatgtcgtggcattcagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcaggtaaatacaatttaaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtcattttcatttcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcggtttgttttttttattggctggattagtgttttactgttatttaaaaaaacacaaatgtactttaaaatatttttaataacaattttattagagccttgaaattagtaatttattaacaagatattgtaaaactagtcttgaaaattaatttgtaaatgaagtttagaaactttttcctatatatcacaattctatcagtccatcatgtggtcgattcatttaatatatcccagtattaagcctttaacttcctatagaattcaagaaaggtatgtgggaaatgaatgaaatagctactctaaatttgaaatgacaagtgaaaaaagggaagaggaaatgaatgagagaactaaattagaaaataaaagcaagttgggacaattaggttgtcaatccaaatgctttgaaaatatcacatctaatattttatctaacattacctgttggtttttgcaaacttatgttgctacttcagctgtaaacccagcatacacactggataaagtagaggcattggtgtccccaaggtttgtctacagtggtgtcccacagacatgtacctgcttagtgaatatcagctcactgtgctttattatttatttatttatttattttttgagacggagtcttgctctgtcacccaggctggagtgcagtggtacgacatcggctcaccgcaacctccacctccctggttcaagcaattcccctgcctcagcctcccttgtagctgggattacaggcacatgccaccatgcccagctaatttttttgtatttttagtagagatggggtttcaccatgttggcaagactggtctcgaactcctgagctcaggcaatctacccgccttgtcctctgaaagtgctgggattacaggcgtgagccaccacgcccggcctttactgtactttttgatgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctatctagaaaaggtaagatttttggagcaacccttaagatagttacttagcatgaatatgcttcatcttttcatcaagatcaatatatttccaaagcaaataaaagtatggttttatttttctatatattattactgttgtagctctgtatagtctctagggtggagtgaaacattgttacaaaacaaagcagccaattttgaaagtaagcccaagtatagtatctcttcttcctccttcctacctccactaccagctaccctttcagcaggttgcttctgatcatttcttcatttatgcatctacaaaaataactgattaagaataggcaagtcagcccttgctcttcattagcccagccacccacaagtaaaggcttcaatatactagcccctttgactttcctgtttctccctcttattcctttagattcactaattttggaaatagttacctcactaaataagtgtaacatgaaacacatgatgcgattgtctttcttttcttttcttttctttgagatgaagtctctctctgtcgcccaagctggagtgcagtggcgcaatctcggctcactgcaacctctgcctcctgggttcaagcgattctcctgcctcagcttcccaagtagctgggactacaggagtgtgccaccacacccggctaatattttttatttttagtagagacggtttcgccacattggccagtctggtctcgaactcctgacctcaagtgatccacctgcctcggcctcccaaagtgctggcattacaggcttgagccaccacacccagcctgattgtctttaaattttataaagttctctgtttttgcagagttctttacaagtattagctgtctgggttatttctacactgtcaaagttgttttgaaaagtcaagaaaataccatagttcagggctgtccaatcttttggcttccctgggccacattgcaagaagaattgccttgggccacacataaaatatactaacattaatgatagctaatgagcttaaaaaaaatcacaaaagaaatctcataatgttttaagaaaatgtacgaatttgtgttgggccacattcaaagccgtcctgggccacatgcggcccatgggccgtgggttggacaagtttgcaatagttcatataatttagctagcttttatatgtatataagttaaattttagtgtattaccttaatttgagtgattctttagatgtatttagtatttgtaaatataatttaaattggttgtgttttcttgaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtttttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtcttggtcctactgtagttaatcacaaattagtatgtaagatattgacgtgttcttttgtgaataattcatgctctgcttctaagttcattgtggagaatatagatattagctttctgttttgcttttttggtttgtttgttggtatcatagtggaaaaggagatagatattgaaattaattacaaaagttacctattttgatgtaattaaatccctttatttaagcctgtcttgaatctgtatattttagtgtaagcagaggtgtaagttagctaaatagcttggggagagtcccctttgtcctttgatgcttaggaaggtgtgtgaattgcacagttaagacaaaagtaagtttattccctttataatccttagaagtttgcttttttccctgggataaaaacccaacttttttcattaaatgttgtatatcatgtgtgattttgtagttctgttaaagttcatggcttttgtgttttaccttaattattctatgcaagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaaggcaagtgttactcagcccaatattctaccctgtgcttgaaaaacttagacataagccccttgatgtcaggaatcgtgtatacctctttgtattcctagcacttggtccagtgctctacacataagtagcattttgtagttttctaaactttgatccatatttaggattatttacaagttctagtcttgtttctacaaaagttcctttgtattatataagctgacaagctgtaaatgatgcaagtttgtgtggaggtgatagaatttagcttggtcctatgtctttgcagttaccataggagagggtctagaatggggcattagattggaggatttagaaagcagttaaagatgatgtgatcacaggtgggttttccccctgctgcagaaatatgggatttttacaataaattacttttgtaagtagagaaaatatatttttcagaaaatgtcaagacagcagtattgtataagtttttctttgaaaaccttagattatagtgatgacacctaatattaaatttaagttgacaagctatatattgttagtcaatttgaaggttagagataaaatgtttctcctgcaggaaaataataagactcataatagatacagtcaatctctgctgtagtatacactaaatattacttttggcctatggggaaaagcaattacttcattttattgtacactgacttctcaggaatcaagatcacagtcacactcagatcacatttgtcttccttagattttttggaatataaacagtaccaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcagcattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataattacaagctgctatataatctttggttttgtgactagtctctaagtatgcttctaagtatctccccatactttaataattgtatttttttctattcagaatcatatcttcaagtttaaattcttattacttgaaaacgaatgggacttcacatattgtttctctaagcaaacaaaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgtttatacttttattaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaaggtgagccttcccttctctggcttagcccttagagttttagtgatgaaaatttttagttcatattttctttctgctttatttgggattttgtctttattttgaatacttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtatttattaatgttaattatagttaggtgtttcttatagtcaactgaagtattttttccttttttttctactcaacaatatgtcacagaaatctttctcattttttaacagctgcattgtgtgtatgtatgtagttttttatacaagtccttatcgatgggcatttgtgttgttttcagtcttttgctgctacaaacaacgctgtattgtagtgaataaccttgaacatacaaatttcatacatgcgcaggcaaatttgtagcatggatttccaaaagttggattgctgggttagaggatacatgcatctgtaatctggtacatattgccaaattactctcaatgggagtgtacccacttacatttcctctagctatttgcctgagaagacaatcctcagtcacattctatgagctgatcatctttgactcttatattaattattcatttaaccagtttagaaataacaataaatccttattttgaagggcctattttccataggtttgtcttttgtgatttcattcctgtacctcatttttaaactttctccttctataaatgttgtaacagggactatgggtgacatgtgcttttttatatatttctagttttccactatgaacgtgttttatttttaaaataatggctaaattaaaagccctaaataggggagtgaagaagaataaattagatctaccctccaaaatgctgcttgagttaggctattgtaataaaaagcagaacttggttttgagcttcttaactgctttcagagactaaatataaaacttattggttgggagaggggcatactgttcattaaggaaagcacaattttttccgtagccttcaagtttgtgagaaatttgtgacatggaaccttctgcaataataactaacataatagatgttttccattagcagtttaaaaagctaattaatcctcgatgaatgcaaaaagcaaaagttgctctataaaggctactctgtagagggatttctttgatgtggttaagatcattggtactcaagctttagcagacatcatagtcacttagagagtttgttaaaaacacagatttctgatccccattcttagaatttctaattcagcaagattagggtagaacctgtgaatgtgcgtttctagcaagataccagttatgttgatgctgcactggtccagggacaacactttgagacccaccagtctacttgttctaccatctattgacctgacttcattttagaacaaagttgatgatctattagctatctcctatctgacagataatgtagagattgctaagaagtttttagagactagatattctgtaatgtgaatgaaaggaaattgtttatgctctaaataccaaacttttagatgacaaagataataggtgaagaattgggttacaaaagtatgggctataggagcacctcctgaactctcagaaagtagctaagatttccaagcagatacacaattgaacctccaaagttcattgctgtaaagcacaaaaaagcaaatgcctgacctagaatatcttgaaagcagaaattactgaactttcatctctaccttatgactttttcaacagctagttttcacacaaaactattttaccatataagttattccattaagatttctagccgggcatggtggcccacgcctgtaatcccagtacttcaggaggccgaggtgggcggatcacttgaggccaggagtttgagaccagcctggccaacatggccaaaccccatctctactaaaaatacaaaaaaattagccaggcgtggtggcacatgcctctagtctcagctacttgggaggctgaggtgagagaatcacttaaacccggatggcagaggttgcagttgagccgagatcacaccactgcactccagcctgggtgacagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacacagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggacaacagagcaagaacttgtcttaaaaaaaaaaaagtggggttggggggtaacccagataattaattatttaatgttatacatctcaatattaaagtaaaacctgtaaacacaacagtttaggtttgactatttcttagaattacgacaataagccagtaatgttattttgagattactccaagaatgtgaaagttgtgtcatcattatgttaaactaagtgttcttgcctttagttaaggttccctagactacagcgaagtagtctacccagtccagtcatctgtagagtcattcccaatcctgagattcaggtcttctgtggtcattgtgtcaacaagagcatacattgactacctggaactagatcttggtatacaaaccttgtgtcattgtgcaacctcaaaaggagagacttgtatattgaggcatgccagatatctcttgtcagagagaatcagatggaaatgaagacagttcttattgtgtatgttgatagctcagacatagcccttaacattaaccagaattagggtggctggccccatttttctccaccaaaactatgcattgttacaaagtatactgaacaagtctaaaatcttaggtgtcagaggatttgttttctaaaaggcaagtctctaataaacaatatttaagtgctgaaaggagctttgcacttaacctgatcatcctgccttgtgccaataaataatttttattccttgtcatgcatatttcagagcatctatctcagtcatggttctggggagagaagccataatatcttaagacattcactgaatataatgaattaacttcatttctgtgtatctaggatgatatcagctgtgtactttcagagaactgagaaaatagtcatcagtccttttttgtggtattcacacaaaatacccagatacccagttgaaatcttccagagagtctttagtaccagagaaaacactgtcatttgctttttgaaattcaaattcagctctttctccaacaaccaacatcacagttgagactctaagctgaggtagaaaaaagccaacccattcctttctgtatcaatctctcaacaaaaaataagggtttgattccccctccccgccccagagctagatattgatagagagtaatcaatgtaaaagagactttagacagagtacactacactgcaagaatgttaatgtgatcaagcatcaggggtcacagctaactcaaagacagcaggggagagggcatgtagaatacttattaggcaggaagggaaatcagaaaggccatgagatcattcatttgtttattcaataaatgtgaatttatatacctacgttgggttagatactctactgagtgctaggtctatagaagtagtaaaacattgccctagtccttaaggtgttcacattctaatagggaaaataaacataataaacataattataatgcaaagtgtattgttagagatggtaccaccttcacttggttgctcagactgaaacctagaggctttattttctttttacttttattattatggaaaatttcaaacatacaaaaggagacaataacatcatgaacccccttgtacttgtcactcagtttcagcagttaccaactcatggacaattttgttccatttctctttccaccaacttccttccaatattattttaaagcaagatgtcatatcatttcatctgtaaacatttcagtgtgtagatctgtaagataatgtctgttttaaaaaaccattctcacaatactgtcatcactcctaaaacaattcacaaaaattcctaaatgtcaccaagtaatgggagtcattttaaactcttgtttctctcttctcaagtcttgtctattccatcagcaagtcctattggtcaacttccaggcaggtcactttaccacccctgctattaccaccctacttctgcagtcacatctctgtagatactagagtttaaaccaacagtttacttctgctcttggttttccaaagctagttttattaataactgttagagtgatccttttaaaattgtctaagacagagtactcttattcggtatctgtgggggattgtttccagagccccctgtggatactaaaatcaagtcccttatatacagtggtgtatgaagcatttgcctataacctatgaacctcctcccatgtactgtaaatcatctctgggttacttaaaataccttatatagtgtaaatgctgtgtaaatagttgtactgtattggtttttaaaatttttattttttattgtattgtttttattgaggtttttttggtgaatatttttgatccacagttggttgaatctgcagctgcagagggccagctgtattccattttcctgttcagaaccccacatgagttcacattatccctgaatgacaattctctaagttaagtgatctgcctctgctgttctccctccagccttatctaccactctcctcacactcctctcactttctgcttgtatagatgagtcatctccacctgacttacctggtcttttgcaattgcttagacacaccaatttgtttctgcctcagggcttttctgcttctgcctgcaatgcttttccctcagatcttcacaccagtcactcccttacttcattcaggcttctgctgcagtgttaccctcagaaaggcctccgaccatgttgccattacccactttctctcttttttaaacttaagttttgttctcttatacttattatctaatattatgaaatgtttattaggatatatgttcctcaccagaatgaaactttatgagggcatagtcttcatctgcctttttcccactctgttctcagtgccctagccctgtgtgtaacatgtaatacgcccccaacaaataaatgttaataaattaatcaaatgcttccttaagacacaaaacagttcaacatatgtgagaaacttaaaatttaaaaatgtatagaactaaagacaccataaggacgagtgaccagctgagaaaacgaatataataatgttaattagaacaaaaaggatcattttaatataaagaacaagggatttatatgaagaatacaatgatattcaacttttctagtaatctggaaaatacaaattaaaaccacagtgaaatactattaccctcagattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctgggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatggaaatgtggaaacaatgtaaatgttaatatgcagattggataactgttgtatttatgtagtatatagctgttaaaatgaatgatgtagagttaaatatgctcacatagttaggataaaatagtattgaataaaaaaccaaattacagaaatatacatatagtatcctaatttttttacttaatacttacaactatttgtgtacatatagctttgaaataaaaatataccaaaaaatacaagaacatgataaaccagctaacagtcatcttgatggtgggagggacttagggtcagtgaagcacacaagggggagcttcatctcttccccagcaaatgtgagaaaatcctagatttgataaagctgtttaatggataaaagggtatctgttaatatcattttctatactttatgtatgtttataatataattttaaaaaactttcctagtaaagttgcttattttatatttaggagtacattttctctctgtgaagataataagactaaagcaagagtacatgtaatttcaataatgaagttacactaaaattgagaccacattcatgggtaataatttccaagtgaaactccccaaatttaattgatactaaaattttaaggaaagcagttaattcctctcctaactggacaaactaagtatggattaatgacagatgacggtgagtatagttaacaggagtgacctctcagagaatcgtggggattgagtgatgggcaggctctcaaacatctaggcagcaggctggaaaattatattctttgagcttaagtttatttccgattggtttcctccaaggagctttgtcttctatggacagagaaatattaatacaacttgaaaaaaaatgctttgcactgactctgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatagaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggccagcctgggcaacagagcaagaccccatctctaaaaaacaaacacagtaaacaacaacaacaacaagattatgaagtaattttttatgaaactgatatagaaaaccttctgagacatttacaatgtcacattggccatctagtctgatattcattcgctgaatcagcaacatttattgtatgttttctgtctaccaggtactgtgctgacttaagacttcacaaatatcaaatattacgactaatcatcataatccttatcctcattttaaaatgagaagttcagagaacttgcccaaggccagtgagctaataaacagagcaaggatttgagccttgtctaaatccaaaatccatttattgttcattttattgtgctttctgtgacatgttttttaaaatgtgtgataagtgctataggtgttgtgatggaagtctgtacagggcacacagggtacagtgtaggtatggaggaggaagtgcttagttctgcctggggtggggagaatagacagaagtagatccaagaaatgcttcacagaggaaaaggtgtgtgagccgagttttgtaaatgagttgtttttccaggcagaaggagcatataagcaaaggagaggagacatgagcaggaaaagacaacataagcataggcttagtgtttgaggaagaaaagatgagattggagcagtaattgttggtcaaaagatggagtgttgctttatgaaatgcaaaggagtttgcaccttatgctataggcctcataagaccctaaaggatagtaatatcagacttgcattttagaaagaaattccgacggcactgtgggttctatttttgagaatgcaaactggaggcatgagatggtctgaactgagatgaacagcagtaggaagggagaatcgtgggtagagatgagaaatatgaaggaggcagaattcataggatttgattgctgattaaaaataaggttggggggcgggtgtggtagcgcatgcctgtaatcccagcacttaaggataccaaggcaggaggattgcttgagcccaggagtttaagaccagcctgggaaacatagtgagaccacatctctacaaaaaataaaaagtcagccaggtaatggtggcacatgcctgtaatcccagctactcaagaggctgaggtgagaggattgcttgagcccaggggccaaaattgcagtgagctgtgatcacacccctgcactccagtccaggtgacagagaccctgtcaccctgtctccaaaaaaaaaaaatgttggagaaaaggagtagccagtgcctcccagttttctgtttggggcagctgggtagatggtgaagctctttactgcattgaagaatagaagaggtgactaaagtttgccagagatgaagtatttgaatttggaagtgatccaagtgaagatgctgaatgggcagcttgagaagcacattaagctaaagcttaataaagatatctgggccaaacagatttagaaatcatcagcacatagatggaagggagttgaagtcggtaagctttgcttcaggtagtattttatggcaagaagatgttggaggatagagatctgagtcatatcagctgccatctatgagggattcttctgttctttctcttttcctgttttctattgcaacccaatgctgtgatgccacctgaggttatctggaactacttaggcatttctgtgtttatttctgcttaagagtacaggattattcaaattagaatttaatcaaaacaagtaacagtcactgtaggtgtgcttcctcccccaacaattaatatggaaatcctaaagggattatcacttgtaattaattgcttccctgtccagactgttagcttcttgtaggtaatgtatcctgttcatctttattgcccctatatctgtcatatttttatataaaaatgtgtatattagtttaattgaacacaatattgaaaaataattatatatattctctatttaaaggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattggtaatcttcttgtacatatagtagattgagcactttgttgtttggcaggttttatttttgtttgattcagcactttttctacattctgagttgcagggggatgatagtgatgatgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatcactaatctgatacaactagtttataaacaagaaagtaggcctagttaatgacagagcaagccagacacccagtcattctgattccctacccagtgtgtttttttgtaatgccatgtgatttctcccattagtgcatgtcatcatctgtcttaaatacagaaatgcagttttttggggggatacacacctggtgaaatgaattaatgattaatttgtgttaaatataattcatcaaggagaagaaagtttcactgaagagtgaagagtttatccatagacttctcattttataagtatgttcaataaaaatttgagtacatataatgcacagctttgacccaggtaaataatgggtctcaactttagccacaataattttttaagtactaatattttaaaatgtgtgcctattagtaaagagaaaatttttttagcaaatcatctaggatttgtaaaatgcaatatgcattaaaatagctggcaagatttgagttaaactcaacatggccggttatgcacatcatttaagtaggctaaaaatcctaaactacttaaagattataccaagtcagtggtcttaattgaaattatggctatatattagaaagagatggaatcagtgatttcagattgtttgtttcttttttctccagttggttacatacttggacttggtgatagacatgtacagaatatcttgataaatgagcagtcagcagaacttgtacatatagatctaggtaagtaataaaatctatgtatctattctttttagtaaatatttggtcatcatggaatgttgtttgcctaccaagatattacaaatataagagacagataaattgaagcagtaaatattgggtttttttgttttcagcataaacagttgtcctagaagaaacagttaactctgcctggggtactgagtgaaacttaatagatgaggtgtcttttgagcctggtcttcaagaaagaaagaaagcataattcagacagaagatagagcagattcaaaagaaggaatcagggctattccaccaaaacaaggagtaattttaagatgtagcatgttgtgggagtggtgagacattaaatgtgtctggagtgaagtaagcctgtagttgagtcgcttgagagagagattggtactagactgtaaaaagccaggctaaggagtttcaacttcattgcattaaactataggaaataaatgaaggacatgataatattttattttcagaaatataatttcaggagcactttggggagtggtattggcagcaggaagaaaaattaagggatattgtaatagtttagatgagaaatgatgaagatttatactaaagttgtagaaaccagaatattggatttgagggacatttttgtagtaaactgtaccagtgatattagatgaggaaatagtgggggagtggggcccccagataactgaagcttctaactaaggaatatatcaagttttgtaaatagtaagaaagtgatgaatttagttttgctcattattttgaagtattaatggaatttctaggtggaatagacagtttaatatataagaaagaaagaatatatagcttctatgtatatatatagacagtttaatataaaagaaagagaatatatatagctaaggaatatatcaagttttgtaaataataagaaagtgatgaatttagttttgctcattattttgaagtattaatgggatttctaggtggaatagacagtttaatatataagaaagaaagaatatgtagcttctatgtatatatatagacagtttaatatataagaaagaaagaatatatatagctaagaaatatatcaagttttgtaaataataagaaagtgatgaatttagttttgctcattattttgaagtattaatgggatttctaggtggaatagacagtttaatatataagaaagaagtgtgaatgtaatgtaaagaagtgtgaatgtaatgacaaacttctattaaacagtattaatcactaggtgataatttttagaggttatatgcaaaagaacaaaaataattaaaggaaataagttatcacaggtttcattattttccaaagaaattctcagaaaataatatattgagaggagagaaaatatgccatattcactataaaacaaagaagaaaaccctgtctttttattatttattgaagtaggagaattctcttctgcataagttataaaaaggtagatgctaagaatcaggatgaatatgaaacatatgatttaataatgaagctggtttggttactaaccacatcatcactattatccccctgcaactcagaatgtagaaaaagaagtgtgaatgtaatgacggagatccagaatcttcagcaaatagatttcagttgaagtcactgggctggaggaggttctgatctcacacatcatccgtgataaagagacctaaagatgaaatcataagggaagtgagccttggaaaggctgagccagaaaaaaactgagaagtactcaaaggaagtcaggatcttggaaggcaagaggggaaaatcttttatgaaagaagtagtgctcaatagtatctgatacagaaaggtcagagaggatgaatgctgaaaatagacctttgaatttaacaagtaatcaatcctagaggccttggaagtcccctttggatagaatggaggaaaccatactgtaaaaaggcaaggactgaatggaagttaaggatgtgtagattaagaatgtggaatctgccaggcgcggtggatcacacctgtaatcccaacactttgggaggccaaggcaggtggatcacgaggtcaggagattgagaccatcctggccaacatggtgaaaccccatctctactaaaatacaaaaaattagccgggcgaggtggtgggcacctgtagtcccagctacttgggaggctgaggcaggagaatcacttgaacccaggaagcagaggttgcagtgagctaagatcatgccactgcacttcagcctgggcggcagagcaagactgtctcaaaaaaaaagaatgtggaatcttcctacaagaagtttagaagggaagggaaggatggcagagaaatttgctgcaggaatgagagacacatttggtccttgcttttttaagataggagaggtttaaacctgttagatattgaagatacaggagaaaaacaaaagataattgaaatagcaagggaaatcataaagtacgtgagtctgatagcattggctttagattggaggcatgttagcttttctgctgagagagaaggaaaagtgatgccaataggaaagtcttaagctggagaggaaggagtatgagggaattatatttgctattgtgtttttgctgagaaatagaaagcatgctcatttgctaagaattggagggatggtaactggccttaaaagaacaaataaaattctaaaatttaccatggaaatgagaccaagacctgactagaaagggataaataaataagacatgccaagcagtttaaggggcactttcaatcctaaatttgtagtggagccaatagggttgttgtatgattttccagcagtcctcaacatccttggagcttaagttgtagtttaaaatgggagatgtggtggagggacaaggggacaaggagatttgaagcactgatgagagtaatcaaacttattgtctctacccctgggctgagttagggaaagaagagggctaataaactagaaatctcagtcaaatttgaagactgtttagtaagaataaggggtagaaggagaagaggttttgattagaatgtacaatttacaatgtctaagaagcagttttagcagactcatttctggagtacaacccatatgagtggttcattaagatagaatgaaattgaattccattagaacagagacagtcacggatattatatggttttccccagaatgaattctagagttgggacagaggggaagattgtgagctaggtccatgccaacattcagcgaatgtgagagaaaaccttacaggtttacagagtaaacgtgaagatggaagggatttgttagagctagaaggtggggatctcaacagaggagccagactttatctgagaatgaaaggagagtggtctggaagatgcaaattagaggtaggagtatgccaacctgagtccattcaggtcgtgctaaaagcatctataaatgagaagggtaaattggtacaacccctttggaatattgtttggcattatccactaaagctgactttatgtatatcctgtgacccatcaattccactccaacacaaatgcatacatatgtataaaaatgtttatagtagcattattcataatagcccctaactggaaacaatccagatatccatcataggtagaatggatgaacaaattgtcgtatatttatattctctttgtatataatgagattgaatgaataataacacacaatatagaagactctcacaaatataatgctaagtgaaagattccaacataaaagagtacacatgtataattccatttacataaaattcaaaagctgataaaattaatgtatagtgttagaaatcaggatagtggtgaccctttgaaagaggtgattagtgactggtaggagggactgaaagggggcctctggaatgctggtagagttctgttaacgtggatttgttcactttgcagaaatcccagtgagtcacacttgggtgatttgtatactattctgtgtatgtctgtttggttacctgttgctgcataacaaaccaccccaaaatttagtagcttaaaatcacaatttatttattattatctctcatagtctgttgactgggctcagctggacagttttcacttaggatctctcatgcagctgcagttagcatctggggctggagttatcttaagactcagctgggccagagttcatgattgcttcttcacttacatgtctgatgcttcagcactcccatgtggcctctctgtccacaatagtgtcctggacctactcagcatcttggggctccaaggggaaggaagtggaagttaagggctaggcctgcaacttgcacagtatcacttccatcacattatgtcatcacatagtcatgtcatagggtccatcctggttcttccctgtttctgggactccagtaaccctatgttaggcctttgcaatgtatcatttatactgttacctgctagtctatattttctaacctttttttccttttttctgactcactccttggtgtcagtggacatatccggggaacctggactttcagccctactcagctatagcaagccctttccctattgagtgtcagtggaggccaattggggaatctagtcttctgcccttacctagcagtaacaaggtggtgactcccaaaggcattaaaggcagaagtttaaggaagatcctgagtctcgtaataactaaaaggtgtaggtgtcaattgaaaatcattaggcatacctggaaccaggaaaatctcaactttaatgaaaaatggccacctgtaggtgccaacactgagatgacaatgatgttggaattatctaagattttaaagcagccatcataaaaacactgaaggaacaattacaaacatgcttgaaacaaattaaaatatagtaagtctcagcacagaaataagtagtctcagtatagaagtagatataaaggagaaccagatggaaattttagaacagaaaaatatagtaaataaaataaaaaatttcaactgcagaatgaggagacagaagaaattatcagtgaatagaagacagagccgtagaaattacccaagctgagcaacagaggaagaaaattaagaggaaaccttcagcatctagggctaaacagagttcctagacttgataccaaaagaacaatctttaagaactctcaaaacttaacaacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcataagggatgatcttttctgtatgatttcttacaactcgaagtgaacatataattatctcataaaatgtcattaattttttttttttgatggagtttcactcttgtcgcccaggctggagtgcaatggcacgatctcagctccatgtatccttcacctcccaggttcaagtgattctcctgtctcagcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagacagtgacaaagatgaggaaggcagccagagcagaagtaaactactgtacatactagtgttcatagaacgtaggtaacatgtggtttcttgcctttgtaaagttcacattctaactggaaagaaagtaaattagctgtcaaacctcctaacttcactgtattctttactttaggtgttgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctgctcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaaatgccttcagcccccttgagtttcttggaatgttagagcattgtaagtagtctctagttttcaattcataaatcaattctttgacatttagatattccatatggtattattattttcagaatggtttccattagggtttaagaaaaatcagaaatttatatctcctttttccctgctcaggttcagaactaattagtcagacaaatggagatcaaattgtcagcatcattactagaggaacatggcttaggaatgagggccagactagtttactgctggtgctacctcagtacctctctgctgtcttaactttgggacagctcacctgaatagggtttgggcctgcagagcaaacacatgtaatcaggatcactgccttgtcttgatccagggcagaaaaaaggaagtcaaacaaatttcagtgtctgtgctgttagtacctatgccagtcattcaccaatctggtaagggtatgtgagacaagaaatcaggagtgtggcctccccagggaagcatggcaggtagagtgcagtatgggcttgccacttttccactactcagcttttcttcctttaacctgatttatgttggactggctgcatgttagtattacttttactgcatttaaaaaacattgatgctgatcaaattcaaaccaggtttctagagatggggcaggaatatgtgcatttttaaaaatctctcctactgttcaactaggatatgagaactgtcttaattcattggcattaaccattaagcctgtggtcaataagggtggggctttatcccttggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtttggccaacatggtgaaaccccgtctctaataaaaatgcaaaaattagctgggcgtgatggcgggcacctgtaatcccagctactcaggaggctgaggcaggagaatcgcttgaacccaggaggtggaggttgtagtgagctgaaattgcaccattgccctccagcctgggcgacaagagcaagactctgtctgtcttaaaaaaaaaaaaaaaaaaaagcccaaacttttcaaattaaagagtcaaagcagcttaacatattctttagtattttactctacctagtttcagtcagaagggatttttatgctaaggtggatttgggagtttcttccagtacttgtatcctacctaacactcaccagaagaaggtagttcttttagggcctcagaaatcttactagtttaatgccaaactgcttatggacttcactttttagagtagtaggagatcaaatgagagaagtgacagtggccagatcctttgccattgtaaggactttggatttcctttgagtgagggttttgagtctgaaaagtgatttgcatctccacctacaataactgtcacctttaaacacaccctccgggaggaggagccaagatggccgaataggaacagctccggtatacagctcccagcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggcttggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcacgcagctggagatcggacaacaggcagactgcctcctcaagtgggttcctgacccctgacccccgagcagcctaactgggaggcaccccccagcaggggcacactgacacctcacacggcagggtactccaacagacctgcagctgagggtcttgtctgttagaaggaaaactaacaaacagaaaggatatccacaccaaaaacccatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaataagttgacaactttgaaaaaaatttagaagaatgtataactagaataaccaatacagagaagtgcttaaaggagctgatggagctgaaaatcaaggctcgagaactatgtgaagaatgcagaagcctcaggagccgatgcgatcaactggaagaaagggtatcagcgatggaagatgaaatgaatgaaatgaagcgagaagggaagttcagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactctttgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcatcagtgaagtagaaataaaatactttacagacaagcaaatgctgagagattttgtcaccaccaggcctaccctaaaagagctcctgaaggaagcactaaacatggaaaggaacaaccggtaccagccactgcaaaatcatgccaaaatgtaaagaccatcgagactaggaagaaactgcatcaactaacgaacaaaatcaccagctaacatcataatgacaggatcaaactcccacataacaaaattaactttaaatgtatatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagaaacaaagaaggccattacataatggtaaagggatcaattcaacaagaagagctaactatcctaaatatatatgcacccaatacaggagcacccagattcataaagcaagtcctgagtgacctacaaagagacttagaatcccacacattaataatgggagactttaacaccccactgtcaacattagacagatcaacgagataaaaagtcaacaaggatacccaggaattgaactcagctctgcaccaagcggacctaatagacatctacagaactctccaccccaaatcaacagaatatacatttttttcagcaccacaccacacctattccaaaattgaccccatagttggaagtaaagctctcctcagcaaatgtaaaagaacagagattataacaaactatctctcagaccacagtgacatcaaactagaactcaggattaagaatctcactcaaaaccgctcaactacatggaaaccaaacaacctgctcctgaatgactactggatacataatgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaactgacaccctaacatcacaattaaaagagctagaaaaggaagagcaaacacattcaaaagttagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccagtaacaggagctgaaattgtggcaataatcaatagtttaccaaacaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatccaaaagcttatccaccatgatccagtgggcttcatccctgggattcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccagagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttttacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttctttacagaattggaaaaaactactttaaagttcatatggaaccaaaaaagagcccgcatcggcaagtcaatcctaagccaaaagaacaaagctggaggcatcacactacctgacttcaaactatactacaaggctacagtaaccaaaacaacatggtactggtaccaaaacagagatatagatcaatggaacagaacagagcccttagaaataacgccgcatgtctacaactatctgatctttgacaaacctgagaaaaacaagcaatggggaaaggattccctatttaataaatggtgctgggaaaactggctagccatatggagaaagctgaaactggatcccttccttacacctgatacaaaaattaactcaagatggattaaagacttaaacgttagacctaataccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacccttttacactgttggtgggactgtaaactagttcaaccattgtggaagtcagtgtggcgattcctcagggatctagaattagaaataccatttgacccagccatcccattactgggtatataaccaaaggactataaatcatgctgctataaagacacatgcacacgtatgtttattgcggcattattcacaatagcaaagacttggaaccaacccaaatgtccaacaatgatagactggattaagaaaatgtagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaatatcacactctggggactgtggtggggtggggggcggggggagggatagcattgggagatatacctaatgctagatgacgagttagtgggtgcagcgcaccagcatggcatatgtatacatatgtaactaacctgcacaatgtgcacatgtaccctaaaacataaaagtataatttaaaaaaaactaaaaaaacaaacaacaaaacaaacaaacaaaaaaaacacaccctccaatgctttgtgtattttacactcatctacctaatcttccctccgtaaatctgtccgaatttccccaaatcatttggtgtgattgttccaatcttcaagaataattttcccagtgatcttaccacagtaagaccctttctgccttcagctttaggagggtgcttctcaattagcatcctggttcccagtcctctgggacatcatttctttcctctcttggattcatttcttttcttctcttagatttcattgaggcacagtcactatttctgaactgatctccccgcttcctaagcccctccttcagagcactttaacctgggtgtatttcccttttcttttcagtgtatttgtctctcctggccttcaagattttattttcttcctaatggaccattctctcctctaagattttatgtgttatgctaaggaaatatatctctccctctaactcagtgatgcttagccaagagcagttttgtcccctagaggacagttggcaatgtctggaggcatttttattgtcacaattggggatgggagatgaggatagtattggcatctactgggtagaggccagggatgctgctgaacacctcagaatgtacaagttagcccccacagcaaagaaataccccatccaaaatgacaatagtgctgagactgagaaaccctgctctagcttaatcagtctgtattcctttactgtttccaaccacttctgtcttgtcagactgaaacataattttttacttattccagttcctccttaattctaatatttgcaagtatgattcctgacacaagcccttggttttgaagtaatttagatttttcttctacttcaacccaagaaaaccatctagtctgtattagaggccttcattccttttcattagttcattaataaaatatattaatatttcccttttgtgggtgaaactggtttggatctctgaaatctaaagccatgtcagtgcccaacttgaagtcacataggaaaccttgaacttaacggacaagctacatgtaatcaagctcagtttctccacagtatttaatggtcctggaggacactcaaaacagcattaaaaaatagagagattttggttctgctaatctagtacgtgtcctgaaactaaatctgctaaaggcattttatagtcccaacctgcagatttactgagaaactgtatacagatagcagcaaaaaagtgttccaaccttgtaatactggaatgccctgtagaatcattctttatattgtctccacttattactaagatttgtaagcatttgctaaagcctattttttttaaagttctgtgtttataaataccagagcagttagctgttctgaactgccaatatcagaaattcctcatgaactcactttctaaaatttacgacctaaagctacttgctctagccatgtcagttgttttggtatcctaattctacacctaatatatatctcaagattccaaacgcagcaccaaaccttgggttttgaggaggtttcaacaaattatacctttctggatccacccagatttagaactgagagaaaaagagccataggaatagggtggagatcagaatttcagatttgttactgataaaactattggagaagacggcttaggagtgaggtccaaataggcttgctggtgctctccagttcccacatcccaatctataccttgagacagcctgggctgaggaagaattgggccctacaaagcaaatacactaacccagggttaagagtagagagagaaggaaagaaagtgactaaccttttaatagattagtttcatccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 1539 - DNA, 129592 bp, Homo sapiens
tgtattaagaaagcagtttatttcttaataactgaatgtatattattttacatataattaatgatcagagagaaataacagttgctgagaacgtaaatttatgttgtactttagaattgaacagatacaaccacagattcataccaaatgcattacttttagattattaacatattcttttacataatttcatttcacatatatggagtccaaccaagatacatctggcatagtaagttttcatcagtagcttcctgtataaggtaatgcacatgtccttcaatagataacggcagtcctgtcactctatttcgagtcttgattacaccttgtagtcgctgctcaatgtcaagaacatgggtcttggcctaaaaagaagaaacataaaaccaaaaacagatgttaataatttggaattactacctttctttatattttgacatttaataaatgttaataccattttactgaccaataccccttttgtaagagcaaatacaggaaaagaagaaattaaacaaatacagttagcttgtgatactgatttggaggctcgcaagattgattcaacatcaactgcttggacatgtttctggactacgtgaaataccagggaattatttacacattacaattctagaaaaataattttttaaatctgctttggaagtgtttaggacttaaacatttcaatgaatattcaaataacaatgctgtactgcctaatatttacattatgttagtacatgcaaatgggtgttctaagtgagctacttggaactgtacaatttcttaagcatatctgaatgcaaaaggaagaataacgttattagaagaataattctcagaggtggtgctgggtgggctggtgggctgcgctgcagcccacgagcacaaagaggagggccacggggtggagactgttgctgtgccatctgccatcgacttttccgccaagagcctggactccaaatatgacttatgttccagcagaactccaggtattaaaataacccctacaacagccaactttcccttttgcagttgcaaaccagctgccgcttatttctttggtgaagcacttgagccatgtgcgtgaaccaaacccagttcattcaagacagtgtttaagttactttgccagacctttatcaaaatggggctgctgtcttctttcacttgtgacaagtttagctcattgagactacatcaccacagagctattactcacttaatgaggtccactaaagagagagttcatcaggatccttgtgaggctatttctcatatccagaaaatcagatcaagggaagtaccctttgaagcacaaacttcacgttacttaaatgaatttgaagaacttgccatcttaggaaaaggtggatatggaagagtatacaaggtcaggaataaattagatggtcagtattatgcaatttaaaaaatcctgattaagggtgcaacaaaaacacattacatgaaagaactacggggaatgaaggtgctggcaggtcttcagcaccctaatatcattcgttatcacactgcgtggacagaacatgttcaagtggtccaaccacaagcagacagagcttccgttcagttgccatttctggaagtgttctccgaccaagcagacagataccaatacggtgttaaaaatggtgaaaatagcagctcacccattatcttcgcggagctcacctcagaaaagaaaaaccctttgcagaatctgacactcaaaatcagaacaacaagctgtgaactacaccatcaattccgtcttaagagacaccagtgaatatgaatcatccctggagctccaggaaaatggcctggctggtttgtctacctggtcaattgtgaaacagcccctgctgctcaggtgtaattccctcctagaggagaatttcacatccactgaggaatcttccaaagaaaacttcaacttgttggggatcgaggtgcagtaccacctgatgctgcacatccagatgcaggtgtgcaagctccagctgtgggactggctagctgagagaaacaaacagggccaagagtgtgtgggcaagtttgcctgtccttatggccagtgttgcaacaaaaaattttcaagatttagtggaaggtgtgttttacatacataacatgggtattgtaaacagagatctgaagcctagaaatatttttcttcatggccctgatcagcaagtaaaaataggagactttggtctggcttgcccagacatcttacaaaagaacacagactggacccatagaaacagaaagagaacaccaacacctatatccagagtgggcacttgtctgtatgcttcatcccagcagttggaaggatctgagtatgatgccaagggtctcactctgttgcccaggctggagtgcagtggtgtcatcatagctcacagcagcctccaactcctggggtcaagtgatcctcccacctcagcctcccaagtagctgggactacaggagtgtgccactgagcccagctaattaaaaaaaaacaaaaactatttgtagagaccagggctggctttgtccagttagatatgtatatagcttgagtgtgatcctgctagagctctttcagctgtttagaacagaaatggagcgagcagaagttttaacaggttcaagaactggtcagatattggaatccctcagtaaaaggtatccagtacaagccaagtatatctatcacttaacgaaaaggaacatgtcccagagaccatctgctcttcaactgctacagagtgaatttttccacaattctggaaatattaatctcaccctacagatgaagataatagagcaagaaaaagaaatttttcttttagttcttttagaagaactaaagaagcagctaaaccttctttctcaagacaaagggttaaggatgacatgaaggatgggggcgtacaggtctagccttcctcgagctatatcagtaggatgaaagtggacttaaactctttaggtagttaactggaatgtaaatttttaatctttattagcatatagttggtataattcattgtatttagtaagcctgtacaagacttattaaagatgtaagagtgccccccaccaaaaaaaacgaatcctcaatctattctaacttattaaaaacaactatctgagctaggcacagtggcttatgcctataatccctgcattttgggatgctgaggtgggtggatcacttgaagccaggggttcaagaccagcctggccaacatggtgaaacccatctctactaaaaatataataattagccagctgtggtggtgcacgcttataatcccagctacttgggaggctaaggcaggagaactgcttgaacccaggaggcagaggttgccgtgagccaagatcgtgccactgtactccagcctggatgacagagcgagactctgtctcaaaaacaacaaccaccaccaccaccacaacaacaacaacaaaactatctgcaaactttgcagcttcaactaagtaagaagtgaattgctgcatttgttaacatagcttgtgacatactggtatcatgatattaaagctcagacctgttgttctgtaagttcaggcaatttgtactatagtttttcctactgtatctcataactgtgaattgtctatggttaaacaagtgtgccatgaacttttattatacaaatgcgaatactgttaacattactgacaataaagaaaacttatggcattgtgatactagagaactagatttcagagtaatcaatagtcactaacagtatttccaagcagttctcatgcatagagatgagaactatagctgcatatcaagttcatttgtagagatgaggactacagcccatatcaagctataccttctactaaccttttcattgacaacttctccagtttcattcagtggcgctttggaatgccctttcactggtttactccattccacaagaggatcatgtagaaaagtctttaagacactaaaattgaaacaaatattatggtatgatgttatctttgcaagaagaaatcttgctgacatcaatatttaagtgaaggatgagaagctaatggtaatactcttataatacacattactacgtcttcattaagttatgtgaaatttctgttttggtgtgaggggagggtaagagaagggaaggcaggaaaaaaggcaagatagaggggagtcagaggtgttttggagaatagagtaagatgggttctatgtgccatctctaagtgtatactgtgaactggtaaatgactatattttgaatgaaggaattttatcccttaccatgtcttcaataacgatataacatctatagctaccatatagacctagcccagaccttttttctgcaccctaaacatcaaatccaattacctatgggaaatacccagttggatatgttccaaacacctcaaactcagtatctccaaaataaaattaattaccttttcccaactatttctcctgtattccccaaatcatcatccacccatttgccctagacaaaaatctaggaatcatcctcaccccgtcttcctctaacatgcaattacaactcctaaatctctttggaatctcttcagttatctccgtctctacggccgtgacactatccagtacaccatcatcctttcctgggttactgcaataaacctctaactagttttctggctgttggcccaaactaggaccctattttttctacagtacaaatcagattatctctttccaccccttgccccctttttattccttcttaaaatcctcaatgacttctggttgctctgcaggcaaagttataatgtagtaacaggccccatgtgagaccttcataatctagcccctgcttacctgtcctgcgtcatctcttagcaccacctcctggaagtataccctctggaatacatactgtatttctcaggcaggccatgacttcacttgccttgatatttttatcactcagaacactctcttctcccttgcatggtcaactttattaacttttaaggtctcaactacttcctccagaaattatttcttgactgacccagactaacacaggggctcttggtaactgttccacatgatgatatacttcctatttcagagaatttgcttttgcatatgtccaactaaccagtattctaccataatgtctgatagacagctttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtcttgatctcctgacctcgtgatccgcccgcctcggcctcccaaagtgctgggattacaggcgtgagccaccgcgcccggcccgatagacagcttttaaataatgaaggtgaataaataagctttaaaagtcctttcaaacaatctgtttcccacagctaacatcatacttaaaagtcaaagactgactgctctacccctaagatcaggaacaagacaaggatgtccacttttagcatgtctattcgacactgatttagttagggcaagtaggcaagaaaaagaaataaaaggcattgatattaaaaaggaagaagaaaaactgtatctgcaggtgacatgttattgtggagagaaaatcttaaggaaggcacaaaaataattattagaactaatacatgaattcagcagattgtaagatacaatatcaatatataaatatcaattatatatctatgcactagcaatgaacaatccaaaaatgaaattaagaaaaattccatttagaataaaatcaaaaggaataaaatacttaggaatacaatttttaaaagttaaatataaaacttgaccctaaaaaccacaaaacattgatgaaaaaaataaaattcaaataaatggaaaaacattctatgttcatcgatcagaagacttaacatggttaagacagcaatactcccaaattgttaagacagcaatactccctaattgatttacaaattcaatgtccttcctatcaaaatccaagctgattttaaaattaatatggaaatacaagggacccataatagctaaatgatcttgggggaaaaaaagcaaagttggaacactcacactttatgatttcaaaatttactacaaaggtacaacaatcaaaacactgtgttgttagcataaggttaggcatatagatcaacagaatattgctgaaaatcaattgaccatttcaacaaaaaagccaagataattaaacgaggggcaaaatattcttttcaaaaaatggtgctgtgactaatggatatgcacatgcaaaaaaatgaatatggacccctaccttacaccatatctacaaaataactgaagacagataaaagatttaaatagcagagctaaaagtcaaaaatgcttagaagaacacataggtgtaaatcttcatgactttggattagggaatagtttcttagatatgacaacagaaacaccaaaaataaccagaagaaaaaaacaaattagactgcatcaaaatttaaaacttttatgtttcaaaggccatcatcaaagaaagtgaagagacaacccacagatggaagaaaatatttgaaaatcatatcttaaaaggtcttgtatccaaaatgtgtaaagaactcttgcaacttggctgggcggggtggctcatgcctgtaatcccagcactttgggaggctgaggaaggtggatggcttgagcttacgagttcaagaccagtctgggcaacatggcaaaaccccttctctgctggggaggctgaggcagggaaatcacttgaacccacgaagcggaggttgcagtgagtggagatcacgttactgcactccagcctgggcgactctgtctcaaacaaagaaacaaactcttgcaactcaagaataggccaggcatggtggctcatgcctataatcccagcactttgggaggccaaggtgggaggatcacttgaggtcaggagttcaagaccagcctggccaacgtggtaaaacccaatctctactaaaaatgcaagaatcagccagacatagtggctcatgcacacatgctgtcccagctacttaggaagctgaggcacgagaatcgtttgaacccaggaggcagatgttgcagtgagccaagatcacgccactgcactccagactgggtgacagagcgaaaccctgtctcaaaggaaaaaaaaaaagaataaaaaaacccaatttaaaagtgggcaaaggatttcaatagacatttgtccaaagatgatctacaaatggccaacaaagacatgaaaagatgctcaccatcactggtcattagggaagtgcaaattaaaaccacaatgagatacaacttcacatccctagaatggctaaaataaaaaaggcagacaataaccaggatagataaagatgttatctaaagatagaaaagatgcagagaagttgaaacccacatacattactagtgggattataaagtgttacaactgctttggaaaatgatttgagagttcttcaaaatgttaagtacagcatttaacatatgacccagcaattccactcccaggtatacacaagagaactgaaaacatatgtccacataaaacttgtgcacaatgttcacagccacactatttataatacacaaaaggtggaaacaatccaaatgtctcttaactgatgaacagaaaaagaaaatgtagtatatccatataacaggataccatttggcaataaaaaacaatgaagtactgatacatgatgaacactgaaaatattacattaagtgaaagaagacaaacacaaaaggccacatattagatgattccatttatatgaaatgtcctgaataggtaaatccatagagacagaaaatattataaatgagtggttacaagtagatagcaggggtgggagggggaagggatcaggagtgactgctaatgcctacggaatttctttttgggctgatgaaaatgttttaaaattagatagtggtaatggatgcacaatcttgtgaatatactaaaaaccactgaattatgtacttttaaaggggtgaatttatggtatataaattatatctgcataaagctattatttaaaaaaactatttcagtcagtacaaagtggtttctacataaaaacaaacatatgtaggggccaataattatattcgaggttactgttaaattatttacaaagtataggtgattacctcattaaaggctctcgctgatcacgcatcagcctcattgtaacttcacatgctcttcgaaaaagaccctctgttcccataggacccattccattaaccatattatgagtcaggcgaaatggcacaatttctggaacttcaaaggtttctcccttagaaacaatacattttattacaaactaacaatgttagaatttaaaaatctttactcaaagaacttcatgtccagattcttttagcaaaaagcaaaaataccctcaaaatatttatgttgtaattactttagaagtttgtaacatgaaggagccatgtagctctgcctttgcttttacagaactgaaaccatacttgatcttggataagatctaggagataagtggacttacctttcactgagtttagtacagtgaataagcagtattacagagaaattttatgcattcaatatttagtctcatattaacttctttaatgtctttcttgaataatatgaaatacaaatattctcatatatttctacttttctttaacactttcatcttaaaacaacagaagcagccaagggtcagatgctcacatcccctcataaaggaaataaaacatgtcatataatgaagtccagttgttcattttctgctgtcctctaatctgccttttctagggacctttcatcccttgtccaatcagttaccctaaattcctctcttgtatggtttaacccatgccagtattttatctctgatttgttctcagttggatctatgatctttcttggtttcttgtgacagcacaaggcaacctgtagatgatggaggtgaagaaaatagtgcgctaacctaccagtctgccctgcaggattataatattggaaaattgtagggggccttaaagatgggtccaattgcctcaatttattcccaggtcccactctggacctacagaatctgaatctcctgggtatctataaatttttttttaattcttggataattctgatatgttgctagaattggaaactatcgtattaaactactctgtctctctaaaactgagtctcagtaaaatgaactgatctgcccttattcacataactaataactaattgagtcagaacctaaacctatgctcttggacttcaaattcagtactagctttacagtatcactcttctaagttctctccatcctaatacgcattactacatgatccactgatgaaaactagtcaacaaattctcagtataactcaactgtgagtataactgctactaacaggtatgtcaaggaagatacagttgttgagaaaaggaaattgagagaaaacacaattagtaagagtaactcatatcacataccttattgaaaagacaattgaaatctacatgtacgcattcaccagtcaaagaatcaaagagaatattttcaccatgacggtctccaagccccagaatataaccaaccattgacattactgcagtggaacggcagtaagctgatctactactgtacctaaaagaaacacaatgcctatgaaatatccatatacatatgaggccaatataaatctaaaatattaaaaataaacattcaaccataacaacgtattatattcttggtaacttaccatgatgtaggatcagggaatgttctcagaaaccactcatgaaaaataggaggatgcctgggcaggagaaattctcggaatactttgagtttttcagataaagctgctgactttggtagcatacactggcgaagttcttttcctgtcatatacactcctgcaaggaagagtgatatccattaatcacatcagccaaatgaaaaaaggggcaaagttttttttgttaaaattggacaagaaacatctacttttattcaaattgttattgaaaaacaagaataaaggaacatttttcaattaagcatacataaagttactgattgtataataaaataataaaccacattatcttcccttaatacagatgacccttgaacaacatgagtttgaactgtgtgggtccacttacatgtgatttttttcaaccaaacatggatcaaaaacatgggatgtaaaatcagtatatactgaaggctgacttttcatacatgcaggttctgcagggctgactgagacttgagtatgtgtggattttggtatgtgagggtattctggaagcaatcctccagataaggagggaccaccgtacttacccaagtgaagcctcttattgatgaaaattaatgtcagttaaaaccagtgttgtgaaatcaaatagttccagaatacaagactcaaaattaagtcccatatgaatgaacttattttgcatatatgtgtacatatcaatatatatgtatatatacatatattttttacactgacacaaattatcaagaaaaaatatattttcaaatccaaactcagacatatacaatatgtcatgctcataaataaaatagtcaacagcaagttctttgaactctgactcaagtgtctctgagtttcagttttgcaactgtgaacttagacaagttacgtaagttctctggcactgtccataaaatagggatggataatcaggcgtgttaacaataataaataaaataatgtacataacatacttggcacaatacccattatatagtgatttatcagtattacttaatgttataaattgaactttatctctcaaaaaaatatgctgaaatcctaattcttggtacctgggaatgtgagcttattcagtaacaggatctttgcagatgtaatgttgttaagataaagtcattaaggtgggcccttaattcaataatccagtgactggtgttcttatgagaaaatagagacacagagacatagagagaatgctatgtaacaataaaggcaatgtggtacaatacatccagaagccacagaacaccagaaggttaagagaaaggcaaggaacattagccttcagagagatcatggtcctaatgacaacttgatattgtatctttagcctccagaaccgtgagatgataaatttctattgtttaaactcgcttagtttgcagtaatttgttatggcaaataccatacaaattatgtatgaaaacatatacttattttctacttcactttgacaacttgatctattcatttttaatgtattacaccatatgaactttaaaaacgtcttattttaaaacaagtttagatgttacaaaaagttgcatcaatgatacggagttcccacatattcttcacccagctttccttaatgttcatatcttgcgtaacaatagtacaattattcaaatcaggaaattcttattattacagtattattaaccaaacctctgaccttattcaaatttcaccagctgtcccactagcacactttgtttaggggtcaggatccaatccaggattacacattacatttagttgtcatcaaatgtcaactccttaatgtcatcaaatctgggaattcattactttgacatttgtaaggagttcggaccagttatatttatatttctctactgtaaagttactatacttttccctttataattgttaagtatctgatagggagatacttcaagattcttcaaataacctgtttctcatcttttgcctattaattttagcatccattaataatcactgcctgcaataataattactatagtgtttgctaattgctgatttcccatttccatcatcctttctacatttattcattgaaattctattagtacataaggaagaactattcccacttccctatttatttatttactcaaatatctgtttatatcagtatggactcatgtttatttgtttattccatgggttataatagtttacaatcattatttattttgctactcaaattatcccaggtttggacagttggagcctcttattccaatctaaaacgtcagacttcattctagccttctctccttcctttctccaatagtgagaaaactggctctcattatacaacatatttacttacttgctgaagactagtactgtatatacatagtttcagaattgttaaccaatatctgtgaaaaacaaatattcatatatagttttgtaagctacctcaaatcctgttgggatgaagacagggaaggaatcaaaatggaaggaaggaaggaaggaagaaaggaaggaagggatggaaacacttaagtgtttctgtatataaaatctagaaatttcactatagcttatatcaaaaaacatatgctagcatatattaataccaattatacccatattatataacttagtacccacactgtatatgtataagaattaattttagtacccttttctttatatagtttggtcagaataggtctcaaaccagcagtgttgttcacccattcaataatcccacattcatcatttagtggaataactgcatatgttcgaatatgaagttctcttctacgagactctgcatcttttcttaagcactgttaaaaaatacacataaatttaaaaacaagatagaactcaaaatttctaaatgttatatcaaatatatttaaagattgttcatttcataaccaaagaatgtcattgaaggcttactatgtggtatacatgaataattcttctgaatggtaggaaggaagctactgggacagtatctctaatctatttacagattattaaaaatgtcctgggtaggtccttctttttaattattcactattaatgtgacaagaatattgtatttaaaatatttaagttgtatatttaacaatgacaaaatgctgctgttttattttctattgctttataggtattactgaaacattaagtctttaggcacagagactgctatttaatttttcttttttttttttgagatggagtcttgctctgtcgcccaagctggagtgcagtggctcaatctcggctcactgcaaactctgcctctcgggttcttgccattctcctgcctcagcctcccgagtaggtgggactataggtgcctgccaccacgcccagctaattttttgtatttttagtagagacagggtttcaccgtgttagccaggatggtctcgatctcctgacctagtgatccgcctgcctcggcctcccaaagtgctgggattacaggcatgagccactgtgcccggccaattttaattatttctaaaatacataaacaaaagagcatgagttctatgacatcctcaaaatgtattgctcctcttgcggtttatcacaaccttatttctaaagctatcccttagcagaagaaagccttacatatttcatctgattgatcctgatatatcaggtggaaataaacagtattatgtttaattctagacctgtatgaagtaagcacacatctgtaattgtaacctgctcaattcaaaagcacaatcactgatcaaaaatacattttactttaggaaataggttccataactaccaggaaaacaatatggccatagaatctcatataaagatcagtgtgtggcctccaaaactaacatagttttttacaaaactatgttagtaaatatgttactaactaagttagtatgtcaggctattttattttaccatgtttatgagggaaaatgtaacaaaatactttaattaaagtaacaaagctgattaatgtaaatttataaactaaagccaggccacttgatactcaagtaaatctgatactcagaaaaactcagggagctttggagagaacatactaatggttcagtagttagtgaattaaggtaccattttaacaaacaatacttttttgttgttgttgttgagacagaatctcactctgtcacccaggctggagtgcagtggcacgatctgggctcactgcaacctccgcctcccaggctcaaccaattctcatgcctcagcctcccaagtagctgggaatactggcgtacaccaccatgcctggctaatttttgtatttttagtagagaaaggtttttgccatgttggccaggctggtctcgaactactggcctcaagtgatctgcccgcctcagctgggattacaggcatgagccaccacacccagcccaaataatatgttaaaataaaaaataatcctccttttcatattgcttttgaaatagctttttaatgtggtattaatttttaaattacttttggttaaaccaagcagactataactttttttaaaaaacaaactcatctactgctatatcttttctatgctaaagatctatgactttaaaatgtgggaaggcaatgagaagaagggaaaaaaagcttgtagaaaaataataaagtttcatctttccacagtatagatcaatttttaccaatggaaaaagacatacactatgcatctacaaatacctggttacagaataattcaaaatacataaaaccatacatttataataaccctttaataagattcctcatatcatctttgagatagaaatcaaataccaacagaactgaaaaaatgctaatgattaccttttatttatctatttatttatttataagagtcagggtcttggctctgtcatctgggctagagtgcagtggcatgatcatagctcactgtagcctcaaactcctgggctcaaacaatcctcctgcctcagcctccttagtagctgggactacaggcatgtgccaccatgcctggctaattttttttattttttgtagagacagggtttcactatataggccaggctggtctcaaactcttggcctcaagtggtcctctttcctgggcctcccaaagtgttaggcttacaggtatgagccactgcacccagcctatttatcttttgataaatatattaacacaatagccaaaaggtagaagcatccaaatgtccatcactggataaatagataaataaaatgtggatggaaaacaatagactattattcagcttaaagagggagaaaattctaacacatgctgtaaaatgaatgaactttgaataatgccaagtgatttaagccagtcataaaaggagaaatactgcacttatatgaggtacctcaaatggttaaattaatggagacaaagtaaatggtggctgctggaggctgaggagaagggaaataggaagttaattgtttcatagacacagagttccaatttgggaagatgaaaaaagttttggagagggatggtggtgatggttgtacaacaatgtgaatgtacttaatgccactgaacaatatacttcaaaaactgtcaaatgttaagttttatgtatgtacattttatctcaataaaaaaattaagtgaaaatgaaaaagactttatatttcattcctgctttttaagagtgatctgtttgtatactaaaatgcctatatcagattgatagtaattatagcaactctgaaataaaagcaatctggttttataatagtcaaaaatttttttaaaataaaaaataaataaataaaataaaagcaaactatctcccaaccttattaatcaaggaattgaattccattagtctacaatcctttctcaggtcatcttttggcttacacatcatgatgtagaactttccatctgagccttttaaagaaatcttctttggtttctgaagagaagcaagaatttccacctaaaagatgatgagttatatatgaattagggccaaaaatttctgtgtaaatgtctatatattataaaccttgagttatgtaaaaaaaaaaaaagaatattaccagctatattatgtagtgaatttgtattttaaaaatcttttattttaattatctatgacctatgaaaagaatgactgtctatgaacagaaacattttcacccattaaaaatagctatgacataaaaagattacttcatcgccaatacaagtacttacatattcaaatttagacaccccccttcaaagcagtcaaaatgtttaaaagatttttgaaacatcttttcaggatctttctgcggagcctgagactctgtttttcaagctttatcaattaaaagtagtttgatttttgaaaaaacaaactccttcaaaattaagtgtacctaatgaagtgagtaaataagatgaataatactgcttaaattaaaaacaaagcatagactgggtacagtggctcatgtttgttacactaacacttgggaaggctgagcaggagaatggcttgagcctaggagttcaagactagcctgggcaacatgacgaaaccccgtatctacaaaaaatttaaaaaattagctgggcatggtgacatgcacctgtagtcccagctactcaggaggctgaggtgagcaaattgcttgagcctaagaggcagaggttgcagtgagctgagatcgcaccactgtattccacccaacccgggcaacagaatgagaccctgtttccaaaaaaaaaaaaaaagaaaagaaaagaaaaatcaaattgtgaaaaaataaagattatagtcatactaaaacaacaggagcatttgaaaaatcaaaacgttacggtgaatgtgaatcatgaatcagaactttttttaatcactgaatttttttgccatcagtacaaatgagtttagttttactcttctgtatttccaattatttttcttcacaaataagattcacgtagattttgtgaaatacactttttatcttaatttgaagtttttaacaactaaattttaaaatcatagtcatataaaactgaagtttaccatatcatcaaaccctgcaatataggcccaatgtccaggaaatggttcatggctagcatggttagcatgggtacccagaattgatggaagtgtaggtatcatgactgattgtagaggaatgaggatttcactaaatgttgcttcttctaccagctttttaagcattttaaaatgagtgctcatgcttaatgtggaactacttccatcaacctgaaaaaataaatagtgcattttaatttgtttttaccttaaattccactataacaaaaatttcacttttacaatattttgattacaaaggttcagcagtctgtggttttctaagtatttcctaatcatcccattttaacctctgtcatttacctcattaataatagtacctacatcataggattgtttaatgattaaaggagagagtagaggcctataatctattatcaaatattagaaaatccaaagagctctgtaaattaaactctcactgaagaaacagttatgtgtttgattatgggatactccaacaggttaccctcagtggaaatatcaaatattaaatatgcactaaaatcttaaaaatcctaaatttctaagtgtagcttgccacaaaggtttcagataaagaactggaaacctgtacatgtaaagcacttacaacagtgttagtgttttaataaatgttggccaccataacactgtttttgataatgtcaagtgcatcagaggtcaaatgggattaatggagataataaatgcagattacccttttgagatgtttattgataaaggaaaggtgagaaatagtctgtatcttttcatctataaacactgatgcactctgaatatttgtcaagtgaagtctagctatgtaccttattaaagaacttctctctccctccttataaccacccccacctcccacttttatctttcctatacatccttgggggtttttctctaatacttaggtagaattatggggttactcctgtaaccatgttcctactttagtcacaaatctaccgaaaaaagtacttattactctagataaccatctgcttagttccctaaaagactgtaagcacctcaggcatgagaatagattttattcatcttgtttcccttagcatagtgcttgtcccctcataggcactgaaatgtgtactaaaagaatgaaaagcaaaaccccaaccctcttccctatcgtaagtgtagtttaataatgtatatgaattttgaaagtttaaagatatgatataatcatagactaccataagtaacttagaatattttacatacttatatttttatggcttatttcatattctctactaaaaattgctgagaaacatggatatctactctcggaaaattcttaattcacactaagaagaacttttagaaatattagagggtatttggaagtaagatgtattagaaatattaaaaactgctttattaagacaaatcatacataattaaaatatacattttgatatatgtgtacacctatagttagaattttaatttaattaatcaaatgaaaaaatctgctcaaattatatacataattacccaacatcagtttataagcactaagattatgatagtaccggtttattgcacaattctagaagcttatctgttaggcgagttgcatctccaacaaacttctctaaggattttttcatatgaatagctttattgaggatttccttgcatctgttcacacgcatgggataagatgactgtcataaaaaagagttaaatgtcataaaaaagagtttatacaggatttttaaaagataaattttttgcttgacaaaaaacttaaaaagtattcatgatgagagtttatatgatacaaattttctgaaaatttatttggcaatgctatcaagagccatacaaatattgccaccctataactttgtgaattataaagttatagggatctgccctggagaaataattacaagtgagaataaacatagacatatctagatgtgttacaattgcaagaaaaatagaaataaccttaatgattaactaaacagttaaataagttattgaaggctattttttagaattttatatattaaaattatatcttcaaattatatttaataacatggaaacaataaagtgaaaaatatgaaattgtacggcaacataattaaatttagtgttaaaatatgctagaaaatatacaaataaaattacatcaaaacattaatgaatggcccaaggtgtgaattttaatttttgttttatgtctctgtattgtctaaattctctaaacatttacttattacatatattgaccaacatatgaattcccattaatgatgcaataacggttttttagtattaataattcaggtactggcggggcacgatagctcatgcctgtaattccagcactttgggaggccaaagcagaaagatcacttgagcccaagagtttgagcccagcctgagcaacacagcaagatcccatctctacaaaaagaatttaaaaattaactgtacatggtgacacaccgctatcatcctagctactgggaagctgaggcaagaggatcacttgaacccaggactttgaggctgcactgagctatgatcccaccactgcattccagcctgggcaacagagaaagatcctgtttcttaagggaaaaaaaataaaaattcaggtagtttggattaaaatatttgtgaaaacataggtaaccattttgcatcaagcattaactgtttactagacttcataaagaaaacacatgctgaattatttgatcttaaacatactagttacttcatttcatatggtaaatatatccaaatattaagatataatgctataaatttctctctttaaaaaaatatttaaaattactaatctaatacaggagagacgccctggaacttgtatctacatattagtattacataatcaagttcatataaaatggtaaaagatcttttcatataaaaaggtaaaagacccttttacctttgacacagctgtcatcatccacattgcttgttgaggataggctagaaatactttggctattatttccatcaagacaacaaaaacttcatcgtgagaatgacaaattcgagagatcaattgtgaaaaagcagtcaaaaattgatatggagctaaatagtttgtatgctctgtgataaccttgtttattttacccaaatcattcctcatttgtacacgatcggagcggccagctgggggaagaaataagtttaaaaaacaataaaggaaagagaaaaatcagtatatcagttcatttcacagaagaaaaattttgctttaaaaatagctttaaagtatgttattcccatgcccaaggttaggtcacttgccaatttgtgaaaagatagttgtctctgtccaaccagaaaaaatatttagagccattcaaaaacccaagggacattaattttcactatccattttaatttttagggtaaattatttggctaaaactaacacattttaatatgtgttagattcattaagaaataatcagatttgtatttgtggccctgaattaaaactactttaaaagtctatgatttgtctttcctttttaacatttagtatcttactcacacttacataatatcttaattatcaaattcattccaagcttctaggaaattagactgtccagccaaatctgactttataccaaagttataattcctagtcctttaaaacttttacgtgaagagttatacctttttcccattcatatgcctttgtaccataatcaagccatagagttaacattcgtggcattgactgatatatgaactgatttccatattgtagagatctgcaattatatagacaagaaacactattagcatagctgtcatttttatattatacgaattaaaatttaaagattcaaactaccacataccgttttcacaaaaattatggtatcaatatttcttcctagaagttatttttgactcctctgtctcctttttagctcacttagttctacattccctgtaccaaaaacatgtacatactgtatgtttccacttacagtatacagaatttgtacattatacaaattctgctctaatcaaagtctatcaatacttctttcaatttttccttaggatctctgtgccttcatttgcattctttggccataagcctaggttaggtccaatcattctatttctgggaaattataataacttggtcaccctaaatccatatttctacccttcagtaaattccagactaacattcctgaaattctggctttatcatgctctccccttattaaaaaacaggaatcaatacctacatattaaaactatataaatgattctgcctgggattcaaacattcagaatcttttatctccataattttccaatcttagcatcttgccactcaccagtatacatcttccatcaggtctagtttctgcaccatcctacaaaccaaccactcaacgctgtttctggtaaaatttgtgaaaagttaaagttctctccttcttgaattttttaggggcctggacatcagtttattttcaaaagaaattttattgtggtaaaacatacataacataaaatttgccatcacaaccatttttaagtgtacagttcagtgttatattaatatggttgtacattcacattgttgcgtaatcatcaccaccattccccctccagaacttttttcatcttcccaaattggaacctcgtacctattaaacagtaacttcccgtctccttccccacccagtctctggcaaccaccattgtactttctgtcttcatgaatttgaccattgaaggtacctcatataagtggaaacatacagtatttgtcctttttgtgactggcttatttcacttagcataatgtcctcgaggttcatctatgttgtaccatatgtcagaatttccttcctttttaaagcagaataatattccattgtgtctacatcacattttgctgatcaattaatctcccaatgaactcttgcactgctttcatgttttagctattatgaataatgttgctatgaacacgaatgtacagatatctttttgagacccatagagacagtttaatgacatagaattgcatttaccattctacaactatagaagaagtggggactttcttttccccttcttattttgtcaagattaatttaaccagaaattaggagagctagcaggtttttttaaaggtgcacaacataatgtttttgtttttaaacatttcatttatttatttaaatcaacaaataaaaattgtgtatatttattgtgcacatgttttgaaacatgtatacattgtggaagagctaaaccaagctaactcacgcatgctaattatttcacatatttattttgttgtggaataaaatctattctcagcaattttcaatacaaaacatttgttaactatagtgaccatgttgtagagtagatctctttaacttattccttctatttaactgaagttttatgtcctttgaccaacatctccccaactcctcactactccaacccctggtaatcaccattctactctctagttctatgagttcaacatttttagattctacatataagtaagataattcagtattaatctttctgtgccaggcttacttcacttagaataatctccaggttcatccatcttcgcacaaataacaggattccttcttttttaagcctgaatagtattccattgtgtgtgtgtgtgtgtgtgtgtgtgtgtgtgtgtgtgtataagtatacatacatatgccacattttctttattcattcccatgttgatggacacttagtttgattccatagcttggctgttgtgaagatgctgcaatgaacatgggagtgcagatatctcttcaacatattgatttaatttcctttagatatataccccataatgggattgctagatcatatgatatttctatttttaatttttaaggaatctccatactgttttccataatggctctactaatttaccttcccaccaacagtgtataagggttcccttttccccatatcctctccaatgcttgttatcttttgtcttttatatgatagccattcaaacaagtgtgaggtgacatctcattgtggttttaatttgcatttatctgatgattaacgatgccgaactttttttatatacctctgttggtcatttttatgtcttcttttgaaatatgtctgctcagacccttttcccattttttttaattgggtaatttgtttccttttttctatttttatttttattttttcagacaggatctggctctgttgcctgggctggagtgcagtgatatgatcctggctcactgcaacctccacctcctaggctaaagtgatgcccctgcctcagcctcctgagcagctgggactgcaggtgcataccaccacgcccgaataatttttgtatttttttgtagagatgggggtttcaccatgttgcccaggctggtcttgaactcctgggctcaaacgatccatctgcctgagcctctcaaagtgctgggattacatgcatgagccaccatgcctggccaggtgatttgctttcttactattaagttgtttgagttccttacctattttggctattaaccccctatcagatgtgtggtttgcaaatacattctcccattctataggttgtcttttcactctgttgattgtttccttggctatgcagaagtcttttggtttgtataatatcatttgtctatatttgcttttgttggctgtgctttttggttcatatccaaaaaaattattgcccaaaccaatgccatgaaccttttcctctatgttttcttctagtagttttacagcttcaggtcttacatttaagtttttaagccattttgagttgatttttgtatatggtgtaaggtaagagtgtaattccattctattgcatgtggacatccagttgtcccaacaccatttattgaagagactgtcctttctgcattgtgggttcttggcacctttgtcaaagatcaattgactgtaaatgcgtggattcatttctagggtctctgttccactggtctatgtagccattttaatactaatgtcatactgttttgattattatagctttgtggtataattttgaagtcaggtagtgtgatgccttcagctttattctttttttttttttttagagacatagtctcagtctgtcacccaggctggagtgcaatggcacaatctcggctcactgtaacctccacctcccgggttccagcaactctcctgcctcaacctcctgagtagctaggattacaggtgcatgccaccatgcccagctaattttctgtattttagtagagatggggtttcaccgtgttgccctggctgatcttgaactcctgagctcaggcaatccacccacctcagcctcgctatgattacaggtgtgagccaccacgcccggccagctttgttcttgctcaagatttctttggttatctgaggtcttttctaggtccatacaaattttaggatttttttttctacttctgtgaaaaaagttattggatttttttttttttttttttgagactcccagtctggagtgcagaggcacgatcttggttcactgtaacctccgcctcctgggttcaagcaattttcctgcctcagcctccctagtagctgggattacagatgtgtgccaccatgcctggctaatttttgtattttcagtagagactaggtttcactatgttggccaggctggtctcaaactcctgacctcaagtgatccacctgcctcagtttcccaaagtgctgggattatgggtgtgagccactgtgcccagccagaatttttaaacaaaacaaaacaaaaaaaaaaggaaagaaagaataagctattggaattctgatagaaactacattgaatctgtagatcactttgggcactatgaacattttaataatattaattcttccaatacataaacaggatatctttccatttgttcatgtcttcttcaatttcttttcatcaatgttttatagttttcattgtataggtcttttgccttgtatttattcccaagtattatattttatttttgtagctactgtaaatgagattgtcttcttaatttatctgcaagtactctgttattagtgtatagaaatgctacttacttttgtatgttgcctttatatcctgcaactttattgaattcatttatttgttctaatagtcttttattggagtcttagggtttcagtatataaaatcatgtcgtctgcaaatagaaaaaaattgatgacttcttttccaatttggatgccttttatttatctctcttctcgaattgctatggctaggattcctggtactatattgaatataagtggcaagagtgggcatctttgtcttaatcttagaggaaaagctttgaacttttcaccactgagtatgatgttatctttggggttatcatacatggtctttactgtgttgaggtacattccttctatacatattttttttttaaaaaaagtttgtttttttttaaaaagcctcttttattttaaaaaacaaaggaatgaaaaacacaaaattgggaatagtggttgcctccagggatagaggggtgacataaaggttagactagattaatggatgttcattctattattatgctttacaacttatatacatgttatgttttatatatatatgtttttaattatactttaagttatagagtacatgtgcacaacgtgcaggtttttagatatgtatacatgtgccatgttggtgtgctgcacccattaactcgtcatttaacattaggtatatctcctaatgctatccctcccccagcccctcaccccacaacaggccccagtgtgtgatgttccccttcctgtgtccaagtgttctcattgttcaattcccagctatgaatgagaacatgcggtgtttggttttttgtccttcgatagtttgctgagaatgatggtttccagcttcatccatgtccctacaaaggacatgaactcatccttttttatggctgcatagtattccatggggtatatgtgccacattttcttaatccagtctatcattgttggacatttgggttggttccaagtctttgctattgtgaatagtgccgcaataaacatacatgtgcatgtgtctttatagcagcatgatttatattcctttgggtatatacccagtaatgggatggctaggtcaaatggtatttctagttctagatccccgaggaaccgccacaatgacttccacaatggttgaactagtttacagtcccaacaacagtgtaaacgtgttcctatttctccacatcctctccagcacctgttgtttcctgactttttaatgatcgccattctaactggtgtgagatggtatctcattgtggttttgatttgcatttctctgatggccagtgatgatgagcatttttttcatgtgtctgttggctgcataaatgtcttcttttgagaagtgtctgttatatccttcgcccactttttgatggggttgtttttttcttgtaaatttgtttgagttctttgtagattctggatattagcccttcgtcagatgagtagattgcaaaaattttctcccattctgtaagttgcctgttcactctgatggtagtttcttttgctgtgcagaagctctttagtttaattagaccccatttgtcaattttggcttttgttgccattgcttttggtgttttagacatgaagtccttgcccatgcctatgtcccaaatggtattgcctaggttttcttctagggtttttacggttttaggtctgacatttaagtctttaatccatcttgaattaattttcgtataaggtgtaaggaaggatccagtttcagctttctacatacagctagccagttttcccagcatcatttgttaaatagggaatcctttccccatttcttgtttttgtcagggtggtcgaagatcagatagttgtagatgtgtggcattatttctgagggctctgttctgttccattggtctatatctctgttttggtaccagtaccatgctgttttggttactgtagccttgtagtatagcttgaagtcaggtagcgtgatgcctccagctttgttcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttccttgagcaatggtttgtagttctccttgaagaggtccttcacatcccttgtaagttggattcctgggtattttattctctttgaagcaattgtgaataggagttcactcatgatttgggtctctgtttgtctgttattggtgtataagtatgcttgtgatttttgcacattgattttgtatcctgagactttggtgaagttgcttatcagcttaaagaaatttggggctgagatgatggggttttctagatatacaatcatgtcgtctgcaaacagggacaatttgacttcctcttttcctagttgaatgccctttatttctttctcctgcctgattgccctggccagaacttccaacactatgttgaataggagtggtgagagagggcatccctgtcttatgccagttttcaaaaggaatgcttccagtttttgcccattcagtatattggctgtgagtctgtcataaatagctcttattatttttagatatgtcccatcaatacctaatttattgagagtttttagcatgaagggctgttgaattttgtcaaaggccttttctgcatctattgacataatcatgtggtttttgtctttgcttctgtttataggatggattacatttgttgatttgtgtatgttgaaccagccttacatcccagggatgaagcccacttcatcatggtggataagctttttgatgtgctgctggattcggtttgccagtattttattgaggatttttgcatcaatgttcatcagggatattggtttaaaattctctttttttgttgtgtctctgccaggctttggtatcaggatgatgctggcctcataaaatgagttagggaggactccctctttctctattgattgaaatagtttcagaatgaatggtaccagttcctccttgtacctctggtagaattcggctgtgaatccatctggtcctggactttttttggttggtaagctattaattattgcctcaatttcagagcctgttattggtccattaagagattcaacttcttcctggtttagtcttgggagggtgtatgtgtccaggaatttatccatttcttctagattttctagcttatttgcatagaggtgtttatagtattctctgatggtagtttgtatttctgtgggatcggtgatatcccctttaacattttttattgcatctatttgattcttctctcttttcttctttattagtctagctagcagtctatcaattttgttgatcttttccaaaaaccagctcctggattcattgattttgtgaagggttttttgtgtctccatctccttcagctctgctctgacctaagttatttcttgccttctgccagcttttgaatgtgtttgctcttgcttttctagttcttttaattgtgatgttagggtgtcaattttaaatctttcctgctttctcttgtgggcatttagtgctataaatttccctctacacactgctttaaatgtgtcccagagattctggtatgttgcgtctttgttctcgttggtttcaaagaatatctttatttctgccttcatttcgttatgtacccagtagtcattcaggagcaggttgttcagttcccatgcagttgagcagttttgattgagtttcttaatcctgggttctagtttgattgcactgtggtctgagagacagtttgttataatttctgttcttttacatttgctgaggagtgctttacttccaactatgtggtcagttttggaataggtgtggtgtggtgctgagaagaatgtatattctgttgatttggggtggagagttctgtagatgtctattaggtctgcttggggcagagctgaattcaattcctggatattcttgttaaccttctgtctcgttgatctgtctaatgttgacagtggggtgttaaagtctcccattattattgtgtgcgagtctaagtctctttgtgggtctcttggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggatttcaacccctgcctttttttgttttccatttgcttggtagatcttcctccatccttttattttgagcctatgtgtgtctctgcacgtgagatgggtctcctgaatacagcacactgatgggtcttgactctatccaatttgccagtctgtgtcttttaactggagcatttagcccatttacatttaaggttaatattgttatgtgtgaatttgatcctctcagtatgatgttagctggttattttgctcgttagttgatgcagtttcttcctagcatcgatggtctttacaatttggcatgtttctgcagtggctggtaccgattgttcctttccatgtttagtgcttccttcaggagctcttttaggacaggcctggtggtgacaaaatctctcagcatttgcttgtctgtaaaggattttatttctccttcacttttgaagcttagtttggctggatatgaaattctgggttgaaaattcttttccttaagaattttgaatattggcccccactctcttctggcttgtagaatttctgccgagagatcagctgttagtctgatggggttccctttgtgggtaacccgacctttctctctggctgcccttaacgttcgttccttcatttcaactttggtgaatctgacaattatgtgtcttggagttgctcttctcgaggagtatctttgtggcgttctctgtatttcctgaatttgaatgttggcctgccttgctaggttggggaagttctcctggattatatcctgcagagtgttttccaacttgtttccatttccccatcactttcaggtacaccaatcagacatagatttggtcttttcacatagtcccatatttcttggaggctttgttcgtttctttttattcttttttctctaaacttctcttctcgcttcatttcattcatttgatcttcaatcactgataccctttcttccagttgatcgaatcggctactgaagcttgtgcattcgtcacgtagttcctgtgccgtggatttcagctccatcaggtcctttaaggatttctctgcattggttattctagtcagccattcgtctaatcttttttcaaggtttttaacttctttgccatgggttccaacttcctcctttagctcggagaagtttgatcatctgaagccttcttctctcaactcgtcaaagtcattctctgtccagctttgttccgttgctggtgaggagctgcgttcctttggaggaggagaggccctctgatttttagaattttcagtttttctgttctgttttttccccatctttgtggttttatctacctttggtctttgatgatagtgacgtacagatgcggttttggtgtggatgccctttctgtttgttagttttccttttaacagtcaggaccctcagctacaggtctgttggagtttgctggagatccactccagactctgtttgcctgggtatcagcagcggaggctgcagaacagcaaatattgctgaacagcaaatgttgctgtctgattgttcctctggaggtttcgtctcaaaggggtacccggccgtgtgaggtgtcagtctgcccctactgggggatgcctcccagttaggctactcaggtgtcagggtcccacttgaggaggcagtctgtcagtgctcagatctcaaactccgtgctgggagaagcactactctcttcaaagctgtcagacagggacatttaagtctgcagaggtttctgctgccttttgttcagctatgccctgcccccagaggtggagtctacagaggcaggcaggcctccttgagctgcagtgggctccacccagttccagctttccagccactttgtttacctactcaagcctcagcaatggcgggcactcctcccccagccttgctgccgccttgcagttcgatctcagactgctatgctagcaatgagagaggctccgtgggcatgggaccttcagagccatgcacgggatataatctcctggtgtgctgtttgctaagaccattggaaaagcgcagtattagggtgggagtgacctgattttccaggtgccatctgtcacagctttgcttggctatgaaaaggaattccctgaccccttgcacttcccaggtgaggcaatgccttgccctgcttcggctcatgctcggtgcgctgcacccactgtcctgcacccactgtctgacaagccccagtgagatgaacccggtacctcagttggaaatgcagaaatcacccatcttctgcgctgctcatgctgggagctgtagactggagctgttcctattcggccatcttggaaccgcccctctgaaactttttagtcataaaaggatgttgaattttgtcaagtgctttctctgcatctattgagatgagatgatcatatggtttttgtccttcattctattaatgtggtatatcaaatatatgtatttggatatgttgaaccatccttgcattctggagtaaattccacttggtcatggtgaatgatccttttaatgtgctgttgaatttggattactagtataccttcttcatgaggtttaccagacttttgtagcaattcaatgcaaagaagtacacttttgaaatcataaagccagtggcttgtggcttgacttttgacctccatgacttctggacttgtttggttcacttttggtatctggctaatatagcctcccacatagctgggaccatggttgtacaccctatgcctggctgatttatttattttttgtagagatgaggtcttgccatgttccctaggcttttcttgaactcctgggctcaagcaatccttccatttcagcatcccaaaattctgggattacaggcattaatcaccgtgcccagccatatctgatatttactacatttattttgatttatttatttattttttttttgagatagagtctttctctgtcacccaggcaggagtgcagtggcatgatcatagctctccgcaatctccacctcctgggctcaagcaatcctcttggcttagcttcccttgtagctgggaccacaggtgtgcaccaccatgcctggataatttttgtattttttttggtagagatgggttcttaccatgttgctctggctggttttgaactcatgggctcaagcaatctgcctgcctcagcctcccaaaattctgaggttacagacatgagccactgagcccagcctattttgatatctaatcacacattctattatgtaccattatttaaatgttttatgtacttaaggtttctaaccctaattggatcctagattcttaagggcaaacattgatatttaatcagtaataacacaattattcagtcaggggataaatatgtctcaatagctaagtttactcccttaagcatacaaatattttattttaactactatggatagaaacaggttttaaaatgtacttacattcctgaagggtactttaaaaatactcactatacataacagttttatgcatatagaggactttatatagccacttgttttaaaagaaatgtgttaagtaaattctatatcccaaggcacatgatatatactaagactaaagagcaaacaaaagaagctattactcatttttcaaaagaactgggccaagagtgatggctcacacctgtaatctcagagcgttgggaggctgaggtgggaagattgcttgaggccaggagctcaagatcagcctgagcaacatagtgagaccctgtctctacaaaaaattatttaaaaacatagttgggcatggtggcatgtgcctatagtcctaactactaaggaggctgaggcaggaggatcacttgagcccagagttcaaggtcatagttagctatgattgtactgcactcctgcctcagtgacagagtgatactttgtcaattaaaaaaaaaaaaaaagaagaactgcctttagtacctttactcattttgctaccctaataccattgatgatgaacaaatattgctttttttttccattttttttctcgtgtgacacagccctcaggagatcctgagaacatatgccccctttctttcttttttttttttctttctttctttttttttttttgagacagggtcttgctctgttatccaggctgctgtgcagtggtgcaatcacagctcaccactgccttgacgtcccaggttcaggtaatcctcccacctcaacctccaaagtagctaggactacaggcacacaccaccacccgtggcttacagatattgctttaatttctgaaaatatttaactgagaagtcatagtacctcataataggcaattttaacagatatattgatctgaagatatccttccatgtaaagcaatggtacatgagtatgataaggagaatgtatggaatgatattgtttcttagcaattaataatttataaaaacataaacagtaggcctgagattatacttgactataatacaccgatatatgaaattaaaagttatatttcacctattaactagtttaagaataagtactttctacaagtctaatgtcaaaatcattttcatgtatatatattataccacttcttattggaatgggctagaaggaagtactccattgcaataaaatataaccacaaaggctgagtggagtggctcacatctataatcccagcactttgggaggccgtggtgggtggatcacgaggtcaggagttcgagaccagcctgaccaacatggtgaaaccccgtctatactaaaaatacaaaaattaactgggtgtggtggcacacgcctgtaataccagctactcagaagggtgagccagagtcgcttgaacctggaagcagaggttgcagtgagctgagatcgtgccattgcactccagcctgggcgacagagcaagactctgtcttaaaataaataaaataaaataaaatgaaataaaataaaataaaatatatatatatataaccacgaaatatgacattaagggtcttctggaattctatggttggggactcaggggatgagggtctggaatgagaaggatacttaatttggtgctgttgaatttttttaaaaatccaggctgtggaattataatacatatattggttttagttcacagttactggctcctaactcctcgttttaatgtcagggcactttaggcctcaggaaacagaatctctctctatgagcttctcctgtccttcactcatctgcctaagggaggattctaatctgactgtgagtcaaaagatcctcatcccagagaggatcctgccccatatcctagaggaaggaatgctacatagaaaaggccaagaaaagtctgaacagacagaccttgctgggtttacattatgagctatttgtccactcacatttctacatggttgtcaatcatgcccatgtaataaagactccattaaaaaccccacaggacagagtttggagagcttccagagaggtgaacacgtggaggctgacaggagggtgaagaagacctcatccacgtgccaggaggatggcacagcccatctccatggagacagaagctcctgtgccggacccctccagacctcaccctacctatctcttcatcagactgtttatttgcatcctttaaaatatctttcttaataaactagtaaaaatgtttccctgagttctgtgagccactctagcaaatttattgaacccaagaggaggttgtgagaaccccaacttgaagccagttggtcagaagttccagaggcccagacttgcaactaagggaaggaggagatggtcttgtgtcaccaagccctcaacctctgaggtatgacaccgtctccaggtagagagtgtcagaacagaattggaggacaccaagctggtgtccactgcttggtgtatggggaaaaaaacccacatctttggtcatgtaagtcttctactgtgttgatgattgctgtgttggtgtgagagcagaggaataacatagttagagagagtttccaaaacacatgtctatatcacttttttcatttaaaaagtttttaaagtgaagaaaaaagttgcataaaggaaaaatttacatcttatctaaggtgatacactgaatcagtcataagccagaaaatacctagaatatgctaagacatgtgataacagtttcaatattaatagtcatccttacatatttaatctgcaaacatgcagttctcatactcacctgccaaaatgaagaactatataccggatgagatcaccttgcttttccattttgttgtctgtgaccatgggcatcaatttgtcatagtacttggcaaggtaaaaatgcccatcctcccattctggcaggcacgcggtcacatcctataaaaaagaacataggatacctacctaaggaaatcccacgctatgctgggaagtaaaatatgaatagatgattagggatcaaaagtatgtgacctttatctaggcagagcaaagtcaaaagcagactcaatctttgatgtggaaaaggaatagctaacttcttgtaaaggttttctcaggagggctgatttgttctggtgggttgcccactgcccaacatgaaatagtgctggaagaattcgcaacttaggagaaaactccatttatgtcaccactttaaaagatacatcaaagtagtgtctggatgggttaaatttttttatacatatatatgatatgtgtgtgtgtgtatatacacatatatcatgaaaggcatttttaaaaatcttcaaagcagaagtaatatcaagtctctaaagagtgtaggactttaaaaagcataaaaattttggtaaaataaaaatcacatattttgtttttctccaagatctctcacaagttattgccctttctctcaattccttcagaagcaggcttctaaaaaggattctctacctcacattgattcctaaaactatgtcttttcagcttcagtcttcaccactccactaaggagctccttaaatccaagagatattttacaactctgatctcatttgaactctcttcaatatgtttctgttgtccaagtcacttatttcaaatgctttcatcccttgacttctgtgaggccaccatcttccaagttttctcctctctttctggccactctcacttagtctcctttgtcatttctttttgctgttcctgccttaaatatttgtgtggtttattaatttttaatattacatgaaatgtgatgggaaatacacaggatcactgacaattttttttttaattgaagttccacttttcatctaaagaagtttgagaacagtttagaccagaaaccttaagtgagatcttgagtttctactgactctaatcttgagactctacagacacaaacctgcctgggaatagaggacagaatgatatgattagacgtgtggcacatgctaggttcatgtacctaatcagccacacagggtaagggctgccagaaaaacatattagtcaatctagtctttccttcctttcttctttcctgcctgtcttcctgccttcctttcttcctccttccctaacttccttcctcctccctctctcatttcagcttagattttaaatatttattttgaaaagtaaaattcacatactgaaaaatacactaatattacatttacagcttgatcaattatcacaaagtaattacctttatataaaatctccttcctccctctcttctctctcgctccctttttagttaagatttttaagttttattttgaaaaataaagtttatatacagaaacatatatgaatcttatgtatacaacttgatcaattattacaaatttatcatcctcatacaagaactccaggagttttttgtctgtttttgaacttttatataaatagaatcatactataataattattattattggctgggcaagatggcttatgcttgtaatcccagcactttgggaggcccaggtgggcggatcacgaggtcaggagattgagaccatcctggctaacacggtgaaacctggtctctactaaaaatacaaaaaaaaaaaaaaaaaaaaaacaattagccgggcggtggcaggcgcctgtagtcccagctactcgggaggcggaggcaggagactggcctgaacctgggaggcggagcttgcaatgagccaagatcgcgcaactgcactccagcctgagcgacagagcgagacaccatctccaaaaaaatacatattattattagagacaaggttttgccctgttgtcctggctggtgtgcagtggcatgctcatgactccctgcagccacaactcctaggctcaaggcaatcctccctcctcagcctacggagcagctgggactagaggcatgtaccaccacacccagctaatttttgtattttttgtagagacggagatttgctatgtttcctaggctggccttgaactcctcagctcaagcaatccgcctgcctcagcctcccaaagtgctgggattataggcatgagccaccatgcccagccctacgtgtattatattttttatctggcttatttcattcaacattacatttgtgatatcaatccaagttattgcatataaatttggtttactatatagtattccattataagaatatgctacaacatatttatccattctataactgattgccatttggattacttccaatataaaatctacaaataataatgttataaacattcttgtgtttatcctctggggacatgctgggtcatattccagatatgagcctctaatgtattgcaaatatcttctaatctgtaggttgcctctaactcacaatggtatcttctgataaacagaagttattgtttattttagggttagtgtttttgttatgtttaagaagtcctgacctagattaacaatctacctcaagtttacttttgtttatggtgggaagaagggatcaagtttgattttttgttttcctataagatacccaagtgatacaacaacatttattgaaaagactattttggttattcacagtttgcccctccagatagatacacttgccaactttagccttttccactctgctcagtgccccagcaaactgaaattgatgatttatatcaatgggcctgtttgccctctggcttcctgtgaagttcaatcaatggaaggtagcaatagattagagggtgagggggagagtgaggttaaggtctttatacctgctcgtttccttcctgctgggctgcagttgacagtggtggtgtttctttccctaaggttaagttctggtccaatggtcctttcctacaaatttagctccctgtacaggttccagtaaatgccctatccttttgctccttcaggtctagagttagcaacgactctctgttgttgctagccatggggtactttcaccatcctttgttaatttcccttaatctagtttttcattaaactctccccaattacctcttttgattgggccaactattttctccctgcacctgacctcacacgatacagtaaagagcatctcagatagattggaggtcactaaggagatatgacaactaatgctatatggaatccttaattctagacagaagaagaacactattgggaaaactggtgaaatgtggtctacagatagttaacagtattgtttatcaatattaatttcccacttctgatactctggtagtgtaagatattaaaattagtggaaacacggtaaagggtagatatggaaattccctatactactactaactttttagaagtcaaagattatttcaaattaaaactgaaaaaatgaaaggtgacagagaagcttcttggttattcttggcctttatgtttccacataagttttaaattctaattgtcaattacctgttagcatttgatgagtaatgcattaaacctctaggtcagtttgtagagaaataattatattattgagtcttcccattcatacatgtattctagctaccaatttatttagttcttttttacttcactcaattttaatgttttaatttttattttgtggagaggtcttgtgtgcaatttaatcctaggcatttcatcatttttattgctatcctaaatgatatctttaaaaattttaggctgggcatacatggtggctcacaactataatcccagcactttgggaggcagaggtgggaggatcagtagaggccagggagtttgagaccagccttggcagaacagcaagaccctatctccacaaaataaaaaattagctgggtgtggtggcatgtgcctgtagtcccagctacttgagaggctgaggtgggaggatcacttgagcccaggaggttgaggctgcagtgagctgtaatcatgccactatactccagcctgggttgacagaccaagaccctgtctcaaaaataaaataaagtaaaattttaaatcaactttcttaagacatatacacccatggaaccatcattccagtcaagaagatgaacattcctaactctcgaaagttcttatgggcgcccacccttgccgtcactctcctgccaactacccaggcaaatactgatataatttctatgcatatacattaattatacctgttctaaaatgtcacataaatgaaatcatataagcatatagtcttttatgtccctcttctttcattcagcatatctatgacattaatctaccttgttgcgtgtatcagtagttcatttcttcttactgtagggtagtattccattatacaactgtaccagtttgtttacccattcttctctggatggccagctggcctatttccagtttttgtgactaaacctactataaacatttgtgtacaagtctttttattgacatatgtaattgtttctgttggataaacacctaagaatggaatggaatatggtagatttaactttttatagtccccaccaggtgcatttattgcattaataggtattgctagtctttcagactttagccattttagtgtgtaatgtgttatttcattgtggttttaatttgcatcttcctaatgactaatgatgttaagcatcttttcatttgctttttggccatttgcgtgtattctttatgaagtgtctatccaagacttttgcagatctgtattttttttcttttaatagacaaagtttcactctgtaactcaggctggaatgcagtggtgcaatcatagctaactgtaaccttgaactcctaggctcaagtgatcctcctgctttagcctcccgaatagctaaaactataggcattcgtcaccatacctggctaatttttatttttgcagagacaggttctcactatattgcccaggctggttttgaactcctagcttcaagtgatcctcaggcctcggcctcccaaagcaccgggattacaggcctgagccactgtgcctagcctcacagatctttaaattgtcttactaagttgtagggttctctataatttagctacaaatcctctgtcatatatgtattacaagtattttctccaagtctatggcttaccttttcattttcttaactgtctttcttagaaaaggttttaactttgatgaacatctaatttatcaggattttttaaatgcttaatgctttgtgtgacctaagaaaacctttgcctaccctaaggttgtaaagattttcttctattttttcatctaaaaattcataattttagcttttcagtttagatctataatctacttttttgaagcaattttgtctatcatatgaggcagaggttgaagatcatttttttcctcatacagatatccaactgttcaagtactttctgcttgtaaatggtatgttttaaattcctttcttgttgtcatatagaaataaaatcatcaggcaatcttgtttaattcactcaatattttgaatagtttataatcttttgaattttctacatatgtattcatatcatctgcaattaataactttcctatatttttttcctagtccttgtatcttttacttctttttttatttaaagattgccatttgggtaatattttaaaatgacagctctattgggatataattaatatattataaagttcacacttttaaagttgttgttagtatatttacagagttgtgtaaccatcaccactatttaattccagaacattttcatcactccaaaaaaaaaattgtaccaattagcagtcacttcccagccccaacctcagtctctagtacccattaatctaccttctgtctctatggatttgcttattctggccatttcatgtaagtggaatcatgcaatatgtggccccttggatctgcatgtcattctacagtagtcagcctctattcttttctctactcatttctgtctacatcatgtataggcaaccagaacaagagaagcagctactgaggcctttatgacaggaaattaggggtgtatgcagaagaaacagaacctgaaaagttggtagtctgacaacatctctcttccctaaccctggctttagtacccaggcagagatgggagaactggaatatttgctatcaaattctgctgttaagtactggtgagtttttgtgtgcctcataagttgttgtgtcttacatactagaataaattcagaagatctctctaactgggaaggtgaaacttacaagtatggtttcagaacttgcctcattatcactgccctttaggataatatagtttttaatgcaaatcaaggttagtttcttaggtggcatgacatcttcttgtaaccaaggaacaggagctggactcctatttatcttcatcagaatgcaacacttcctggatctaaagattagcactgtctgtgccatttgctttggctgttggtcccatttaggtctttcttgtatctttgatttctctctcttctcatcatgctcttatttttgtttatgttcttaaacttatggagcctatatacaatagctgtttttaaatcctgtcatttctagaactatttctactgatttattttttttcctatctgtggctcaaatattcctgcttcttcattcacagagtaattttttaatggatgctggatatatttttacattgtcaagttttagattttgttgtcttgctttaaagagtgttaggctttgatctggcaggcagtaaggttacttgaagatcagtgtaatcatcttaaagcttgttttactgcccttctagtatggatatagagtagtttttagcctaggactaatttagtcctacttctaaggtgtggcccttttaaggtctttactgaatgctccatattatgcaatgaggcctcttaatctggctggtggactgaataactctcaatcctgtaatctgaatgaatctcaatcccgtgtgagctctggaaattgttcttatagcctctgcatgtttattctttccccagcagttattcctagcttggcctcatagaattctgaattattcatgtgcaggctggtattcagcgaacacaattcctatgcagataggaactactctgtttaacttttttctctcagttaatctgtcccacaaattctagccacctgctctttgctttattatttcctttcttctacttttttatttctctccctacttttttagttccttttctaactctttgggatagatacttaactcgttaattttgaacctttattttcttcgaatatatgcaaataaaaatttaaatcccttttaagaatggctttagctgcacaggatatgatatgccatttttattatcattcagttcaaagtacttttcaatttccattgaaagttttcattgacccatggattattgagaggtatatctcttacaacaccatctatataaagtttaatacctagtaaagaagttataaattggttttgctgaaaaattttcaggctaggatgtagttaactttgagacagagggtgagaatagtgattactgggatgaagggtagtggggttatagagctcaaataatattctatttcttgatgtggtggcagtttcatgagtatatttattttgtgataatccatatacttatatactcactgaaaagtcaaaaaaatttcctggttatttttatacatgtgctttgccatatagacttaagtcattttacgtagtcaacagagttaactgaaactgcattatacatatacttgccttatattttttcataattgcattgctttcaaagttagctgtttcttccataaatcggcccactagtagcatagctcgaccatggattaacatgttcttaccctcaggtggggtttcattttcaggaaaacataattcaacacctttttgaagaacaattagtgcctggtgaacatcaccctaaaagaaaaaaggcaacaataagccttttaatttaaaaacatacttctattttctgcaaaagtattagttcattatgtttttgtacaaatccatttgtaatttcatgtttatcttttacttgcctcttattaaagtaaaattctaaaactgaaacattgcttcatctcattcattcatttactaattaattttataactgcagttggctctctgtagccacaggttccacatcaatggattcaaccaacagtggatagaaaatattaggaatggctgggcacagtggctcatctctgcaattccagtgcttttggatgccaaggcagggggactgcttggggccaggagtttgatactagcctgggcaacatagcaagatcctgtctctacaaaaaatttaaaaattacccaggtgtagtggctcatgcctataattccagctactcgggaggctgagggggaaggatcgcttgagcccaggaattcgcagttacagtgagctatgacacaccactgctctccagcctgggtgacagagcaagatcctctctcttaaaaaaaaaaaaagaaagctaggcatgatggcttatgcttatagcctttgatacaaagttcagggtgaggtgggaggattgcttgagagcaggagtccaaggcatcagtgagctatgatcatgccactgcactccagcctgggcaacagagcaagactctgtctctctcaaaacataaaaatttaaattaaaaaaaaaaagaaatattacaaagaaaaaattaaaaataatatgaataagcaatacaagtataacaactgtttacaaagcatttgcactgtattaggtattataagtagcctagagaagtatacaagaggatgtccgcaggttatatgcaaatactgtgtatgccactttatataaaggacttgagtatccacagattttgttatccatagagaatcctgggaccaatccctccatggatatcaagaaaggactataatcaaagttcagggaattgaagacaatcacaaacaaattaaaatccctgacataaaaaaagttcatagtcacatgagaaaagaaactatgtgaaataaaagcatatttgctaagtgttacaacagaggaatatacatcagcattatacaggatagagaagagagtcccttaaacctacctgaagaatataggaaaatggaggagaactacagtcaggaaaagttatcaacgaagaaaatttgaattaggttttcaagaatgagtagaaatcttcttggcagagaatttagtgaaaggcattctaggtagatggaataataattttaattggaagaaaagcacatagtctgattttagctgaagtttaaagggtttttgagatggtgatgaatgacactgaggaagtaggccaggacttgatcagaaagggatttgtgtagttcctagagttaggcttaatcctaaaggtatgaagaatactttgtaagatttaatctttttgaaggagcaacatgattcgatgtggattttagaaagatcacaaactgcaataacgtatacagggaaatggtgagatcctaaaatggttgttaatattgttagaggaagtaaataataaagtcataagttaaagcagtggaaataaataagagggagaggattcaagagatatttctaaggttgaagaacaaagatttagtctccagctggatgtgaaaagtgaggttgcagaaggaatttaagatgatgtccagatttctgtttttgatggaaggatggaataaagtcttgttcagagaagtaggaaacatgagaggagaaacagatattgagtattaggtaataaattgcattttgaacattttgagtttaaggtattataatacatagactaccactagctcaataaaatgaccaggtactgactaatgcacactgaataaattgctttcccctctcatccaggaaacctctcctgtcctttctcagccaccacaagttggtgtaaccacaaatggcaccaacaatagttgctaagtatcaattccagaacatgctattattattagtaatgcctattactaattctaaactggtgactagcctgaggagaaatttaagtaatagccattaaatctgggttattggccaggcgcggtggctcacgcctgtaatcccagcactttgggtggctgaggcaggtggatcatgaggtcaggagatcgagaccaccctggctaacacggtgaaaccccatctctactaaaaatacaaaaaattagccaggtgtggtggcacacacccgtagtcccagctactcaggaggctgaggcaggagaatcacttgaactcgggaggcagaggttgtagtgagcggagatcgtgccactgcactccagcctgggcaacagagtgagactccggttcaaaataaataaataaataaataaataaaaataaaaaataaatctgggtcataaaccttgcaagtagttccaatgtttaaaaaacccccttcttattactttggctttaatctgaggtctgccgtgaacttctgttcagatgctaggccctttctggctagatcagagctgaatatttacagtaacactggcaagtctacagagagctaattatctgccagcaactaagtgacagagttacattcatttaaccaacatttactgggtcactactatatacaccctgtatacatacataaggtgaaaaattaagaggtcgttttcctcaaggaaaatgtaagatagatgaaaactgaaaaaactccacattcagccttgaaatgggaaggtatctggggactgtagagtaaaaagaacaattacttccaggctatggtagataactaatgaagaaaagtgatagaaaaggaaggttcttaatttggattagttatgttctctcagttggccttttaaggaagtacataattcccgactatatatatatatatatatatatatatatatatatatatatatatatatatatatatatgatgacatttccctggccattaccttggaccagagccactttgccctttccacgtacagttcagcgagtcgtgattcccctgcattaaggagagcattgtaggctgtctggtggtgaccagcctttctagctaccctggcactctgcagccagcattctccaaccatttcattgtaatctggtctaaaggaagtaacaacacattggtgagagagaccattggtaagtgtacacaacaacttaacttaaaacaatttaaatctaggtcataaactttgcaagtagttccaatgttttgaaagcctctgttcccaatacagaaccttcttcatatactatttcaaaggaattaattattaatttgtttaaaaagccttgacttaacttttcttacagtgttctgttttacctattatgaaccttattcttgatttttatcagtaaaaaacatatcccccagatatgtttttaacatcttaaaaaagagaaagaaatggtgtctaaaagtgattcttaagttctaggttcctttcaaccagatagtgtagccctgatcattaaaaatagaaaaatgtagattcagacagaaaattaagaaatacaaacacccccaaataatatccaaataccaaattcaagataagtgacatttttaaaaaaagtagtgtgagaaaccttttgttgaggcttagtaaagccctccggagagccaggataggctccttggctctgtaggaattctgggtcatttctagtcgagctacccagtttagagaatcttcttgagaactgtcacctggagaatgctggaaaagtggtttgatgctatgctccaactcacataacatgtgcaatctgaagatagatagagcctatgttaaaatgttatcatattcagccttattaatctcatatataaagcaagtactttaaatcagaaataaagaatttaaaatacacagttgtctttggtagaactttaatatatccttgctaagtaaataattacatttatatcttttcaaactgaatgtaaacaccaatttatgctggtttatacatttggtgctttagccaggcatggtagcgtgcacctgtactccagctactcaggagactgaggcaggtggatcacttgaactcaggagttcaaggttgcagtgagctatgattatgcctgtgaatagccactgcactccagctcaggtgacatagcaagaccccgtcccttaaaataataaataaataaataaataaataaataaaattaattacattaaacttttaaaataaatatttagggatttgcagtgaatcccaaattcctaattaaactggagaatgatggataaaactaaattcaaatgtatgaaaccaaaatttaccacctaaatgaagataaaagaaaatatggatccattataaaccaacatgaggtatttgcatatattgctggtgctactataagagggcctggcatagcagatgatagtaaaaaattatgaaattaatgtagtttttttctaagagtgatggaaactttgatacattcacactagctttttcccccttgtatgatagtcagtgtctatgattcagtgttcaaggtacaaggatatagctgagtagctacagaacagaattaaactcagtggtccaatctctagtttcattaagatatcaccaaacgggttgatactaaatataatgaattcttctaacttaaaaaaacagtgctatgtagtaaatttcttataccttaattacaatatttagtttatcatttttcctcaggtagaattcatagacctaaaatgttttccaacattttcttcttcacctataaaagttaatattctttctagtaatgtgatgcctatatttttggggggaaatatcaaacacatttctaaatgaaaaggaaagggaaacaacaaataccaagcaccaatgtgccaggtgctatagatgtctatattatatttggttatatagaaagcaaactatgacattacaagaggacaaacataagatatttttattatgtttttcattagtctcatagttgcctttccttaaaaggatgtatgttagaattttaactgtagggtgattgtgaggtaaaaagaatgaaagagctgtctagtgtagctatgcatgaaaccaaactcactatcaattatttactcaaaaaaattttccaatcctgtcaggtgacatttataggccagaaatataaaaatggaaattccaaaatacctcacaatatattcatatcctcgttggtaggagcctctttcaaagcttgcagctgaaagaggtacaatttgttctgctctcactagtttcagtgagtcataaaaagctgtgatatctctttttttggctgataataatagctgtcccagtctgacactccatgttgtagattttccatctgaaaaacaaatgaagagtcaagaaatgtcacggtagctgggtccaagagtcagctttatttcattagataaaatggtcagctgaaatatcaaacaggtggcttcattcctttttttttttttgagacagagtctcactctgtggtccaggatagagggctatggcatgattatagctcactgcagccttgaacttctgggctccagtgatcctcccacctcagtctcctgagtaggtgaacaggcatgagccaccatgcccagctaagttttttaaaaaacatttttgcagagacagtctcagtattttgcccagactggtctagagctcttggcttcaagcaatcctcccaccttggcctcccaaaacactgagattacaggtgtgagccaccatgcccagcctggtttcattctactttgaacaactaaacaaggcaatcataaaacaggctaagatattaagtatgaatgttgctaagttacttaagtctgaatatttatgtcatattaaaaccgctttttttttttttctttgagatggagtctcactctgtcacccaggctggagtgcagtggcgcgatctcagctcactgcaacctccaactcccaggttcaagcaattctcctgcctcagcctcccgagtagttgggactacaggcgcgtgccaccacgcccagctaattttttgtatttttagtagagacggggtttcactgtgttagccaggatggtctcgatctcctgacctcatgatccgcccgcctcagccgcccaaagtgctgggattacaggcgtgagccaccgcacccatcctaaaactgcttatattttaagaagtaattttacctgctgccaaatagttttccaccaaatcccactgtgacaatttccaagctgcttccactctgtacgtgtttaattcatctgtccactcggacctattaaaagaaacccatatcaactaaactttaatttatttaaggtgacattcagagatttttcattggtttacatactctatttattatatttattgaatttgcattatattgtattttgttcttagatataaaataattatctctatccagaaactatccagaaaattttaatctttccatccttcaaaaatattttttcactaattacttctgatacaccatttaaaatgacattcttcaacaaattaaagtgtgccatatattagagcagagttaattcctgaataataactaagcccattgtaaaaatagctgcatgcttaatttgaacaaagagcaaggaagaaaaagagccaactgaacacacataaattcagaggtaagcaattccaataactcagaattctgaattaaatttaagacaaaaatacaggggggccagtggtataacttacggacagttgggaggtatctagaacaataccaagagcaaaagaaagttacaatgatttgtcaatggcataacaaagtatataaaactagctacgtaaaatatatacctatttttaaactactttcagttagtttaaaatttgagtttgcaaaaccagtatgatataggctaattattttgttctaagcattctacttaggtgacattaggatgaccagtgatatttgagatcatgactacacagaaaccgctaggctttcctcatgtttcttttttattaatcatactttctgaatttctgccatatgtttagatcctaggctaggtacaattttccatttaataatctaataacactgcatacagcacatatatatccatattataaataaagtaacagagaggctggaatcaatatcctcaaaagttttccttgctctttttattgtagtaaaaacacataaagaaaagacaacaagtgatctaacaagtttcatttttaaaaattctaaaaatagaagctagaggattccaatttctaaatttatgaccaccaccaaaaacagtttagaataaggctaaagaaatacaactgaaatgtaattttcaaaagtccaattttgaaggactttacaagcttaccatcagacaccaaaatataaaaatttcaggataaaaatctcagtagaattaggcagtatttgttatccaactgtgggataacagattatctatgggatatcagataacaaaggggatgtgtcacacgaagacttatagcaaaaagtacaaatggcaatcaggatcaggctgtgagaatgtatccacataaatgggtacattaaaaagaatgataaatagggcaggcacagtcaatattttaggaaaaatatttgtttaatgcaaacagaaattaccccaagaaaaacatgccccatccataatcatttgcttcaccatgacacagcaccccttcattgaatattgacgcatgcctttttcacaacccaaatcaggaggctctatgtatcccagacccaaagagaagaaaagaggagtctgaatgtgtagtctatgtcaaaaagaaatttgacaccccaatttgagccatgactctcccaaatccctgtaatctatttattcataaagtctctcaactaatctggagaaacatatccacaacatataagcattccttctttacttctgtaaaacttcccttgtgatttcataaattccactactgtgataccatctgaccaacagtgaacttctctgcccttagacattgtaaaatgatagtctttatgaatcacagttttggaacctatacaaacagtacttagaaaaggctggcttcagaatctataaaaagctcaaataaatcaacaagcaaaaaaacaaacaaccccattaaaaagtaggcaaaggacatgagcagacacttctcaaaagaagacatacaagcagccaacaagcatatgaaaacatgctcgtcgtcacaattatttgagaaatgaaaatcaaagccacaatgagataccacctcacactaatcagaatggctactattattattattattttgagacaaagtctccctctgctgcccaggctggagtgcagtggtgcaatctcagctcactgcaacctccatctcccaggttcaagcaattctcctgcctcagtctcccgagtagctgggattacagatgtgcaccatcacgcccagctaatttttgtattattttagtagagatggggttttaccatgttggccaggctggtcttgaactactggcctcaaatgatacacccgccttggcctcccagagtgctgcaattacaggcatgagccaccacacccagcccagaatggctattattaaaaagtcaaaaaagatgtagaaggggctgcagagaaaagagaatacttatacactgttggtgggaatataaattagttcagccactgtggaaggcggtttagagatttcccaaagaactgaaaatagaacacacagcaatcccattactgggtatattcccaaaggaaaataatccattctaccaaaaagatacatacactcgtatgttcattgcagcactattcataatagcaaagacatgaaatcaacctaagtgcccatcaatggtagatgggataaagaaaatgtggcacatatacacaatggaatactatgcagctataaaaaagaataaaatgggagctaaacattgggtacacatggacacaaaaatgggaacaatagacactgcagactacaaggggtgggggagggagggaggcaagagttgaaaaactatcttttgggtactatgctcactacctgggtgatgggttcaattgtatcctaaacctcagtatcacgtaatatgcccttgtcactaacttgcacatgtaccctcagaatctaaaataaaagttgaaaaaaaagagaaagaaaaacttggcttcagagtagtccaaaaacagtggcctgtataatctttgtttaactgagatcccattcccttttgaccagattttactgcccagaatagccatttagagtctggtgaataaatcaaggaatacagctgtcagctctcacagcaaagcagcttcaagagcagtgctaatctccacatttaatctccaaactggaagaactactcagccttaatgttttgccacatacatgtattattttttgtttaatttgattttctacaataaacccaccttctttaggaaaggaaggctgctttcacattcatcaatcatttagggtaaaatcaatgcacacagtctacagtggtattccgtaaatcagtcacaacctctagcacggaaaataagtggtactgatactgtaagcagagcatagatgccctttgaggcccaggaagtcccatctgagcctcaccaatagccagtgggttctagaagttccttgtgttaaagcaaatctaattcaaggatggctctttagacagaagctgttaagtggtagactgactatgaaaaacttgaggaaaaaaaaatgttggtgcttatctccaataccatgaaaacacataaaacatttattactctactaaacattaaattacccaattcactaactaaaaattctccattcagatgcaataacaaaagaaaatcattttataaaatattacctgttagcatgcactccattcacctgagtgataacagtagacagctgaccaagacctaacatggactttactacaccatgataatgaatgatctagaaatttaaaaatatttaaaatagcaattatcacttcaataatagcttggggaccaaaaacagtttaactgatattctttaaaaattactatttaccttattgcccttatttttttattattattattattttaattttttgtagagacagggtcttgccatgttgcccaggctggtctcaaactcctgggctcaagtgatcctcctgcctcagcctcccaaagtgctgggattacaggcatgagccaccatgcccagtcacacctttcttaatttaacaattgatttgcttacttacatggcaggacccccatcaatgtcctaacacatttaaagtaacataaataaatgtagacaacatagaaaatctcagattgaagttattatatttttcaatttggactactttttggttcacatccaatataaaaagtatctaatatctttgatattctgtttaaagattgtcatatttctcacataaacattcaagctcaaaggtcctgatgttttaaatatggatttcgggctttagcactaaaaagttaaagaggattatgtactatcctttaaaatgaaaagaagattgtgaaaaataaagaatttatatattgtgcttctgagaaacatgtcaaatatgacaaaaagcaatatcccaaaattagaaagaatctaaaggcaagattgtaaattaatgattctaaacccctttcccattccaatagacacacagcttattcccattactaactgtaactctgtgattctacaggaccattttagagacgtgcaggtgggtgagtaggtgtataaaatatgaaaatgtttctcaggctatggagaatccctagttctacaaactgatccatggcttacacttttaatagcaaactaaaattatatacattttagagttattaaatgaacattttaatacagatatactccataataaatcttattcatttaggggatttctaaagtcatataaatatagtattggaagggaccttttttttttttgagatagagtttcactcatgttgcccaggctggagtgcaatggtatgatcttggctcactgcaacctccacctcccgggttcaagcaattctcttgcctcagcctcccaagtagctgggattacaggcgctcgccaccacacccagctaattttttgtatttttggtagagacagggtttcactatgttggccaggctagtctcgaactcctgacctcggggaatccacccgtcttggtctcccaaagtgctgggattacaggcatgagccgccgcatccggcctggaaggaatttttaaaatcatctagtaaagtctctaattttatctgttaggaaactcaagcttagagagggttaaatattttccagacactcagtgacactgacagaaacagtattaaaactaaggtttcggctggatgtggtgtggtggcacacgcctgtaatcccagctactcgggaggctgaggcagaattgcttgagcccgggagacagaggttgcagtgagccaagatcatgccactgcactccagcctggccaacagagcgagactctgtctcaaaaacaaaacaaaacaaaacaaaaaaaactaaggtttccagagttcctattcagggctattttcattacagttgcctttcaattattatcttacctggtctggttctagctgaatagccctgtcataacaagcagtggcatccctcagcaagccaaggctttcatgttcaaggatctgttcttttagagatggttctgcctttctaattgcactgactccggccactccatcaggttcatgcatagcagcatacaatttctttgttcaatgattaaaaaacaatcaaaaacaagaaaaaaacacaactggaaataaaactataaaaccacctgtttatattgaaacagcaattttttgagaaatttttcctcaaagtaatagtaagcatttgtttcatggcaaagtcacagtaaaattataaacttatttccaggcattctattccctcaacattcttactccttttaaatacaaatctatatcaatagctgttattgatcataaggtttataaagaacctcaggatcctaaaactgtctagatccaaatgataacatattctgttgagtatagcttataagagttttattgaatttttaaatttttaaaaatgtaaataaccattttaatatattgttattgagatgacttcaagaaaaccaagacagcaatctgggctcaaaggagatattcaagctaaagataaaaatttaggaatcagttagcacaaagacagtctctcacaacatgagaaagaatgggatgatctaggaaatggataaagaagaaaagcagactgacgatagagattagagtttctacatttatcaagaaggaagagctggcaaatgaaacaggagaagtgagataacttggaagaaaactggagaataaaatatcccagaagccatgggagaaaagcaaatgatgtcttaatgagaaaggcatggtcaatgatactgaggttaagaaaatgagggctgggaaaaatttactggatttggtaacatgtggccaccaattttcttagcaagaatagtgtcaacagaaaagaaaaagagaagtcttgttgaaatgggcagagtgaatgagaaacaaagaagtgactgcagtataaagaaactagacaattccttcaaaaactggttgtgaagttccggaaacagagagatgggatgtatctaaaggagaaggtaggatttaccagagcatgtctatatgctccatatactctggttcccaaagagaaattaattacactagagaaagaaggaatatatgaagaagttacatcttgaaattgagaacacaagtagaaagattgaattttgacaggaagaaatccttccttaaaaataacagaagaagccaggcacagtggctcatgcctgtaatcccagcactttgagaggccaaggcaggcagatcacttgaggtcaggaggccagcccaggcaacatggaaaaccccgtctctacaaaaaatacaaaaaattagccaggtgtggtagcagcgcctgtggtcccagctgctcgggaggctgaggtgtgaggatcccttgagcctgggaggtggaggttgcagtgagccgagctcgtgccactgtactccagcctaggtgatagagcaagaccctatctcaaaataaataaataaataaaataacagaagggaagaaaaagaatatggtgcagatgctgtttcatttgcagatttttcctaatgaatcatgaagcaagattgtcagctggaagcagggaaacaaagtgaaggtaagagacagtcatcttgacaaaggggaaagtagccttactagagaaacacagccagcctgaaggtaatgttagagtcctgcagttttaaagatgtttgagatcatgaacttaaactgaaaccagttataacacccactgtgtaatttttctccagctgcttacatggttggagtttgacaaacggagtacaacacagtgggaaaaagacaagaagttgagcatcactctaagggaacgattttaaccatgaaccatagacttaaagctggacaaggaggaacacaaagataggaaggggctaatattcatcttaagactgcaagttactaattttctagttattttatcacactttgctttttgatttgaaaagcccaccaatcttgagctcttatttaattccactgtattcgcctcacctgctcttactttcttttcttccctacacaatcataacatcgcctaaatcattatttcaccagcattttcatgcttgatacctgacataaccggcacttgcccccactaactcactcccaaattcaggaccacaactctcacaaggagaagagtaattccttgaatcatagcccttccaaactcctcctccacaactgccacaggcatttagctaaaattccattgtgaccataacacttccctagttcgcaccctccaagaagtttgggcaacttaaaaagtcttctattatttgtgatctttcctctaccattccaaaaccgacactttactctttggcatataccatgctcttttcaaacactccacagagatgcctctgattataatgtcttgcctccctatactgctcattttttaagacaccatctccaagaagccattcctgacctctggctcatccgcttccatctcccaccctattccacatggatgagttaagtgtccttcctcagggtacatgtgtgttactgtacttaaaatattataccaaattgatgtttatctctccccactaatctataagcttctaagcatagcatataaaacattcaataaaatgaacaacataaacataaaagactggccacattaattttcattattaaattcactatattaacttcagacctgtaaaaatccaagatgttcctgaatattttgcttcttttctgtaataaatgattcaaagtgcattacagctcgtgtgtatgctttggagcgaaaggaagctactgccagagtatcctggggtatgaggtctagaaaacgggttacactctgatagtcttcataatccacagtagatactagatcataaaaaaagttgagtaattaaagacttataagataaaatttaaaagtgtcaatttaagtatttaagttcaatttatttcactaaacaaattaatctgaatatattaggatatcatatttagaatgtaactaacaacagaacaattgttcagagagtcttgctccaactctgccattataacttacctttctttggacagtcatttaatttactgagcctctatttctttacctataaaaggaaaatgttagtacctgtcttgccttccttacaacgttgttggtgaggattaaatatcaatctattattaaattttgaaaagatataatgatgatacaaaagatacaagattagtcattatttttgatgactataaaaaatgattaaatgtagctattttgtagggaaacttcaaaactatggaaataatcttttttaaagtttagaattcattgttatccacctattttttcttggttgccaaaaatacagtatcacctattacaatagaaattgaaagtaatggctgggcatgatggttcacgcctgtaatcccagcactttgggaggccgaggcaggcggatcacaaggttaggagatcgagaccatcccggctaacacggtgaaaccccgtctctactaaaaatacaaaaaaattagccgggcgtggtgacgggtgcctttagtcccagctactcggggggctgaggcaggagaatggcgtgaacctgggaggcggagcttgcagtgagctgagatcacgccactgcactccagcctgggtgacagagcgagactccgtatcaaaaaaaaaaaaaaaaagaaagaaattgaaagtaaaagtgccttcaaagtaaaaccacaagtactttaggataatttttcaagagtgtacaaaaagacaaaaattaaaaacttctaaatgaggacagtctagtttatgaattatttaaaacttctaaattttaatgattcataagtgtgtagaaaacaggcaacaaatttcttcaaaatttaaataaggcagtatattttatttttatttatttacttactttttaaaaaaaattattttgatctcattctcactgaggctgcagtgcagtggcaagatcatagctcactgcagccttcacctcctggacttaagtgatcctgcctcagcctcccgagtagctgggaccataggcatgtgccaccacgcctggccaagttttgtattttttgtaaagatgaagtctcattatgttgcacaggttgatcttgaactcctgagctcaagtgatcctcctgcctcggcctcccaaagtgctaggattacaggtgtgagctaccacacctagcctaaggtagtatattctaaacagattatatttaaaataaggtccttatttccatcaaaatttgtagatgatttcaaattctgattttttttttttttttttttttttttttggagacagggtctcactctgctgcccaggctggagtgcaggggtgtgatcttgtctcaccgtagcctcaatctcacaggctcaagcaatccccacacttcagccttgtgagtaacctaggactacaggtgcacaccaccacacccagctaatttttgtattttttgtagagatgggggtctctacaaaaatgttaaagaaatgttaaaggtattgtacttttgaatcattacaaatgttattcttaaaagctagaattttggccaggcacagtggctcacgtctgtaatcccagcactctgggaggccaaggcaggtggatcgcctgagcgcaggagtttgggaccaccctgggcagtgtggtgaaaccctgtctccattaaaatacaaaaaattagtcgggtatggtggcatgtgcctgtagccccagctactcaggaggctgaggcacaagaatcgcttaagcctgggaggtggaggttgcagtgagccaagatcatgccactgcactccagcttgggctatagagtgagactgtctcagaaaaaaaaaaaaaaaaaaagctactgtcactgaaaatggtgataatagagtgtttggttttacagtaccattttgacatgcagaaataaaaactaacaggctggttgtgctggctcacacctataattccaacactttgggagatcgaggcagatggactgcttgagcccaggagttagagaccagcctggccaacatggtgaagccccgtctctactaaaagtacaaaatattagctgggcatgaggcatgagaatcacttgaacccaggaggtggaagctgcagtgagccaagatcacaccactgcaactccagcctgggcaacagagagagacttagtctcaaaaaaagaaaaaaaaattaaaaaacaaacattcaatagttaaatataaaaatatattaatagccacattccagacaaaaacattctccaagcaggtaattattggcaagtccaggaaatttcagaaaaataataaactattttgcttaacaacaggaaagtatctgcttcaacagaacaagagggagatgctcacaaactgagaattatggaagtgaaggcctctttaaggactgttagatagtttttcaattagcctgaaagcctgaaggaaaaatacttgatgtctgtgagaacagctaaggtataaggccagattataaccatccacttattgccaagaatggaaaaaaaaaaaaggttcaaagaaagtaagaatatccattagtgtgtgatgaatataattcttctcatcaatgcttatatcatagggacaaattagcagttgtcatttttaaatcaagattcttcttagtgaaagttgtaatatcacaggaaaaaaacagtgcaaggtaagatagagcagggtgtagtgtagtaatgcatactaagcatatctggacagctggctagatatcaaacactactagagacaagaaaaataaataaataaaaatagcttctctttaggccatgaaataaataaaattaaaatctcccttgaaatttaaaacttaaatgtgaaaaagattacaaagaatattttccaagtgaagaatgacaaagaacagagtacacacatacacacacacacacacacaaaaactgaggaaacatataatatgttaacagggaggattaggttaataacaatattagcatctcatttatttcacattttataatttatctgttcatcatctcatttattcctcacaataatctcctaagggagataatattaaccccattttggccaggtgtggtggctcacacctgtaatcccagcactttgggaggctgaggtgggtggatctcttgaggccaggagttggagaccagcctggccaacatggtgaaaccccgtctctactaaaaatacaaaaattagctggccatggtggcacacacctgtaatcccagctactcgcaaagctgaggcaggagaactgcttgaacccaggaggtagaggttgcagtgagccaagatcctgtcactgcactccagcctgggcaacagagcaagactccatctcaaaaaaaaattaataaataaaaataaaaatattaaccccattttatacaaagaaaaaataaatatgtgccttgtcgaagtgagagtaagaagagagaaaggtcttattactataaattcactgttttttctcagtgaaaaggccacactattacccattttaaaaatacacaaaacagctgggtgcggtggctcatgcctgtaatcccagcactttgggaggccaaggcagatagatcacctgaggtcaggagttcgagaccagtctggccaatatggcaaaaccctgtctctactaaaaatacacgaaaaaattagctgggtgtggtggtgggcacctgtaatcccaactacttgggaggctgaggcaggagaattgcttgaacccgggaggcagagattgcagtgagccgaggtcacgccactgcactccagcctgggcaacaagagggaaactccatctccaaacaacaacaacaacaataaaaaacatgaagcaaggtattttttaagctagtgcttaaattatagaactgataaagggaagagctaattggtgaatagctaaaaaaaaaaaaaaaaaagaaacagaagtgataactcacccattgagtctaccttatttctgtttgatttgctgtgtggacatttctcagctttcagtgcctgaaatttgtgccttgcccactgtgtgagatggtcaagcatggagaacacagtctgtgtactgagttgacacagatcagatgcaatgtcttgggtatttatggtatgctgatcgtcatgctttagaactgccataatttctgcataaacctatgagaatcatttataattaataataatatctatataataccatttaactattatatgacatctaaagctaaccattctaaggcaaaaattttcaaaagaaaaaacacaattggccaggcatgttggcctgtaatcccagcactttgggaggctgaggcagcccaattgcctgaggtcaagaccagcctggtcaacatggtgaaaccctgtctatactaaaaatacaaaaaaattagccaggcatggtggcacatgtgtgtaatcccagctactcagaaggctgaggcaggagaatcacttgaacctgggaggtggaggttgcagtgagccaagagcatcactgcaccccaacctgggcaacaaagggaggctctgtctcaaaaaaagaaaaggaaaacacaattgatcaataatacattcctctattgttcttatctataattaaatcaatccaaatattagtctaaaaagaaaatatgttaacgactaaagaaaattttaaaaattttaaaatattctagattattcaataaatgataatgaaactttgttaacagtgaaaaaaacttacagtaatatttcacactatatgcaaaattaagttcagagtaattgaagactaaatataaaaacagaaggattaaaagaaaatatagcaaataagttcatgacattagatgaggcatcacataaaaggtttaaaattaataatctataaaagatgtataaattttgcatttacatttaaaatttctgcgtggcaaaatgtgaaaaggttaaaaagaaaatgactaagttggaataatttttgaaaatatgactggcaacaaattggtagctagaatatacatagaacgtctatcaattaaagggatacacacaccaaacaggcaaagatatgtaaatgaacatacatagccatacataggtctacatttcctactaataggtagcctttctaatactaattacattggagaaagtaagtttcacatgttcaaaaaccaagtaagatgatttatctcacctcctgctgatcttcttgattacaacccagtaagacatacaccagaatatgtggaagaagatagatggtcactttgaaatcatgcttcatcataatgctacagcaggtgaaaattttactggcaagatcatgtcgaacctgtaaatgcaaaatgtgtagacagtaacacactttcacatattgattaaatgtcaaagagtagcatgtgagataatttatcacaaacgagtattcatttttaaatttaaaaagttttttaattaattttttaattaaattatttggggttaaagtcaaattttgttatgacttaacttttgatttgctaacactgttgaactcataaaattttaaagagattttttcttcaaatacaaagccaaaaaacaaaaaaaaacccataatattccagagctgaaaatagttaacagtattccacatttcacacattatattttcagtatattcattaaaaaaagaaaatgtcagccgggcatggtggctcacgcctgtaatcccagcactttgggaggccaaggtgggaggatcacgaggtcaagagatcgagaccatcctggccaacatggtgaaacccagtctctacaaaaaaaacacacacaaaaattagctggtatggtggcgggtgcctgtagttccagatactcgggaggctgaggcaggagaaccacttaaacccgggaggcggaggttgcagtgagccgagactgcactccagcctgagtgacagagcgagattccgtctcaaaaaaaaagaaaatgtcttgaagttactaactacgaattagtataatgatattttaaaacactaacagaaatgttaattaaaggtggggcacggtggctcacgcctgtaataccagtactttgaggggcagaggcgggcagatcacctgaggtcaggagatcgagaccatcctggctaacacggtgaaaccccgtctctactaaaaaaatacaaaaaaattagccgggcgtggtggtgggcacctgtaatcccagccacttgggaggctgaggcaggagaatggcatgaacccgggaggcggagcttgcagtgagctgagatcgcgccactgcactccagcctgggcgacagagtgagactctgtctcgaaaaaaaaaaaaaaatacaaagattagccgggtgtgatgactcatgcctgtaatcccagctactcaggaggctgaggcgggagaatcacttgaacccggtaggcggagacttacagtgagccgagatcgcaccactgcactccggctgggtggcaagagcaagactccgtcacaaaaaaaaaaaaaaaaaaaaagaaaggtaaattaaaaacaaaaattgtaaattttaaatatactgtaaacattttcttggaacacagagtaccttttgtctatccagcatgtaaaaatttctcattaaggaaatagaaatatacctgtttttctatgaaaattcattgtaaaaatctttatttttattttagagaaagttcagataatataacttcttttagaaatgctattagagtataatatatctctttattgaatgtctttttattatgtaaaaaactctgacatagcatttacatccttttacatagtattattttacaatataaaaggaataaatgtaattttacacacacattaagaccatagtaattttcttggtaaaacaattacttttcactcagaagctattattagtaactacagagaaattattattctctattagttaacattttcttcaaaaatttctatgattatcagcacaaatacttcaatgattattgtgtgtgctaggcattcagatagatgttctggtttcctttagaatttccattcagttaacaaactgaacagggtttcttacctttgtaataagataacctgcccaagatgctgaccattctgcaaagttactacccaatttacttaagtaaattggcttctttactccagaccaatcggttgacttctgagaactcttgtatctgtaattttgaaaatttgtttattaaaaagataaatccacctgtttagaattttagtaaattacagcaactccttcagttgactacctcagtactgccttgcctttactgcaatctgcttacctttttccagtatccttcttaggggtgaagtaggtcattcttggacacctaaagtacttctaaggatttgagtctgccccctcctcttcctcagatccttccaactctcttcttatataagaaaaacctgttcctttgaagttcaagccacccaggtatactaccattttctactcctcattatgggtaactatgcaacacactgattaccaaactcattgataactttagaacactgctcagggttttctttcttcccagtgttattatcatcctgggtgacttcagtgtctagctggagcacttaatcaagctcagaagtttccaatgactttcttctctacttatcagggctcaggaattatcagggctcccatgctaattcaaagaatttcttcactttgaaatcaattatttagacatctcattgtatggtcatagtttcctaaatttccagttttttcacccagttattccagcacacccattctctcttgttgagatcttctgttccgtgaccctgctaagctctcctgatctatgacacccctgtctctttgcctctttccacaaccatcttagtctgtatggtccttcacttctagcattctcttggtaatatcctctacccactccattgccacactgtcttttccagcggtattcatctgctaacctcccaaccttgaatcagtctaaatatttgtctttactgaaatgatactcaggctactgcactgatacaggaaaatcactaacccacttataagattagtactactatgtattcttagtcttcaaagtcagtgggccgctaaagttacagaattccttctacgttttcattattggctctcttctgttttccagtgattatttcaaaccatcaccaccctcctaaagtcacctacaccaactccattgccactttcagccaatgaggtcatctcctatacctcctacttcacagagtaaaaacaaaatcattgcttcccgcaatgaaatctgtaaacttagctgtgttccatccattattttatctttccctattgcaaaaaaagagatctattccttctaagtataattccctataagggccacggctctcccattccggatgctccttggggtccttactacaccaactatcacttctctctcacattacttcaacatgaccctttctatttgttcctcagcattaacatttaaacatgttcacacagctctcatcttacggctacctgtgtgtaggatttttttgaatggcatgggtttctttcaaatcaccaataaaagcttaggaaataacaaatgccctatacccaaagtcttatacccaaataatatatatatatatatatatatacatatttcactgtattccaagtttctaacagttgaaaaatccaataatctctcagttaaccatcacactaaaccaggagaaaaaattcaaatccctattttgaatcatcacgcgtatagttctctggatgatttttatcaaatttatagtaaacttagctagaaaactactgatactgggatacaagccaggctctgcctagtcataacctgatgttttctcctaaagttatttctatggtgattttgaactgcagttgttctatctggttctaaatttcagtctcccaaatacagccatcctttaatccagatttagtgattatatataaagagcccaaattaaaaaaaaaaaaaacataaagtagggagtataacttaaaggcagcaaaaatatgaatatgcttttaagaaattccatatttccctaggtcctctggagtaaatatcaagcagtccaagctataaaattgagctacaggctaacctggtattttagtttttcatacaaaagggaatcaacgctattgaaaacgcactctatcaacctcttaattttatgtggctccaatttcaataagcagatcccaactaggtaaatctcctaacttccatcattgaggaaccattcgagaggttattctaactgctcaggtataaaagctaaagaccaaaagaatttccattgctttgttaagatctacttttaaaagaccacttaaaagttgcttcctatgaaaaacatgacaagtaggcagaaatgttggcttctacttcttatgaagtatatgatagccaacctcacaaattctccccccaaaaacaaagaacttattaagcaagctaggattgaataagcatttattattgagtgtcaactaaatatcaggcactttgctaagtacttttaatattatctcctttattcctaacaataatcatacaaagtgggtaaaattatccatgttttcaaaattaaaaaattaaaacctggaaatgttaaataacttgcccaagacttcagagctagcaaatgcaaagccaacaatcaaacctaagcctgtgtgactacaaaggtcataaactttccagtagattacagaaattctttgacatctacaggtgctatacaaaatacagactaagaaaatgggggaagtatggagtcctcaaaaatgaaaatccaaattttaactttagtctttaactttactttttaaataatgctaatagtggccaggtgtgatggctcatgcctgcaatcccagcactttgggaagcccagacaggcagatcacttaaggccaggagaccagcctggccaatatgatgaaacttcatctctactaaaaatacaaaaagtagccaggcatggcggtgcacgcctgtaatcccagctacttgggagactgaggcaggagaatcacttgaacccaggaggtagaggctgcagtgagctgataccgcatcactgcactccagcctgggcaacagagtgagactctgtctcaaaaataataataataacagtaataattcttctttaataaggctaataataataatgctaaataatcacttctttaataatgctagtcataagacataaaatgatgtttaaaagatttctaagtataaaaaattatctaggaaataaatatgcatacctctgggcttttataaagactgttagtataagtctaggcactttctaaggttcaaagaagttatttgtccaaagtcaagtatctaatatgcatgtgtacctagggtaccaaaaagtagtttctaaatagaaataatttatagttgtatggatttttttcatataaaatgcttcatgtatttgcatgtcatcttgcatatttcgtcagtcctaacaaagtcatttaaattttttaagagattaaatacatttttttaaaagcagagggtgaaaatatattcatgaggagaaattgggagtaatgaaaatctttaattgggcctactaaaggctttctgactagctttaaactttaaatttctgtattacttatacctatcaaagaattcaactcacattcagcttaaagtatattctttcaatttactaccgaccattgaacttttaaaaaaatcaatccttttaacttcaataaatttatctgaatatttaaagttgtagaatttaacccaatgagcagactgcacttctcatctagacaaattataagcataaatcatagtgaaaaatatacatgaggagatactaaaacacttttaatgttaaaaaactatatcaaaaatcacattaatttttttttttttttccaaacaaagtctcgctctgtcacccaggctgtagtgcaatggcacaatctcggctcactgcaacctctgcctcctgggttcaagtgattctcctgccccagcctcccaagtagctgggattacagatgtgcaccaccacgcccggctaatttttgtatttttagtagagatggcgtttcaccatgttggtcaggctgatctcgaactcctgacctcgtgatccgcccgcctcagcctcccaaagtgctgggattacaggcgtgagccactgcacccggccaaaaaaatcgcattatttttatataattaaaaacaattttatgaaaatacattaaataagcctacatacctggtatttagatgaggttctagtatttcccgaacatgctcaggaaatctcctccacaattggtgacctgggccgttggtctccatctctctacagtcataaatagaaagcaactcctacaaatacatattttacatttgtaagtccacagtgaagcagataacgctttatattcgtcaatgttctacatatcttagttataaaaatacagccataactcattttattgcacttcgctttatttatgcttcatggatgctgttttttttgtctgtttgtttttttagaaatagaaggtttgtggccactatgcatgcagtaaatctatcagtgccattttcccaacaacatatgctcacttcatgtctctatgtcgcatttcggtaattctcaaaatatttcaaactttttcattattactatatctgttatagtgatatatgatcagtgatctttgatgttactgttgtaattgctttggggctccacaaactgtgcccatataagacagtgaacctaatcgataaatgtggtgtgtgttctgaccagccgttccatccccctcactctctttgggacttcatatttccaaagacataagaatattgaaattaggccaattaatgaccctacagtggcctctaagtatacatatgaaaggaggaatcgcacatctctcactttaaatcaaaagctagaaatgactaagcctagtgaagaaggcatgtcaaaaacctagacaagccaaaagctaggtgtcttgcacctaacagccaagtataaatgcaaagaaaaagttcttgaaggaaattaaaagtgttactccaatgaatacatcaaatataagaaagagaaacagtcttatttctgatatagagaaagttttagtggtctggataaaagatcaaactagccacaacattcccttaagccaaagcctaatccaaagaaaagccctagttctctccaattctatgaaatctgagagaggagaataagttgcagaaaaaaagtttgaagtgatacaactcaaggggcgcttcttaaaaaacaaaaaaaaacccaaaaagtttgaagcaaacagaggttgcttcatgaggtttaaggaaaagaagctgtctctataacataaaagtgtaaggtgaagaagcaactattgatagagaagctgcagcaagttatccagaagatctagctaaaatcattctattctgttggaagaagatgctatccaggactttcacagctagagaggagaagtcaatgcctggcttcaaagcttcaaaggacaggttaataactctcttgttaagggctaatgcaattggtgactttaaattgaagccaatgctcattgacgattccatacatcctagggctgttaggaattaggctaaatctaaatatatgcgtctactatatacccataaaaattgaaaattagaacaataaaagtaaaaaaaatttaaaaataaaaaattatgtgaaatctactctgcctgtgctctataaatgcagcaacaaagcctgaatgacaacacatctgtttacagcatggtttactgaatattttaagctcactgttgagacctactggtcacaataaaagattcctttccaaatattactgctcattgacaatgtacctgtcacctgggagctctgatggagctatacaaggatattaatgttgttttcgtgcctgctaacacaacatccattttgcagcccgtgtatcaaggggtaattttgactttcaagttttattacttaagaaatacattttataaggttatagcggccacagatagtaattcctctgatggatctgggcagagtaaactgaaaaccttctggaaagaattcactattctagatatcattaagaacgttcatgattcatgagaagtcaaaatatctatcaacattaacaggagtttgaaagaagttgattccaacccctcctggataactctgagaggctcaaaatttcagtggaggaagtaactagagatgtgataaaaacagcaagaaaactagagttagaagtggagcctgaagataggactgaattactgccttctcatgataaaacctgaatggacgaggagttgctttttataagcaaagaaagtggtttctggagatggaatctactgtggttccactcaaaatgctgtgaacactgttcaggtgacaacgaaggatttagaacattacataaacttagttgattaagcagtggcaaggtttgagaggactcattcaaattttgaaagaagttctactgtggggaaaatggtatcaaacagcatcacaggctacagagaaacctttcatgaaaggcaactgatgtggcaaacttcgttgtctgatttttttaagaaattgccacagccattccaaccttcagcaaccaccacggtaattaatcagcatcatcaacattgaggcaaaatcttccaccagcaaaaccattatgacttgcgaaggctcagaagatggttagcattttttagtaacaaagtattttttaaataaaggcatttacattggtttttagacataatgctattgcacacctgacagactatagtatagtgtaaacataatgttaatatgcactgggaaactgaagaattcatgtaacttgctttatagagatacttgctttattgtggtggtctggaactgaacccctactatctctgagttatgcttgtacatagaaaaataaacagaattttatagttttagagctgtgaacatccttaggacatttatttcaatgcctagaatgatttaagtaactcatttaagtcacaaagctgaggcagtagtatatatttgtatatacatacaaaaattttgaaagtaactatacctataataattggttaagaggtatgcttctgtactctaaaatgtttatcatgaacttgtataactttgataaaagtgagaattaaaacaaaaaggagtttcacaagtatagaatttacaacgttcttatttgaattaaacaatttaaagccagtaatgactatatccactcttacctgaatggcataggcagctgaatcttgagctcggctattatcagcatacgcaaggtaagctcttgttagctccatcaataatccataggcaaagcttgaatcttctactccagtctcaatcagaaaaaaaaaaaagaaaattccaggataactgctataaattttcttaggtgtactgctttttccatggtgaatttaacttaactgcgtaagtgaatttaacttagacaaaggaaaagacagtgaggttcaaactaagtttggtatcaagactacaatataatctgtagctaaaaagccaaaatgtaaagctttttaggctatttctaaggtgtacaaaaaattattcaacttttgcatatctctgacaatttgcattgtttgttttttaacccttaaaaagcaaaatgtaggccaggcatggtggctaatggctctaattccagcattctgggaggccaaggagagcggatcatgaggtcaggagttcaagaccagactggccaatatggtgaaagcccatctctactaaaaatacaaaaattagccaggcgtggtggtgcacgcctgtaatcccagctactcgggaggctgaggcaggacaatcgcttgaatccaggaggcagaggttgcagtaagccaagatcgcaccactgcactccagcctgggtgacagagcgagactccgtccaaaaaaaaacacaaaatgtatacatagcatctcctacgttgcattctgtagagcccaagagtcatctgagaacctctaaggaataattttaatatacgcatatagtataactcttggagatatagtcttagagattcacaatgcacacagatacattaaaagtcacattttttttaaaaggtcacatttaattttgttctatatggagttcccaaactcatttgactacaaaacattactactgtaatatcctggaaactagttatccatggaaacactagcaataatgtttaaaaagtaatatttaaataattgattaggctttaagtattgtcattattatattaggaagctttatttacaagaatataacaccctagatggggttcaaactttattgcttttggctaaaggtttctgcaatagtaaaagaaataaactcagaagttaactgattgtctggttctaggtgaagcttttattaaggataagctgaatagttctttgtaaatgaaatatataaacctcaataggacagagaactcttttgtcattccaaatttccactacttaccacaaatgtaaaatcttttccttgagtttcagttgttgagaaatctaatcgacctggatctatcgcccccaattcccctaaacattccccacagagcaaccgagcttgagagtttgcatcttggcaacctttcaaaagcactgtcaccaactgtgagataataggttctactgtttcactgtctgttgcatactttatcagtttttcctaaaataaaagtagaaagaaaatttatacgtaatttctacaaactagtatgttttcctgagctaggaagcttaaaaatattaaggaatatctaacataaatattgacaaaattaaatttctgtatctgcaattttttcagctagtttttgatgagttcacataatatagttcaacaatatgtcctgtacaattagaatcattaaatgtctgaaagtctttgatcattaatccattaaacaagcagttactgtgcattttatcaatatacaaaaaatcagtaaaacaagtcttaacaagttcacagtctaagaggaaaacagacaaataactaaaatatcatatgatatgtacaataacaaatatacttgtacggcaaagaagcaatgaataagaaaaaacacagagtaacttttaaaggacagtggacagatatttcagtagataagtggaggagcaactattaggttaaaacaagaagtttgaaaagtgtataacaactagtaaagaaggaaaaaagatataaaaaagggttctgtgaggatggaaaagagggaggaagaaagaggtagcctaatgataaatatgtcaattcaaatagtcttttttcagctatctcttcaggatgctgtaatgaataaaatgttaagtaagaagaaacaattctcaagccagtgaagatttagaccttgcacttgtgtgatcactttaaagctacttcatttatattattttctttctagcacaagtcaagtgtataggagcatctcaaactccatgttagaactgtaatgagtaatacaaattactgtaatacatttcaaaagaaaaacgaaaagacatttaatcttatccagaatcttcaatagctgatttcttaaataacattacaggttaattcagctgtaaagaccgcctccccacccccacacatacacaccctggtaatcagttaaaagtaaaactcagataagaagtgtcactttttatcatatactaaatgtccatatgtacttgggtctatttctagacctcctattgtttcccactggtctggttattcatatactagttacctctttgttataactgtagtggctacaaagtatattaatgtttggttgggctactatattctcataacctttttttttacagggggagtttactagctattttttacatgttttatttttccatatgagcattattataaacctcctacagttaaaaaaaaaacaactttggtgacattttcattgggattgcattccattaattaacctaaggagaactgaaatcgttataacatcaacctacccaataataagggattgatatagcttaggtatctgtccattccaaatctcatattgaaatgtgacccccagtgttggaggtgagatctggtggcaggtgtttgggtcacatgggtggatccctcatgaatggcttggtgccatccctgtgataataagtgagttctttctctattagttcaggtgtgagctggactccattagttcaagtgataactggttatttgagagtatggcactcctcccattgctttcttgctccctctctcaccatgtgatatgccaactccccttcccctttggctatgagtaaaggctcaggcttgctgaaaccctcaccagaagcagatgctggcaccatgcttcttgtataggttgcagaaccataagccaaataaacctcttctttttaataaattacccagcctcagggtaatttactataattcctttacagcaaagcaaacagactaaaacagtgatggtttccatttagttaaatctattacccttttgtgtctttcagaagcattttaaaatttttcttttgttggtgtatgcatttcttgttaagtttatactcaactatattgttttcctgttgctattgtaaatggggtattccaaaaaaatttctacctagttaccacttgtcatatgaaaattattaatttttatgttaattttatatcccctattttactgaattcatctgtggtcaagttagttttatcagtaattctctataatttccgaagtatattagcataagaaatggagataattttacatcttttccaattcttatgtctctgattatcatatcatctgtaaatatagttttacatcttttccaacttttatgtctgattgcttttttccctaaattccttagccaatacctccaagtgaacgctaaatagtgcagataataggaaaccttgctttcagtgggaatgtttcttgtttcccattaagtatgtgtatatatgtactatgtatatatatacatagtacatatataaacatgcatacatatatgtacacatatacattaagataatattcatcaatttctgttttcttgagtgttttcatttgaagtaggtgatgaaatgtgtcaaagtctattcggcatctatggaaataatagcatgattttctctttagatctattaatatagtgaattacattcgtggattgctaagtattaaccatctttgcaatactggaataaaatgcaactggtcatggggtattgtgggtttgtttttgtttttttttttttgagacagggtcccgctctgttgccctggctggaatgcagtggcatgatcttggctcactgcagcctcaaactccccaggccaaggtgatcctcccacctcaacctccaagtagcttggactttaggcatgtgccaccatgcctggctaatttttgtattttttgtagagatggggtcttgctatattgctcaggctggtctcgaacccttgggctcaagcaatccatctgccttggcctcccaaagtgttgggattacaggcatgagccactacacccagcatggggtgttttcttaatgtgaaattgatttgtttgataatatttcatttataaatttttacactgatattaatatgataatctttaattttttgtttcatgctatcttttttcggtctactgaacactgttatatattgccgcttttttaaaaatggaagttttctttcatttcctatactccaggacaatttaaacaccactgagactatttagtttgtgaaaatttgatttaaaaatccccttatctgggcctggtgctttcctatggatgaagttcttttataatattctctatttctcctacagaaactaatcttttaagctttctatttcagctagagttcattttgatacactatatattccaggaaaagtatacatgtttacaaatttatttgtgtaaaagggtacaaagtagtctcttgtgatttttaaataccttctatgtttcaacagtttattatttacatatttgacatttaccaatttcgctagttttttgctagcatttttactcattaattaattttactgctttctgttctctatatttctgcttttatttttattattttcttcctgtactatcttttcttaaatagttttaataaaatatttgtttcacatactataaaattaactcttctaaggtgtacaaatgaatggtctttagtatattcacaagttttagtataatgaagtatatcacaagtgcaaccatcacttctatttaatttcagaacatttttaccatctcaaaaggaatctgtacccatcagcaatcactccccatttcccccaaacctcctaaccctaggcaaccattaatctactttctatctctatggatctgtttattcaagaataccaaaggttgccagcaaaccaccagaagctctcaaaaggaaccaaccctgccaccaccttgatctcaaacttctagcccatgggagctgtgagacaataaatttctgtttctgttgtttaaagtcattcagtttgtagtactttgttatagcagccctagcaaactaacacaaagatccaactaatacaataatcaatttttatgaatgttctatctgctctttaaagtatgcttctattatcaaggtgtaacgtctgacatatattcacaatagctactttattatgttatttagatcttctacgtatttatctactaacttattttatactgagaataacatggtagtctcctctgattgagtttctatatatatcttcttaagcttcttattttggctttatcaaggtggctggtgtgttatttggagcatattcataactattaaatcttccttatgaattatggcattaagcattaaaaagtatccattttggtcatatttaatgcttttcagcttcagttctattttgtttggtggcagaatgagaattcctgctttcttatactttccacttatctggataatttttgcttatccctttatttttggcctttctgaatcactttaggtacgtatcttgcatgtggtagagagttgtttcttactttgtaagccaatttgtaaattttttaattttaaggttgttcacacttattaatgtgactcagatgcttggctacaattctgtcagattttttattataatacaatggattataattataatacagtatactataattagtgctttcttccctctatcctgtttcgtgtttaaaaaatcatttatttgggtaaggatgacagtttatacttttgttctggaattatcatatatatatatatatatatatatattttttttttttttttttttttgaggcagagtctcactgtgtcacccaggctggagtgcagtggcgcaatctcggctcactgcaacctctgcctcccgggttcaagcgattctcctgcttcagcctcctgagcagctgggattacaggtgcgccatcatgcctggttaatttttgtatttttagtagagacagcgtttcaccatgttggtcaggctggtcttgaactcctgacctcgtgatctgcctgccttggcctcccaaagtgctgggattacaggcgtgagctaccgtgcccagcctatccaatatattaatacctttaatattaattaaaggtgaaatattatttaccttaaaggtaaaataaaaattaaggtaattttttgaaatacctacactccctcttttccttatttgactttctataactagtttgccggtgtaaaatggtatattttgacttccagttattgcctatgcaacaattactgagcttatcttacttactccttactctcccccttctctcatttaaaaaaattgcattatttctagtttattagaatataacatttacatataattatcccacacttgccctattgttgttttagtcttatatatttcgttaaatacataaacagtaaccatcagaccttttgccaaagtctgcccagtcatctcttgacttaatgaagctcatcctctaatacatctcttaggaagggatcacttgtgaaaaccatattacttcaattcttgtaggtttaaaaccgtgttctcatacatgatactctaaggacagcttgactctttcttgactcatactttatgacattttttgacattttaaaaaaatgctgctattttctaggcccactctgtacattcctactgagaattctgataccaatctacttttttttctccttgcaagtaattttttgaaaaaaaattttttggccaggaagctttgaagactttttattattaaagtctaggatatgtctcagagttaattatcctgggtcaattttctccaggatacaagtcttttcaatatgtagattaggtcttttatttccagaaagctttcttggattataattttaaatattaattctgttctcttgttttggttttattcttcagagacatcaattatttgcaggtgaaatctttgccaatcttccatttcaactactttttctttttactcctttttactcctttatctattttactcctttatctcatttttcttctgttttttatacctttattcaatgccccttgctaaatgtttagtcaaatatattctcccctgtagttcttgtaatttaatcttcatttcaatttctttcctaagttcaatcaccctcgtttcatcttggtttttatttctcttgttttttaaatttttcatgcaactttttttatatctgaaaatgattgtttaaaatattcaattaaagttatactgctaagttcaatcttcttccatgttatggttggttttgaggaggaactgtcatcaattcacagactttattttcattttctatttttgtcttacaggaaccttgcatacatatattttttctacacatattgtgaaatttctaaactagaaaaccctccataacagctatctgcagtaagcattctgtagtggcttcaggatttctctttcatgagtatccacgtcagcatagtgaagtgcagttttcttcatgaatagcttttttttctttttctggtagcagggggaggatttggttcatctctgattttgtacatttcttttacttctgcaggacccttaaaattctccctcttactttcttctttctgtttatgccatagtctctgaagagtgcctctcctctcctcttcttttactactcccaagaaactgattttcagagactacaaacgttgggcatactttcaagtaccttccctgtagccagtagtctgacataccacatcctggacttattttcagtaatgttgcacttaagagtatgactctctttctgttggtgattttctctttgctccatcaattcttagttcctattcttcattttcttctttttttatacagtctcatcagaacgtacccgctctcaacaccatacaaggttaagatatgagctccacagatatctctgttagttacaagtaatttgaagttcataatattctgtctcaaagttctgttgaaggtgtaaattatgtgtggtttcaattgctctgcttgacactctttatgatatttcaggggctacacagaaattcagatgtaggcatccaccattatcctaagacaacctgaaagtctctagcagttttattttattttattttattttatttttattattatactttaagttttagggtacttgtacacaacgtgcaggtttgttacatatgtatacatgtgccatgttggtgtgctgcacccattaactcgtcatttaacattaggtatatctcctaatgctatccctcccccagcccctcaccccacaacaggccccagtgtgtgatgttccccttcctgtgtccatgtgttctcattgttcaattcccaccaatgagtgagaacatgcggtgtttcgttttttgtccttgaaatagtttgctgagaatgatggtttccagcttcatccatgtccctacaaaggacatgaactcatccttttttatggctgcatagtattccatggggtatatgtgccacattttcttaattcagtctatcattcttggacatttgggttggttccaagtctttgctattgtgaatagtgctgcaataaacatatgtgtgcatgtgtctttatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttccccacatcctctccagcacctgttgtttcctgactttttaatgatcaccattctaactggtgtgagatggtatctcattgtggttttgatttgcatttctctgatggccagtgaggatgagcattttttcatgtgttttttggctgcataaatgtcttcttttgagaagtgccctgcttcggctcatgctcggtgggctgcacccactgtcctgcacccactgtctgacactccccagtgagatgaacccggtacctcagttggaaatgcagaaatcacccatcttctgcgtcactcacgctgggagctgtagactggagctgttcctatttggccatcttggctccacctcccagttttattttcaatagcctcttctcttatgtgtaaacgttagtaaatgtcattttattagaattctgcattgccataaaagtttattttggcttcttacaaagttatctttttgggattttatcaaatggattcctgactagtatcaatcttcagaaaccaattatatggtttcttaatttgatctctagtctgacttttctacatagaaatcattttctgccatccactgagcttagaagtcttctattccttcaaaaatatatattcctccttaaaaataagtagaaggtgtcatctcttcaatgtcaatgactgtctgggactacccatcagtacagggcttttgcagggtcattccataaaaaatagttaagtatctaatgctataccagcgatcatcttattaactttcctatcaccacctcttggaatttgctttgttgctacattacacccaatcatttgtttagccactcctaccacaacttcaggtgtatttttaaataaaaacctcctttcaatccactcttaaagtatcttttcctctccctgtggctaaattttaaattctaaaacagaatcttttgcatctgttgtctcatggactcttaagagtactgactacaaagactctggcctctcatcctcttatcttatgccagtttcatgctctggtggtattcctgtaggttcaaccaacttgtagagctgcactgtccaatacaatagctactatccacatgtggctatttaaatttaaattaggccaggtagagtggctcacacctgtaataccagtactcccagaggcccaggcaaggggactgcatgaggccaggagttcaagaccagcctgggcaacatagcaagaccccatctcttaaaaaaaaaaattaggtgagcatggtggcacacacctgtaatcttagctactcaggaggctgaagtgggagaattgcttgagcccaggagtttcaggctgcagggagctatcatcacacccctgtactggagagaccctgcctctaaaagtaaataagtaaataaatttaaattagcaaaattaaatagaattaaaaattctgttactcagaacataatgtttgagcatatatttcaagtgctcaagagagccacatgtggctagtggctactgctgaagagtatagatatagaatattttcatcctcacagaaaggtcctttggacagtactattggaagtcttaattcaattgtattcaactttaatgctatcttcttgccacagttgggaaaaaacccatttccttctctctttattcctaggtgttttgggccagtgcctgctggagtatggttaggaagacgtgtttctggatctttattcttttcttacctcctcatggatcttccaatcttccttgcctttagtttttcttaccagcctgccataaatttatccagttatagatgctaaactacattaaatacttactttaaaaaaatcccataataatatacggctattatatcttaatcagagtactcaagactcctacaagtacacttcccttcttattctgtctaggtaatctattagcattggggctttacattgaaggaatcctgtaaggaagttgccacatatgatttatcttctgtgatccaggaggcaaagtgaggcagctgcagctttccttaagactgtaagaaatcttcttgaattctcagatttagttatttatatctaggaagtgatgattgaggtgaagtttccttatgttagacaatgactgtgccatctgcttggaaataacctaaactagaaaacctctatgcaaagaggagaaaacctttgtgattcataaatctctgtattaaattaaaaggctaaaagtcctttgagttacctgaaaaccaggtaaaggtatggggctaggggcaagcacagggtagtttcattgtagtttagagcaggaatagaggctgtaacgttgataatgcacatctatagtcaggaaggcacaacacttaacctagaggagattcaaggctcctcccctctgttgggatcatctccacactggctgctacccacattggttatacaaactcactgccccagaaaaatgtgctcattaccatcacgtatatcttttgtcctaagtaagtgcttgcttctattaatggaaggaaatataacccttccattatagaatggtaatcccaaaattcatgagggtcttaggctctcatatcttaccatatgggttctagatatgcaaaaatgagtaattccgttaaattttttccaatttattcatatacagtgatctggtattttaaataccagttctcactatcatcaagtttagggataatctacattatgttgccaaagaaaagaataaagttcactcaccccttgaaaaagtaaacttaaagatttagcttcattaaaactaacgttaattcagtcaaaatgtacaatagtaaaattgctgacatttcatatgacatatatccataggaaatatgtgagaagacttacataaactgctgctgtattatacaattatatacatgtttacttacgaagatgcagtaacctaaaatataaccatcaaatcatgatccttcaaaaacaacaaaaactgcaaatccctaagattcaagctcaaagggcatctcatggattcctaattctcagtcagatctgataattcaggtaaaataaaaatttcttctttcactaaatctcaaacaaaaatgtcattttgtcatcttttctttaagcctccaatctttctttgttatacatttttaattatatcatattagcatacctgatttttatacaaggtttccttcaagcttgtaagagcatgaatacgaacatcgacattttcatgttgaatggccttcatagagagctgaagagttgtctgaagatcagtgctctcagaggtctcctatatacaaagcacagagagacagaacttattaatcaactattttaacaaccatttccaaaggcctgaattctctatatagttaccattaaactataccaaaccaattttttaaagtaatgaaatttccattccttcctttgtacagcacaaatcatttttagtaattctgagggaaagggatttcattgtaaaactgttagacctggagaaaaattttatcccaactaagtaagaatttacttctctaaaataagtacttcttgacaggaagtacaagtttcccttaatttacaaagggctacataatagctttgaaccaggtctatggattatataggtaattcaattcctttcactacccaaggtgacacctaaggtcaggtgtcccactttctacccagaagttctatgaaatcaccactaacatcttcataattttagagagctcactaagatttaagatgctggaattataaattattccccttctaaatctcaggaatcattcacatctgacatttctatatcatggtttgtagcacaacaaaactagaatcatcccacagctttcctttcttctcttagggtgtgccgctgtggtagcgcttctttttgggacaataagtaaggacactttggtctgggtagtaaaggcataagaattgtattttttgctctctgttctatctaatggtgttacatatttaatctaaatgctaaaacttccctccaaaagtcatggattcatggtagcattatctactcaccaggaattagctatcagaataggactatattatccctagatatgatcctaaaggatctttatttcatgtattggaacttgggaacaattctgtattaatgatctcctaaaccacaaattaaaaattaaatacctttctgtattcctggagaacggcttttatcttttttaattctggatgatcaggtaaaaaatatatttcatgaagaaaatcttgcacagcatccctaatagttagttggaataaaaagaattatttgccaagaatatgaatactaaaaaaatgtaaagtaaaagttgaaactaaggccaatttaattcataattaaaagtgctagttgattactgagctgcaaagtattttctaactatgtctaagatgctcagctaaattattagtggaaaatgaccaaagctatgaaaatcactctataatagtgctacaataaaccatgcttctcagcatacaaacccatatatacagtcccttcctcttcaagctgggctgagtgtgtgacttgctttagcaaatagactgtggcagaagatatactgtgccaatttggggcctgttaaaaatgcctgcaagtttccatttgtgtgttctggagagccctgagtcactacgtaagaagtgttgccaccaacatggacagaccgtggtacagagagacagactgtgagactacacggaatgagagagggcccagcccagtctacctgccccctgaatgtggccacatcagtgaccacttgtaagaccagtagaactgaccagctgagcacagtccagattgcaaaattatgagcaaataaaaatgctcattgttttaagatactaggttttggagtgatttggaatgtagcaatagacagacaaagactacctcaatatacaaattatcatgaagaattatagaaaaaaatacataaataatccttgtcagggctataatttttaatttccttctaatataataaatgctctaatctttctgggtccaaatataagcatttctaaatcctagtcttcattaactcatgcaataaatatatattaaataactactatgtgctactacatgctaagcactctgctagtcactggggatggaacaataaacaaagccaaagtagtgccttcattcagcaagcttaaggtcttctatcttgcagcatgatcataactcactgcagcctcaaactcctgggttcaaacaatcttcctgcctcagcctgcagtagctaggattacaggctctttttgcttttttttttttaaatgtttctgtattttttgtagagatgaggttctcactatgttgcccaggctcctggcctcaagcaatcctccagccttgtcctcccaaagtattggtattgttggcatgagccaccatgcctggtcaggatttttcttatgattatgagaaaggtagagaaatgacacttctgcaataaacagcaaagacatgactatgtacaaaaaaatttaaaaggtacttgaaaagtagtcccaaaatctaaattagtgattttgttgttttatcatgcacaaaatataaaaatatcaaaaataaaagtattttaactaaataaaaacacattaacttttccttcttctatgatttctccctcattagacagttactgcaactgactaaagggaccagcaatagcatatgggtgagtaggtaaataagtagtacttcaatcccaacttttcacaagcaaaggaatgattatatacaacattaagtaaaatcacagaaaaaaaattaaatatataaaaagacatcccagtctaaaaagcagcctgaatcaaaaatacaaatgggaaagaataatgcatgttctgtcaatagtaatccacactggctatagcctaatgcctgttttgaaaaattatgggggaagatagtaagaaatagtctgtggccacatttttagaaagccttcaatatcaagctaagcaatttggaatttatcaattaggaaatggagaatctcagaatgcctttgtatgctggaatgacaccaataaagagatatttttaaaacacagttctagtaacaatatcaagaaaagtgatgaaagcttaaaggaagagaggctggttcaaagcttaacgcaatgaggtaataagggtttcaactaaggtaagctgcagaaagtaggtatctctcctaacctttctcatgctattcaactatctgccttttgactgtgaaaagaaaggtaaattaggttacacatttacagaattaatgaaaagtaatttttaactggtgacctattagtgagctttggaaataattataatagaagcaatgccacaactgaaatagcatcatttcaatatgtaattacatgccaattacttttgtttattgataaaccctgaaattcaaaaaagtgacagtttccacattaccatcagtaattttgagacataaaaatacagtttaaaaagttattattttactattaatttcagttacaatacctgttttcaattatgaggtagtggaagatagctgcagtttctttaggctggatgtgtataagaggtaacaaagctactattacatgactgagaagggagcccagacaagcatgatccaggcagcgaacaaagcagtcccaagctctatgtgaaaaaacaaatagaaatgaagtccaattacttttattatttgtaaagctctatcaatcagtaattagttgaagacacatgatatatacaaacaatagattaaaaggcagctttaaacatggaataaagatcagtgctatatattcaaataaagtgatgtccaaattatgtgaagtcaaaaaagcaaggtgaaaaacagtgtttggggcagaattaataataaaaaaaaagtatgtgtgtgtgcatttacttattcttttacagagggtggatatacaaaaattaataaaaatagatatctgtagaggtcgaaattggaatctagatttctgactataatttgttacacagatttgaatttgggactatgcaaatgttttatataacttttaaattaaataaaatagagggaaaaagcaacccttaaaagttttaaagaaactgaaacaagtgaacctaactaaatgttaaattggtagcacatgcacacagaaaataagtacttcacgtgattctaaaacctattctttataaaaattttctagtagctacattcacttaagacttagaagcaatgacagtaggcccaaagagtgcctatgcttggaattaatctgggctcaaaggaaccagagccaggtttccttgaagaaatcactaattttgagtcagaggcaggaaatgttcaagataagcccaggtcatcttgtcatgccagaaagcagagaatctataagagattaatagaggtcatatcaaaactcatagatgccaacttgaagggatttctacttgcttaagatgggacaatttcagcaataaaaaaggatagtgactttaatggataaaaaataatcaaacttataaaaatctacgttatcaaaatgatattaaaaaaacttcactggaggttgctacagcacaaacctatattcctaaattgattaactaaagggaaatattcaagtatttatgaactgctttatatgaactatggttgttttgcttttaaagacaaggtcctgctatgttgcccaggctagactcaaactcctggcctcaaatgatccttccacctcagcttcctaagcagctgggactacagatacgcacaatcatgcccggctagccaaattttatgaggaattttgttttaagaagaatcccacctagtaaatacagaaggaataataaaattagaaaatcattatttcatcaactgcaatgaaataatggacttaggcaatgatcattaattaatgctaaaatcatcagatgaaagattagtggggaattttataataaagggattcaggttgataaaacctactgtctaatcttaccattactaaaagtggacaaccagatattattatgtggctcatactgtgccacaagagaagcacaaagcctcacctatgaggtatgttatcataataaattgaacctaaatctaatcaagcatctatatctaagtacccatttatagaaaagacagggaggaaagaaaaaatagagggaaaagttaaattagctattcgccaaatccaacatcctaaaatcttaacagcctaaaataagtaaaatgtgtgagtagagaatttaagggatgaggctgtttacaagagacacttaaggagccaggcaaccaaatacacatatgtaaacttcatttatagtctaattcaagaaactatgatacatacaaacatctctggaaaaacatctctgatacatacaaacatctctggtcatatacaacataatatatacaatgtctttgggaaaaatacctttgagacaactggaggaaatgtgactaaggactgagttttagattagatatttctattaatcctgctaagtataataattcatgaaggttattttttaaatgtcctcatccgttagatacatctaaagtatttacaagcacaatgataagattctgggatcttctctaaaataccccaaccaacaatcaaaaaggtagaagtggattaaaaaaaactagcaatgttgataactgctaaagttgggaaataggtatgtaggttcattgataactcttctatttcccagtatgttaaaagacttccatagtaaaatgttttaaaagaagtaaatatgttctattttaaatacaaataaatagtctttctaccttatttattatttgaacccaatttccctcaaagagataagaattcaagttagtgctactggaaaatgcaaaaaaaaaaaaaattaataaactcaggcagtcatttacctgcaacacaattcaggaaaatcatccttgaatcgaaggccagttctcagtgtggtcatcatcttcaccctcacagaactgacatgtttgggtcccattaacttcatcaaagacatcaaactgttcaaggcctatagagttaagtagtgcttcagagtaaagcttataaacatgctgccagaagcagatgagccctaaggacaagtgcttcccacccagtatcagggtgtcatctattctcagataatacaaaagattgaataaatgttggccagtttgttttgtccaattgcttatgtcttatgtggtaattataaatttgaaaaatacaagttgagttcttttttgttttttcccttgaaggtgatttgttattttagcccagtattcatctagaacagtacaatttctaatttattaaaggtataatgcatattgtttaatttctttcatatctatcccaaactgccatacacatatataaaacaaactgaattaaaatcatttaaatttgagaccatataacaatttttgtagtaaatggaatacttcctagtaatcagtagttaaggaaatttttgtcctaatgatattaaattcaagatgtcctgaatttagtaaaacaaataattaatgatacactcagaaaatgaaacacatgaaaaacacagaaccagacctgttatcagcagctccagtttataatgaaggggtaaagaaactctggtcgactttatatgccaaaacattttagttatttatggtttacaagacaaactgtagttttcttagattcaaggtgattctctcccttagaatagcaattggggaaacaataggaaagaagccatgtagatggaatagtagttggttgggggattgaatttactagttgacaccaaaagaacaggcattggttgctgaaatttgcaaaatttaatatggtaacatatgtctttcttggctccttaataaaaaaaaaaggaggggagagtatacactgaaataaaagcttccattcgtaggtgttttttgtttgtttttattgtaatcttactgactgcagaggtggaaagcaacagaaagagaaattttatcaatatctaaaattttactccaatttataggacgaaaatttccaacggtggccaactgttgcagcagtcataatgaaacttcactgtggcacaagcatttaaacataaagttgctttacattataataacctaagatttctggtgttcaaaaacaccatgagccatgacccacaccagaccaatctaaaccaaggagactcaatgatgcaacttttgtttgagctttcagtgattgctagtctctctcttcaaatgctggactagatgttgtgatgacgtgagcttgaagccattgaggtcattaactggctcttaagtacagagccaacccagatgaatctgagccaaaagactgactctgagaacttttttgagtccaaaatcaagttatgcctaaagctacatcatccttacgcttttagtaacacagccacaagttccttttagtcactttgggttgggtgttctatccctcctaaactaaagaaatgaaacgaatacaattccaatttttagactcccaaaaaacgtatatgagttcttcagcaatagagaatgtcatatttggttatttctcatctttgaatgtttgtagctagatgcagaatttatctatattctgtatgaattctatcttagcactctggaactatcaccacttaccattttcttatcttcaatgccaacactagagctcagtaactgcatgttaaaaaaagccaaaatgcccaacaatttgggttgtaaataatcagcctaagaaataaaaacagataatatgtaagctttatacagattgaatttcttaagttgacattttaattatttaattaatgtcatttatattttacctaactagattagcatattagaaataaacacttggttaattaagtttctccaaaagcatatatcttcacatgtagtatttaaagaaacatgtagtatttaaaggaatgatttatagtcaccacgaaaaaatatgattaaacagtacagtacaatgagaaaatgatgagttttttaatcatggagtgaactggggtgggatcctcaggatctaattcatgtcgggatgtggggtggagaggaaaagaagaaagaaaagaatagagaaagacaagggactgcccttattctatgacatttagagctatggtagaaaagtacgattaaggaaaaggtattctaccagaataatgatctgacataggggataatatccctggaagtaacaggggaaaagaggcacaagaccatgggcatcaaaagttgcagactagatatcatcatccatgacgctttaggtttcctgaagtaaacagagttccttccttagttccttccttccttccttcctccctccgtccctcttttcctccctccctccgtccatcccttcttcctccctcctttcctccctccctccgtccgtcctttcttcctccctcctttcctccctccctccttcccttccattcctccctcctttgcttccttcctccctctttctctttctttcttcctcttttacttaaacagggttccttccttccttcctccctccctccctctttctttttctttctttcctcctcttttttcttagagttccttccttcctttctatttctttctttcctcctttctctctcttttttcttttctctcctcttcttttcttcctctctcgacagggtctctgtcacctaggctgaagtgtagtggcacaatcacgactcactgcagcctcaacctcctagactcaagcaatcctcccagctcagcctcctgagtacctgtgactacaggcacgcaccacctcgcccagctaattttttgtattttttgtagagatggagtttcgccatgttgcccaggctggtctcaaactcctgggctcaagcaatcctcctgctttggcctctcagagtgctgggatttcaggtgtaagccactgtgctcggccaagttaatactttcttaagagaaggtcctggaggagagggcatgggctttaagtcagccaaatctaggtttgaatcttaattttgacacttcctaatgtgtgatcttctataagttacttaattcttccaagtttgtaaaatgtgaataataaaaccacctactgcatagagttgttgtaaaggctaaataagataccatttattggctaggtgtggtggctcacgcctataatcccagcaatttgggaggctgaggcaggtggattacatgagctcagaagtttgagaccagcctgggtaacatggcaaaaccccatctctacaaaaaaaattagccaagcatggtggcatgcacctgtggtcccagctactcaggaggctgaggtgggaagattgcttaagcgctggaggcagaggttgcagtgggctgagattgcaccactgcagtccagcctgggtgacagagcaaaatcctgcctccaaaaaaaaaaaaaaaaaaaaaaaaaaaagataccattcactaagaacttagtatatagctaagtattaaatcaatttgttcatattactacaaactgagaatgtgaccagtctgtaaagaagaatattcttttgtttcatgtctttatgtacaggcagaagaaaggagcaaaaaaaaaaaaaaaaaaaaatgagctgggaatgagtagcaactaaagcattttgaactccataagaaagttgcactgcttgatgttgaggcatctgatttaggtatcttcaggttccatgcattaccaagaaaagggtaggagggtgtgtgctaccatataatagagaggagtgaggtatcctacaagtctctccagattagatgtcaggataaatctttatcttgcctagcacaggaaatcatctggtttttaaaatctaaaattgcattttgttctgcaaacttctgatttaggttgagactcaactttggcatggtaagccacaattcactaattgtatggttctagcctatgttgcttaaataaaaagcagataaggatcacacaatctctgtcaacattccaatattaaagttcttgcactcagacaaacaattatttgactttatctacctaccaatatattatctatcaccaaatacttattatgtatgcctagaatcctatactgggtacaggtgtacaagataagcagagtcattctctctcattagcttacaaggtagactagcatgaatggaagacactaaataagtagtaagtatgtaaacaaagttgtgataatgctataagaaaataaacacaatcctgtgatagacaagaaatgtggtaagggagtcgagacagggtactcaggaaactcttgaaatctaaagaatgagaaagatccaggagattattccaagcagagagaccatccagggcctaggtctcgaagcaggaaaaagtttggcatgtttaagaaacacaaaggaaaccatgttgaaatatagggagaaaggaagaaaagagttgtaccatgtgagagtagaaaggtaggcagatcatgtatgccttacagattttattttatgttaagggcaatgaaaaccattgaaggaatttaatcaggggaacgatatgagtttgtaaaaagagcactccaaaggctgtgtaaataattaattgtagagagggaagaatgaaaggacagaaccattaggagatgttcacagctgtcccaagaaagatgatcattatttgtgtaagggtggtggtggcagaaatgaaaagatatattttggagagacttgataggatttgctcattaattataaaaggataaaggaaatggagggctcacgaatgcttctcaggttttgtctcatgcaactggtagatagcggtaccattactgagatgggaaagactgggagaaaaacagattagaaagggaaaataaagatttctaatgaacatattatatttggaattgtttgagatgcttataagacatgagagtagagatgatgaaaaggtgaatatctgtttgccatcttctgtcatcctcaggtccattctctgccgccttctgccctgctccgtacctgggacactgaccggactgcattacttaggatcccttaccctctggctttccactgaattcagtcagcaggaaataccactagaacagagggtaggaggagagagtatggtattcatatttcctgctctgtctgtgttttgaggtagttctggcagtggctatgttcctctacaatgagaggacccccctcatggttctggctctcaatcaggttctagtaacactatttcttcccctttcccagaactaaggggggcattaagttttctgtggtttgtagtacctgggttccttaacattccttgctggttcccttaaccttgccatgtcactaaaagtagcccctttgttaaactatttctgtgtaaatgtttgtgtgtatgccatctgtttcctcccaggacctaacctataaaaccaagctcagaggcagtctggactgaaatttcaactaaaaattatcaaaatgtaactcatattaaagaaaaagatcaaagaagatcattaaaggagagaatgatgactgagaaaaaagagccagttacatagtcctgagttattctaacatttagaggataaagtagataatttacagggaaaaagccagtaaagaagcctaaatatgagtgaacagtgaagcaaaaaagaaaatcaagacaatgtggtatcacagatgccacgcaggaaagaatggccaattgtattgaatgatactgaaaggttgaataagataggacagagaagtgactatgagatttaatagcccagaagactgttggtgatcctgacaaaaggaatttcatggaatagtgagaaaagagccagactagaatgggaaatgagaaaccagagataaaaatctctcttaatgaacttatgtctagtattccattattggaatggtaagcttgtagaagttatttatatcctactgctcaaggtcatcaccaaagtctgatttttcacaaaaaaaatttgcaacctctggcataaatgggttaaaatattttgccaacagtcctttaagtctgttacaagaataagggcagttgaaagaaaaaataataatttaattctgtggatttacatatttttttaagatagataaacagtaaagtgatttcaaatacaaatttatggtagggaaagatttaaaatagagaacatatttccaaacttcccttctatccaataatggattaaactacagttagaattgaaaagtttcatttgttgacctaaggaaagagtagtcggaggggcagggtgagaggagagctacaaacatattctaatatacatgtaatttaaaagtagtagagaaaaataaacttcaacatttttattcagtgaaaaaataaaatctactaaaaacacttaaaagtccacatttttcaatgctaatatatgttgttaatgccctaaatatgtaaatatgtaaacaaagttgtgataatgctataagaaaataaacgtgatctcgtgttcatgatcttgtgcatgtgaccacgtgatttaaatcagccttttcaaaataaaaataccaacttaaaatttaaacaaatggctagcagccagaaaatgaccaaaaatatgatttcttcaattttataattaagctgcaaaaggaagaaaaacaaacaaaaaaacctcatagaacatattccttaccatcagttcaggtgatatgatatctctcgggccctgatatggatcatcactggatgcaaatgaggcaagtattgacaaaccattaaaaacctgttgatagtgttctccaatacgcagcaataattcattatgcaatccttggaaatcttgtctcaacaggctccccagttcaatttctgtttcattctaacccaaagacatgttaaaaaaaatttttttcttcatactaatatcctggaaataagtatactgattttaacatgctattagtacatcaggagctctagcccagatgacaggatttattaaaggtattaagaaaaggcattggaaaagattctaatcttattctatcctggtaggtctcccatggattatatgtaatgaagagaagtgatccaactttatttagaaataaaatattaaaaagcaagtcctagttttctctaaggtcttataatatcatcaactcattattggggacacacaaccctgggaggaaatgtagtatagtggcttatagcagtctttctgttcagattgctttagtttaaattctagctgtcatttatcagatatgctgacttggacaagttacctaatctaacctcactctgccttagttccttatctatgaaacaaaacaaaaaaatagtacctttggctgggcgtgttggttcacacctgtaattccagcactttgggaggccaaggcaggtggatcacttgcagccaggagttggacaccagcctggccaacatggtgaaaccccacctctactaaaaatacaaaaattagccaggcctggtggcagacacctgtaatcccagctactcaggaggctaaggcaggagaatcgcttgaacccaggaggtggaggttgcagtgagccgagatcgtgccactgcactccagcctgggctacagagcaaaactcccatcacaaaaaaaaaaaaaaaaaattaagagtacctttatctcattgggtaactgtgaggattgcatgaaatgatccatatcaattgtttagctcaatttctgacatgtattaaatactccataaatacttattactatcattctatctccacaatatacagtcgaataatactttctcaagatgaataaatacatttgatattcactaactctcgtggaaagagatgtgctgctggcatatattatgaaacaaattaagtaaattaacatcagagaaaacagtaaagttatatgcatatttctcatagttttcctgttcccatgtagtttcatattcctcagagatattttgttaatatgacaccaaaaaaaagaagcacaggttataattttaaatgtaaaaactaccaaaaacctggaccaaattgtaatcagaacaccaagtaactaaaatatagacattatactacatttgaaggtgattgcctcttcctatggatataattaagtgtgtatcatcagtcaacttataactccaatcaactgaaaagtactataatgaaataggctgagaacctctcccatgaaaggatgcctatcatatcccattatggtgaaatgatcaaagaaaacaaaaggagaattctatttaatatgctctcaggacaaagattatttaacataacaacatttaaacttacattcttctaggataggctataatttactcaccctctttcctagaagaatgttacatctttcctataatgctaatttatataaaaaagtaaaatatatagaaatattcaattaccttcagataatgaagggcacgttctaattcatctttggaacaagaacagaccaaatgagaaaaaatatatttgaagttgtttattaaaatctctctacgattgacatttaattgttttcctaaagttcgaatgagagcagaagctgcagggcttgctttggcagcaagatcaggtagtagaacttgtaatgtcctctgaaaaagaatgcaacaattaccaaaaagtacatttgtctgggtgaaaaaaatattcacataagctatgtgcaaaaatatttttaaatgccacacatatttggagtccactccatactataaaatatgtaatagtagatcatttataccactataattttatactttattattccaacaccttagaagcagaaatgatcatattagactttgaattgccaacggaacaaatcatagcaccaaagacataagggctcaaatagctaactgaattgattagcattattcaattagtattaacttttcaggacagctaaccataaagaacaatgactcaaatccacttaaacttaagttttacagcataagcaataatctcatatcaaagtcaaaatctagaatggaatgaacaaaatactgaattgcaaacctcaagtgaactatatgttgcaacttacagtaagaaaacgattaagatcaggaaagtcgaaaacgttggcaatttcagacaacgtatttaaagccatttctctctggtgagccacatcttgttttcgcacgtcagcattctggcatggagtattcggaagtgctgtcatctgactagagtgaagggattctaccaaaaactagagcaaaaaccattttattgtgagttttcacacaaagaagaaattttaactaatactttttaagccaccatagagggcagtatcaaatagtattctacattatctgaattggtccattcaatttttataacaaccttaatgaggtagactatgtcataatctgcctttcacagatgacataatcagacttagttaaaaaacttgaatatcatgctaaggattataccacaaataaattcagtattttagcataacctaacttttcagccattaattgaatatatttaaaacaaagtgtcatataacataatatcaaggtgtaaaacagtttactatcactaaaaagtctatacaccattataagatgatttccttcctccctcatttataacctgtatcttcagaccaatatcctaaaatataaaaatggcaagatttcagttatagtaaataaactataaacaaaatacatcgtttttgacaataattttttttttttaaagacagagtcttgctctgtcactcaggctggaatgcagaggtgcgatcttggctcactgcaaccgccacctcctgggttcaggcgattcttctgcctcagcctcctgagtagctgggattacagatgcccgccccatgcccggttaatttttgtatttttagtagacatggggtttcaccatgctagcaaggctggtctcaaactcctgacctcaggtgatgcgcccaccttggcctcccaaagtgctgagattacaggtgtgagtcaccacgcccagccttaacaataattttttaaagcaagcacaatgctttctttttaaaaccaggcacagtggctcatgacagtaatcccagcactttcagaggcagaagtgggaggatcatttggggccaggagttagagagcagcctgggcaaaatagggctgctctctctaaaaccccatctctacagataaataaataaaaattagctaggtgtggtggtgcacacctgtagtcccagctactcaagaggctaaagtgggaggatctctaagcccaggagttagaggtttcagtgagttatgatcacaccattccatgtcactgtatgctgcctggacaacagagtgaaatttggtctctaagaaatgtttaaaataaaaaagaaaataaaacttttaaaaagcaagcaaatggaacagattagagaactcagaaataagatgacacacctacaaccatccgatctttaacaaacctgacaaaaacaagcaacagggaaaggactctctatttaataaatggtgctgggagaactgactagccatatgcagaaaattaaaactggaccccttcctcacaccatatacaaaaattaactcaagatggattaaagacttaaatgtaaaactcaaaactataaaaactctagaagaaaatctaggcaatacctcaggctataggcacaggcaaagatttcatcacaaaaacaccaaaagcaatttcaacaaagcaaaaattgacaaataggatctatttaaactcaagagcttctgcacagcaaaataaactatcatcacagtggacagacaacctacagaataggagaaaatgtttgcaatctattcatctgacagaggtctaatatccagagtctacaaagaacttaaacaaatttacaagaaaaaaacaaaagtgggcaaaggacataaacagactcttctccaaagaagacatacatgcagccagccaacgaacatgaaaaaaagctcaacatcactgatcaaaactacaatgagataccatctcacgccagcagaatggctattattaaaaagtcaaaaaacagatactggcaaggtttccgagaaaagggaatgcttttataccgttggtgggagtctaaattagttaaaccattgtggaagacagtgtggcaactcctcaaagacctagaggcagaaataccatttgacccagcaatcccactactgggtatatacccaaaggaatataaaaaggaatataaatcattctatagtaaagatacatgcacatgtaggttcactgcagcaccatttacaatagcaaagttggccaggtgcagtggctcatgcctgtaatcctagcactttgggaggctgagacgggtggattgcttgagatcaggagttcaagaccaacttggccaacatggtgaaacctcatctctactaaaaatacaaaaattagccaggcatggtggcaggcacctataataccagttacttgggaggctgaggcaggagaatcacgtgaacctgggaggtgaaggttgcagtgaactgagattgcaccattgcactccagcctggacaacagagcaatactccatctcaaaaaaaaaaaaaaaaaagcaaagtcatggagttaacctaaatgcccatcaatgacagactggatgaagaaaatatggtacatatacaccatggaatactatacagccataaaaaggaacaagatcatgtcctttgcagggacatgaatggaattggaagccattatcctcagcaaactaacacaggaacagaaaaccaaacaccacaagttctcacttataagtaggagctgaatgatgagaacacatggacacatggggggaacaacacacactggggcctgtaaggggggtgggggaagggagagtatcagaaataatagttaatgcatgctgggcttatacctaggtgatgagatgacctgtgcagcaaaccaccacgacacgtttacctatgtagcaaacctctacatgctgcaatatacccctgaacttaaaatataaattgaagaaaaaagaaaagcaagcaaaataaaacatgtataaatattcttcttttttgtaactcttaaaaagtactgctgttgcctatagtccagacaaacgctgactcttacctgacagatgggtttcttatactggctgaaaaaactttgcagtttaacacttttagctgcaaccagagctctaatttctgtgtatgctgctccagagacagatgctgacttggataacaaacaatgcaataagtgtaagagtgcaaatggtaccaaatctccttttgcggccctaaaattaaaaacaacatacatatgaatacacaaacacacacacacacacacacacacatacacacacatatgtatctccaatatcccagaaacaaacggaaatctacaaataaattcatgttgactcacattttgtctataatatcacaaatatcatatcaccatttttaacagcaagcaaataaaaatggagaatggccaaaataaataaggaagaacacaaatgctgccaagtataccttccaatatcccctgttgtaagaatcaaggtatccttcagctcattatttcttgatatttgggcatgtgtatatgcttccttcattcttaagacaaaaagctagaacaataaaattaactggttaaagaaatttttagagctaggttgacgtaaactcaaatgttaaaaacaaaaattatcaacctcctttataaatccatcttcagagtccaaggattccaatatgtgcttgatatttccactaaaagccactctaacatctttgtctggatcttccattaaatttaataaagttccaagaactgcttttacatctgtttcatcttctctaaaatcaagatgcttacaaagatgatgtagattatctatgaaagctgaaggacaagagtatacaatacctaatttaacatattaaatgtcaaggttgtactgtaaaaatattgtcaacaaataatatgccatgaagaatcctaagttctcttataatgtcaatgtttcatatttaagtatgtatagcacacagaattttaggaaattaaaatggatacttataaattaaaattactttatatttaataaatgtcactttttttttttgatatagggtcttgctctgtcacccaggctggagtgcagtggcatgatcacggctcactgcagcatgcagccctgacctcccaggttcaagtgatcctcccacctcagcctcccaagtagctgggaccacaggcatgcaccaccatgcctggctaatttttgtattttttgtagagatggggcttcaccatgttgcccagactggtctcgaacacctgagctcaggcaatccgcctgtctcggcctcccgaagtgctggtgttaaaggagcgaaccactgcactcagcctataaataatttaaatctaaaataatttccagaattgttataaaataacaagtctctttcagattttgtagaccattatatgttaccaagataaacttaaaaacacattgcaggccaggagtggtgactcatacctgtaatcccaacactctgggaggccaaggtgggaggatcacttgaagctaggagttcaaagaccagcctgggcaacaaagtgagatccctctctacaaaaaatttaaaaattagctgggtgtagtggcacatactatggttccagctactcaagaggctgaggtgggaggatcacttgagcctgggagatcaaggatgcagactgcagtgagccatgattgcgccactgcactctagcctgggtgacagagcaagaccctgtctcttaaaaaaaaaaaaagaaagaagaaaggccgggcatggtggctcatgcctgtaaccccagcactttggggggacagagtgggtagattacctgaggtcaggagttggagactagcctgaccaacatggtgaaaccctgtctctactaaaaatgcaaaaatttgccaggcctggtggcacacgcctgtaatcccagctactccggaggctggggcaggagaatcgtctgaacccaggaggcagaggttgcagtgagccaagatggcgccattgtacttcagcctgggcaacaagagcaaaactccgtctcggggaaaaaaaaaaaaagaaaaaaagaaaagcacatttctcaaggggatcttagctttattgttaaccttacattacaagatttagggagtactttctattgctttcaatagaaagtttctattgaaacttcagaacaagtttcaacttactacctaaacaaatggatcttctaagtatttgtataaatctcatacttcataaaaatttatactccattaccactggaaagtggccaagaagatacactctatagtcctcagttgggcaaagtaatttaactatttgaagttctcaaggtccaaggttgtaacagggggcacattaagacgatctctggtatcactaaagaagataatctaatattgaatcttacaatattgaaacaaccatcaggtatgccccatttaggctgtcaaatcacaagagtattcgaaaaatcccaaaatcacctctcctaccagttttgtgatgcgatctaataccagttatcccatttataactaatcaatactgagcactgaatctataaagcatgtaacttcctgtaatttttcaaggcttcagtctaattcttttactgatttgaaaagcagagcttaaataggttttaaagtattaaataagtcataatcactcaccaagttttactggactaggtattttttttttcagtaggaaaaggaatggcttgcagacagaagcttttagttgagaagatgaacattcatgttgagaagtggctttcaagttcctacagaagaggtccacatgtccgtgttcagagaaaggttctgttaaagaacttgtcagataaaacatgccgtgaagagtacagacaagttgaccaagtatagaagcaaattctttcttgacaatgtcagaatcatctttgactttatctctggggaaaaaaaagaaaaagtactaaactttcttgcctaattttgtggtctaaatagtcttgcttaatttgggacaaaagtactggtaaaacaaagcctagaaggaaaaaatgttaaattctaaaactaaaagcaacatttgctttacatattcaacaataaacacaaccctgcatacatagccagacaattatgatctttccaatagagtgatatattcaaattaaaatcttagtacatacataagaatcttgggaactctgttacaagaattctgctgctgcaataagataaaaaatccactaacacaactagcccggattacttcatgggagctctgcagggcccagttgtaaactgctgttctccactcaaggaatattcttcttggaaacagagtcagaagaaacacacatcgtgattgtgcctgtggtgctgaaaaaattaagtctattaaacaagatttctactaatgttaattttatgtatacacatatacatatatataagtaaagtaacatttgtgtatacatatatataaataaaagtcaagtaacacttaaaatacatttaatacctaatttaattaaaagctccttttcagaaaataaagcaagtgcactgaaaaaggtctatacacaaccttactaaataatcaaggaaatgcaaattgaaaatcatacctaccagataggaaaaagaaaaaatttaagatacttaactccatgacattttttattttctagatagcaaaaattttaaagtcagctaagtgtcagtgaggatgtggaactcatactctgctaacaggagtgtaaactggtgtatctttggagaacaatacagcagaatagaggtgaagatgtgcaaactctataacccaacaatactactcctaggtaggtaaaaacgttaaaataatgcttctcaaactttaatatggatatgaatcacctatcttgttaaaatgcagattctgatcagtaggtctgggtggagcataagattccccatttctttctttctctctctttttttttaatgtgctctttcagcagaatcaaagacgctccatttctaacaagtccctaaatggtggcgatgctactggtctgtggagcatacttttcaaacagcaaggacttagaatgactaaagaatcatttataaaaatattcatttaaatgttgcttgtaattgtgaaaagttggaaacaacttgattgtccaccaataggaggtctgatagtgtccatccaaatttggctactatttggaagtttaaataaaaactagagttacccatatcaccatggataagtctcataaagatagtgttgatcaacaaaatgtaagctgtaagaagcaaaacaatttcttatattatttataaataaatacatatatagtaaaagtaatagaacattcaacagaacaatcaacaccaaattcagaacagtagtaatctctggggaaaaaaatgaggggaatgaaatcatagagggacaaaggcttccatcatatctctaatagcccaggctggagtgcaggggtgcaatcttggctcactgaaacctctgcctcctgggttcaagagattcttgtatctcagcctccctagtagctgggactacaggcgtgagccaccatgcctggctaatttttgtatttttagaagagatgaggttttgccatgttggccaggctggtctcaagctcctgacctcaagagatccgcatgccttggcctcccaaagtgctgggattacaggcgtgagccaccgtgcctggcctaatgtttctatttcttaaactgagaagttggtataagaatttttggtatattgttcttctttttaaaatatttctcaaatacttcctaattttattaaatgaagataatgatatgtaaggacacattgcaaatgttttacaaaaagaaaggaaatgggatatgtggggcaggcttttatgtgttactttttatgtatctaacccccttctgaactattaaaaatgtacctgctcttttaattattgaaaaaaatataaataagtcttagaagtcctatatagagatgagttaaaacaaaccacacaaggccaggcatggtggctcacgcctgtaatcctagcactttagaaggctggggcaggtggatcacttgaggtcaggagttcgagaccagcctggctaacatggtgaaaccccgcctctactaaaaatataagaattagctgggtatggtggtgcgcacctgtaatcctagctactcaggaggctgaggcaggaaaattgcttgaacctgaagacggaggttgcagcaagccgagattgcgccactgcactccagcatgggcgacagagtaagactccgtctcaaaaataaataaataaataaataaataaataaataaatagatagatagatagatagatagataaataaaacaaaccacacacacattcttgtgagcacttacaatagctatctgaaatcctacagcttaatgttagaagattagcggcaaatgtggtcaactttaaacagccatcatcagaatgggaataaatccatggaagtgagagcataccacataaatcttccaggatatgatcttcaaatgaactgtttactacagaagcacaaaataagtcattaattataacttttccttaatcatatctcttttaaataaaaataaagacatttgaaatactatcataatgatcattggataagcagaaattcttaacacagagatctataaacgatggtctgaggtctgtgaacccaaagaaattaaatgtgactttataaaaacatgttatctatgcctgttttaaagaagaatcacggcattcctcaaactcccaaattaaaaaactttgaagttataaataatttctattgactaaagaatcaaaatattatgcacataaattggcaactcagaacttctattattgacaaatttaatagaactgaaatcaggaaaaaacttctgagtattccaaacacgcacttaggcttcaggcaaaaaagaaagcatatttctatactgattatctttaaaggttattctgatctgttgctaatttgtactcaccttgcatataaatcaaagcatcataaattttcaccaccttatcaatggttgcctccaggtccagtttctgaacagattctaacaaacttctacagctcttaagcacttttgtgtaaaaatccaatgacatccaagttatcactacagaaggtttcttcttggatttatgttgacagtccttgaaagtacggctgcagtaagtacattttgttaaaaacattggaattaagatgaattttgttatagtcaaacataaaattgtagtaaagccaaaagaaattgtgagtacgaaatttatctataacaatttaaagtaaacatgcaaatcaagtaatatgttattactattttaagttgaatctatttatgtcagcttaaatcacccttaggatttgggaaccaaatgactttgggagcctgaggtgggaggatcacttgagcccaggagtttgagaccagccgggccaatatagggaaacccatctctacaaaaaaaattttttctaaattagggtgtggcggcacatgcctatagttccagctacatgggaggctcacttgagccccggatagagatcaaggctgtagtgagccatgatcatgccactgtgcaccagcctgggagacaaagcgagaccctgtcttcaacagccaaacactgggttttgagttgtacacaaatgtgttctggtactttctaatcatgtgtccccaggaaagtcagttttggcttcagacaaaaaagagcctcagtttctctgagtgtcagtttctaatttttaaaataggcataatagcctttaccttacaggactattgtaaatattaactaagatatatacagtgcttagcaccgtacctagcatttgactcaatagaaaataaatttattaactacttcagtgaaaagtttgtgttctaaggttacatgagtcaagtgaataatgagtaaacagtaaatccaagttcattacaggaaacccaaccccaagaaacaagaagtttgttttaccagttcatgttttgatgagaacaatgaacagtacacagagcagtcagttgtaagacaacagcaattccttctaacatctcaataacaggattctttaggccactgtattcaagggaaatctgaagggattcagctttctgtttcagtgcactccataatatgctcttttggttcatgtccacatgtttaattctataattatgaatatagtagagagatattcatatgcaatataaatttggttaaaacatgaaacatatttagaataaaacatactatgtaatatcaactattcaaaaaaattttttttttttgtgagacagagtctcactctgtctcccaggctggagtgcagtggcgccatctcggctcactgcaagctccgcctcccgggttcacgccattctcctgcctcagcctcccgagtagctgggactacaggcgccaaccaccacgcttggctaattttttgtatttttagtagagacagggtttcaccgtgttagccaggatgatctcgatcttctgacctcgtgatctgcccgcctcggcctcccaaagtgctgggattacaggcgtgagccaccgcgcccagcctgaaatttatactaagatttaaaacaattaaaacaatgttcagaagtaactgaaatatggcaacttagccactttataaaaaatagttggttaatgttttaaaaattgctaatagatgcacagtctcaaagatttttcacatattaaaaagttaaattagataagcatataaaaacatgcaaagtaactatatttaaccatgaaatgttttatactactaaccgtctacaataattataaaaatattttaagcactcccttggctacatttagaaagatgttctttgtgtatttaaatcaaagcacttaactaaagctgatttttaaaagtgaacaaagttttatttaatggctaaatacaaactgaatgaaggtcatcatactcctcagtctgttttggtgctcttttagaagggtttagagacgagctgagacgacgccttttgggtgatattccatcactattactgctgaggttttcctgttgagtttggcattgaatctcctcaatgatttccatactttccattttcaaagctgcataaagtgggcccaacaagtactgagaaaataaaaaataatttccagaaatattccttagaaaatatatttatattattcataggcagcaagaatgtattagatgttaggtgttttctagtgaaactacttttagagtctcataaagcaaaataaacatctaaattgatctatattatttaagtctatatatagactatggttctatagtcttagaaggtttaaacaaatccttctctctacatcctgtttttcctcttaccaaaatgctataaattttaattcccttataaaaaattctgtaagggaattaccaactttcttcatgtaactttaatccagcaagattaataaactaaaatatttaatcaagttactgcatctctgatgattttattgtattacctgactcccacagtccaaatagaaaaaagcgcataatttggcatgattaatcattcataggttttctaaaagtgattgattataacttgtcagacacataatctgattgaccaaagcttctgcaattaagttggtaactgcccccttttaattaataatgcaacaaatacatttacacttcacagattctacttagaaacattctactccattggcagttcattaccaacttaatgaacaaatccttctgaaatcaaagtaaaagtccataatagtgagccagactacactatgaaaatcattatgttccaaatataaattactattaaagatattctattttcttattattacattttgcacatatgtatacaattaaatgatgaacaaaatacatacttaactagtaacctgaaaaattacttacctctgcatctacctcaattccaagcacatccaaaagagctttacaaatatttctcacatagaccttcctgacttgtaaagcagattcatacccagctggcacaaatttaaggaaatactgcagtaaatggcacaaagctgcttttagcaaatcagacttaagccgcatgagcacaccgtcttcaaacatgacacagagtttttccagcagcatatttaaatagacaggttcaatatttctataagcttctgcttcaaagggaaatagtgtctttatcagctttgataatggctcttcatagagtttcaattggtcagtatccatttctacaaggtgttttaataattccaaaaatgagctgaaaaaagtgctagctggttgtgctggtagtcctccaagctgaaaaagttctgttaaaaagctaattgctagggatttaatttttggactaccatactctagcagaacacaacctatctgccaaagtaagagttcttgccttctaaaaaacacaattgcaataatacgagtaagaaccattaataaagtgacttcaataaattctaaattttgcatactcatcaactgcaaaggagctgattgtaaatatcccatgtgttcatctaattgacttaaaaatcggctcatgaccactggccattccacagcatgacccatcacatttcttctatggaggtaaaccaagtcttcaaaaagttgtaataattcttttgtgagtaccccaaaaatagcaggactcttgcttttaaaaagaaataataatgaacagatgacttcacagattttcttgtgtaacaaatgacaggagggagttgctgcaatccgcagaagtctcgttatgatccaattactgaattctttgaaataaacaaaaaagatattaaataaacaagtatatccgaagtgctaattcatttgctaaatccttgacgattgacttttaaagaataaacttcactaacaagagtgtaaaacattctcttcacaatggaaacataatagtttagaacacaggcatacccagttttattgcacgttgcagatactgcatttgtcacaaattgaaggttgtggtaactctgcatcaagcaagtgtatcagtgccatttttccaatagcatgtggtcacttcatgtctctgtatcacattttggtaattctcaaaatatttcaaacattttcattattatcgtatctgttatggtgatctgtgatcagtgacgtttgatgttactattgtaattgtttggagctgtcatgaaccacaccgatataaggtggcaaacttaatggataaatgtatgtgttctgacccaccgaccagcagttccccatctctctccctctccttgtgtctccctattccctgagacacagtattgaaattaggttaattaataacccttacaatggcctctatgtgttcaaatgaaaggaagagtcacacatctctcacttcaaatcaaaagctagaaatgattaagcctactgaggaaggcatgttgaaagccaagacaagttgaaagctaggcctctttcaccaaacaaccaacttgttaaaacaaagaaaaagtttttggaggaaattaaaagtactactccactgaacgcaccattgatgagaaagtgaaacagccttattgctggtatggagaaagtttttgtactctgaatagaagatcaaatcgttaaaagatgaggaaatttccagtaggaaaaaaagaagatcaaaccagccacaacattcccttaagccaaagcctaatccagagaaaggccctcaacatcaaggcaagacactccaccagcacaaatattacaacttgttgaaggatgatataatcgttagcattttttagtaataaagtatttttaattagggtacatacattgttttttagacataatgctattccacacttaaggtacaacgtaaacataacttttatatgcactgggaaaccaaaaaattcatgtgacttactttattgcaatattcactttattgtagtggtctggaactgaacccacaatatttctgaggtatgcctgtaacaactttggagtcagacaggcaaggtcctagctttccacttactagttgtataaacttttcatttctctgaacctctgtaatttcatgtataaggagaataatgctatctatgttatgggttactgtgaggaccaaataagaaaatgcacatgaaatactcagcacagttccaaagtaaaataaatgttcaataaagggtagctattgtcattctttcaactaaaatttgagtggtgactctgtctcaggtacacaagaataaatcagtcatagtcctgtcctcatgaatctcacagtacagtttcttgagctttttgactgcaacaaagaaataacattttatatcatgacccagtacatatacatgcattttatttaaatatttaaaacaaaaggttcattaaatagtacttactcttattacatacaatgtactataatattttctttttttttttcttgagacaggttctcactctgttacccaggctggagtgcaacggcatggtcttagctcactgcaatctctgcctcccaggctaaagcaattagtgtgcctcagccttccaagtagcttgtaccacaggcatgtgccaccatgttcagctaatgtttttctgttttgttttggtttggtttggtttggttttggtagagacaggattttgccatgttgcctaggctggtctcgaactcccaaagtgctgggattacaggcgtgagacatcgtgcccagcctatgatattttctagtttatttcatcttgttttaaatgctgataattgcctaatttcataacccactagtgggttatgacctgtagtttaaaaactactgtaggaaagaatatagacaaaccaatgattagagcacagtttaatagcctctatgatagatgaaatgcagaacacttagtactaagagagaataaaggaataaccaagccagttctaagcagttagaagtagtgctcagaaaaaaacttcttggaggacatgctatcaaagttgagttaaagtttgaacaaaaaattttaaaatactttatccattatacaaaaaaaatgtttattttgcatctctttatgaagacaccaatgaagggacaaaagtagtaggtgcaataaagaataagcctagagaaaagcttcaatatatagaatagcggtcagcaaactttttttaaaggaccagatagtaatatttttggcttgagtgcccaagttgcctttgtagtagtcacagacaataagtaaaagaatgagcatggctgtgttctaataaaactttgtttacaaaaactgaagccaggcacagtagcatgtgcctatggtcccaggtatgcaggaggctgaggcaggaggatcccttgagtctaccagttcaagaccagcctgggcaacatagcgagaccctgtcttatttaaaaaaaaaaaaaaaaaaaaaaaaaggaaacaaaacaaaacaccaaaactttgttcacaaaaacaggcagccaccctgtggactacagcttgccaagctctgatctagaagaaagagattaccaaaaacagaaaaaagaaaaccatgccaaagtgttcaatggcaaataaacaaatttgattatttctaagtacctagtatacaatactaaaaagaaaacaataaggatatgtgaaggaaaaataaccattaccattttgctccttcaatttatagcaaagctgacccaaaaaagtataatcctgtacatgtaatatttcagaagagcagtaaaaggaggattttatagaacagatggcaagtgaatgcatgaataacagcacttaccaatacaactgcctttggcctcatggcttccactcacatttacaaacataagtggggaggatttcatgatatgctggatgaaatcaagcaacatcacggaggttggctgagagtcagttttctttacaagttctacagcaactaaaacaataagattcattttaaagagtcatgacaaattaaacaatggtccttttgttaagaaaccagactgtgggccaggcaaggtgcctcactcctgtaacccctgtactttgggaggctgaagtgggcggatcacctgagcccaggaactcaagaccagcctggataagatgtcaagatcccgtctctacaaaaaaaatttttcttaaaattagctgggagtggtagtgtgcctatagtcccagctactcagggggctgaggctggaggattcccttgagcccagaagttcaaggcagtagtgagctacgatcacactattgcactccagcctggaacaaagcaagactctgtctcttaaaattaaaaaaaaaaaaacaaaaagtggggtgggggtggggaaccagactttggtgaccagaattatatccagcacagcactcaacaacattcaagctaaattgatggggctaaacactacagtcttttttttttttgagacacagtctcactctgttgcccaggctggagtgtagtggtgtgatcttggctcactgcaacctgtgcctccggggtacaagtgattcttctgcctcagcctcctgagtagctaggactacaggtgtgtgccaccacacccagctaattttggtatttttagtagagacagggtttcgtcatgttggccaggctggtctcaaactcctgacctcaggtgatccacccacctcggcctcccaaagtgttgggattacaggcgtgagccaccgtgcccagccaacactacagtcttatctaattttaaatgtttaaaaatcacatgcattcctctaccatacatctatttatcaaacatgtacttcaggaataatatgccaggcaatgctaaaatctaaggattaaaaaaaagttctcacaatccagtggggcgccaaacaaaccaactaataattataatacaatatggtaacagcactaatccagaataaggagaaacaggtatctgggaggacactgtgaaggaaatgattcctagatgaggagttggtcagagaggggaagggcaagtagtctaaacggagggaatatgaatacgatacaaaaacacatcttgtaagtattcagtagtcctttgttatttttcagcaacccatcattttactgattgaaaaagaaaggattaatggctagtctaagtcataaaatctgcgccaaatttggaatccaaattataaaccctgagcctaatgccattttatattatccctcccatgtaatttcaacagatatgacaaatgtgacaccatcttgccaggttggtaatattctgtctagcagattggcacaaacaggcaataattgattcagtaactcacataatcctataatctcctataggcacaggcatgaacctacttaaagagtaacttacttaaagaggtttttttgggtggcatttgctattagtctaccactggcataacagctaaccaaaatagggtccacatgattggtactggacaaatatttttacatataatatccaatattaaagaactcatagcaagcagtagaaaatctagataacaaacaggaaaagagaattattttaaaagcctaattcaaattttgtaacaagcaataagcaatactgattaacaaataacttgcttgaaaatagtaactatcataaatactccatatctaaaactacatggagaaaatgctactataatttatacatggaaaagaaaagtctaatttataaagtttatataagaaataattggtttcttaccaacatttacatctgtaagtatccggtcaatgaattgacacagaatttgtcttggcttctgtacaactgtattatattcctctggtgtggcactaaaatacaaattaaaagcttttaatccttaaagtgactcagtttcatttgcaaaaaaaatttctctaaagtagaactcatcaaatgtgttcagtgtcaatgttgatattcacagtattcttctgtttaaaaattgaaaagaaaatctgaatatgttaccaacttacaagaaaaaaaagaatatgctaagtaatactaaagagatccaatcagcaaagcctagacctgaacttctcaatatggtggccactagctacaagtaactagggagaacttgaaatgtgattagtacaaattgaaatgtgctattgatggcagtggcagcccagttggagcggtgaggaaggtggtgctagggctgctctctccagggcgctagtgggcagaagccccgcccccttctgaggtgcaagacaggtggaagccccgcccccttccgagttgcagggtcgggagcccagccatcctgggtgcagctgcagccgcccaaccacggctgcaaacccaggcatccctgctctttccagggccgggaaggccccctgccctcacagacttggaaatgcctgctcccgctgcctggcctctccccgctcccggcacccacaccaatttcggagcaaagttgtgggggagcccaggtgttgtcaggaccaggccgcgtgtgcatgtgctcaggacggcactgacacaccagccccctgctgcctcatctccctctggactttgggcaggccaagcggtaggctgagggcagctcaatatgggcctgcaggcgcccctcggcacgaacagcctcggtgtagtgggtggcaggttgatggcagcaggaagtaggctcctgggaggaaaggggtgggtccccagtgaagacccaccttcaagccaggaacagcttgaagcctggaagcctggctgccagttacacggaccacagcgagaacttagggtgctttttccaggcccacccatgactgcctatggaccaattagcattcacttcctcccttctgaagcacataaaaactaaatttttggtggaacgctaatacccttttccacagtggctgtaccattgtacactcccacctgcagtggacaagggttccaatttctccacatcttcaccaacacacgttattttctgggtgtttttttattattattttattttccccttttggcgacagggtctaaccctgttgcccaggttactgtgcagtggtgcacccataactcactgcagcctcaacctcccagcctcaggagatcctcccacctcagcctcctgagtagctggcaccacaggtgcatgtcaccacacccagctaattttttgtattttttgtagagacagggtttcaccacgttgcccaggctggtctcaatctcctgggctcaagcgatctgcctgctttgacctcccaaagtgctgggattgtaggcatgagtcaccatgcccaactgtgttttttttttgtgggattttttttgttttttggttttttttgagacagagtcttgctctgtcaccaggctggagtgcagtggcatgatctcaactcactgcaacctctgtctcccgggttcaagcaattctcctgcctcagcctctcaagtagctggtactacaggcatgcaccaccatgcctggctaattttttgtattttagtagagatggggttttaccatgttggccaggatggtctcaatctcctgacctcgtgatccgcctgcctcagcctcccaaagtgctgggattacaggcatcagccaacatgcccagccccaactgtttttttattaatagctatcataatgggtgtgaaacagtatcctgtggttttgatttgcatctccctaatgattagtaattgtgagcatcttctcatgtgcttatttgtccatttgtatatcttctttggagaaatgtctattcaagttctttttctgtttttcatcaggttatatttgttgttaagctgtaggagttcttaatatattctagatattaaactccttatcagacatatgatttgcaaatattttctccagttccatgggttgccttttcactctattgatactgccctttgatgcacaaagtttttaattttgatgaattccaatttatctgtttattttgctgcctgtgctttgtgtcatatcaaagaaatcattgccaaatccagtgtcataatgttttccctctatgttcccttatttttatttatttatttactttttgagacagagtttcactcttgttgcccaggctggagtgcaatggcgcgatctcagctcaccgcaacctccgcctcctgggttcaagcgattctcctgcctcagcctcctgagtagctgcgattacaagcatgtaccaccacgcctggctaattttgtatatttttagtagagacagggtttctccatgttggtcaggctagtctggaactcctgacctcaggtgatccacccatcttggcctcccaaagtgctgggattataggtgtgagccaccatgcccggccccctctatgttcacttctaagagtttcatagttttagttcttatgtttaggtatttgtatgccttttggacttttaaaattttcctgtagcagtaaagagagaagccagattgcaaggggctgaaaatctaatgaaatgtgaatactgagaatagcgggttctttccaaagcttgatcatgaaatgaagagaagtagagttggtgataactaaagaactgtatgagatcaagagggctttgttttgtttctcccttataatggaaagacctaagcaaccaattcttgagatgtgactcctcttcttggaaccagatataagtaaaaagacaatccttggacaggagggtaactctttcataaacatagaaagaatggatgggtacagacgcaaataatttaataaattcaaaaggcaagtaaaacaagatcctctgcttcaaagaactcagaatagttgctggggagaggagaggaatgcacttaaataatcaaaagcggccgggcatggtggctcacgcctgtaatacgagcattttgggaggctaaggcaggcggatcatgaggtcagtagatctaaaccatcccggctaacatggtgaaaccccatctctgctgaaaacacaaaaatcagctgggtgtggtggcgggcgcctgtagtcccagctgctcaggaggctgaggcaggagaatcgcttgaatctgggaggcggagattgcagtgagtcgagatcgcgccactgtactccagcctgggcgacagagcgagactcagtctcaataaataaataaataaataaataaataaataaataaataaataatcaaaagcaagtatcatgtacacccaaagcagggaatgattaactctacctagaggattcacagtgggttatgtgtgagtgattagcaaagtccatcacttctgacaaaacaacttagggtgtagtaagacagttacttataaataatagcatatatttcatatatgtcacaatttatttctatatagcactgtaaaatgttcatacattttccccacttattatctcaaatagtggtaaaagaaaaagagtgaatttttttctttttctgatacagagtctcgctctgtcggccagggtgaagtgcagttagtggcacgatcttggctcactgcaacctccgccacccgggctcaagcaattctcctgcctcagcctcccaagtagctaggattacaggcgtgtgccaccacacccagctaatttttgtatttttagtagagacggggtttcaccatgttggccaggctggctcgaactcctgacctcaggtaatccgcccgcctcagcctcccaaagtgctgagattacaggcgtgagccaccgcacccggccctttttcttttttttttcttttgagacggagtctcgctctgtcgcccaggctggagcgcagtggtgtgatctcggctcactgcaacctccgcctcgcagcttcaagtgattctcctgcctcagcctcccgagtagctgggactacaggcacgtgccaccacgcccggctaattttttgtatttttagtagagacggggttgcaccatgttagccaggatggtttcgatttactgacctcatgatccatccgcctcggtctcccaaagtgctgggattatcggcgtgagccaccacgcccggcctgactttttttttttttttttttttttttttgattattcaaaccacaaagtccaatcctaattgattacatataggatcaatagcatttacagctaataaatgccataaaagaactgatactggtcgggcatggtagctcatgcctgtaatcccagtgctttgggagtccaaggtgggcagactgcttgagctcaggagtttgagaccagcctgagcaacatgatgaaaccctgtctctacaaaagaaatagaaaaatgagcaggtatagagacacacacctgtagtccccagctactcaggaggctgaggtgggaggatcgcttgagcctgggaggctacagtgagccaagattgtgtcactgcactccagcctcggtgacaaaaccagacccctgtctccaaaaaatagaaaagaaaaaaaagaactgttctctggtcctggtacatagtagacatttaaagaaaaaaaaacaactcttcaatgaatgaatggttcataagaaccttcctgaattttgtggtttcttcattcctaatgtacagccttctggacctatggaatatttacctattccctgccactagactataagctcctacaggtggcagactgtgctttatttctctctgcatgtcctaaagtgccattagaccgtaagctcttataggagagaaaatgcattttatttctttttgcctctgctacatcacctagaacttgcttaatagaaaaacttactgaaattaacaaatgtttttaagtaacataaactctagacacaaagaatcaaagggccaggcgtggtggctcatgcctgtaatcacagcactttgggaggctgagacggactgatcacttcaggtcaggagttccagatcaggctgcccaacatggtgaaaccctttctctactaaaagatagaaaaattagccaggcgtggtggtgggcgcctataatcctagttacttgggaagctgtggcactgaggcaggagaatcgctgggacatggaggtggaggttgcagtgagccaagatcgcaccactgcactccagcctggatgacagagtgagacttcatctcaaaaaaaaaaaaaaaaaaaagcaagtttgtatatgctactaaataaagtccttaaaaaaaaaaaagaatcaaagaacaagtagttacatttgcatatgaaagcaaaacaacttagtgctatgtatcttatttaaatcagcgctggccaatagaaatataacgtaagccataattttgttattttctggtagccacattaagaaaagaaacaggaaaaaaacaattgatcctaacaatatatctgaaatattaggtgaatgtgtaatcgatataaaaattattcatgagatcttttacattcttttttctggtactaagtctttgaaacccactgtgtatcttatatttacagcacatctcaatttagactagccgcatgtgaggtggtcaatggtcacatttggctagtggctaccatagtatagggcatcacaaatttaacaaaaaattcaaaatctgtaattacaaggtaacatgaattgttttagacaaagtcaggagacattatgataaaccacagtaatttcacaagtatcatttaaaaatgtgaacaaagaggaacatgggaagaggagccaggattgtgggtagtggtcagagtttcttacaaagtttcattttgtaaagattatgtactcatgtattatttgtgtaatttttaaaaatcagttttagaaaaatgtaaattgattaccattcattagatctactatcagaagaaagaaacttggccgggcgtggtggctcatgtctgtaatcccagcactttgggaggctgaggtgggcggatcacttgagcccaggagtttgagaccagcctgggcaacatggtgaaaccccgtctacaaaaatacaaaaattagccaggcatggtggcacacacctgtagtcccagctacttgggaggctgaggtgggaggatcgcttgaccccaggaggcagaggttgcagtgagacatgttcatgctattgaactccagcctgagcaacaggtgagccagtctcaaaaaaaaaaaaaaaaaaagaaaaaagaaagaaaactcacaggagtgagcacttcttattttgtgacttctaccctggaactgagctaagagggtataacttttcaaaagcatactataaaatttgagtattaatgtaagtattatataaagcttaggcacctcctctgaggtaagcatcaaataccaggataaccaagacagaatgcacctgccctaaaataatttgcagattaaaggacaaacaagaggtaattatggttaagaactgacaggcccaagaaagaacacaaagggacactcagccctgagcagggccctgtcagtcatggcttccttaacgaggtgatacaaaactgactccctaagggacaaggcagtgaaataagggtaagagggagggtagtccaagcactggaaactgtaagaggctctatgtggctaaagcctttagagatgcagctgaagagggaagataaggttaaatttcaaaggactggctaagtagtttggattttacactgaaggcaatgtgtaagcactgaaggattttaaggaagtaaaaattaagcaagttttaaaaaacttgcttatttccctgtttaaaagattccaatggtttcccatcacacaataaaatctcactcctttttctagcctccaaggtgctgaaggatgtggcccttgcctacccctccctgtttaactcataccactcccctctttactccctgtgctccagccttcttactatccttttaaaagtaggctcattcagccttggcatggtggctgaggtgggtgcatcacttgaggtcaggagttggagacaacctgtgcaacatggtaaaaccccatcttcactaacaatataaaaattagctcggtggtgcaagcctgtagtcccagctacaggaaagggaggctgagacaggaaaatcgcttgaacccgggaggcagaggttgcagtgagcagagatcacgccactggagagggcgagactccgtctcaaaaaaaaaaaaaaaaaagcaggctcattcccacttatgggcctttgtacttcctattccatcccagattcacgtgactagcttctttacaccatcaaatctcctctagtggctaatgctgctgctcctcagaacctcctccacatcccactgttccatttaacattttaatagcaactatcacatttgaaaatgtcttacaactacaaagcaatctcaagtaggaaaatcagagaaggtgattctgaaatgacatctaaatgaaaccatccagtgttcagatagaaggaacagcaaacgattaaaggcaggaacagccttggtatcctggagaaacaaggtcagtatcactagagtaaagtaagcaaaagagggataaaaggtgatgaagtcagaggcaggctgagccagattatgtagaaccttagaggccttggtaaggagtttggattttatactgattttaagtgtgctggaatgtcaaaggacggttttgtgcaggggaacttacaatatgactaatagatgaaaaatcactttactgagtggaaaatctattataagtaggtaaaagtagaaatggaaagatcaactaaggttactgtaatagttcaggtaagaaattctggtggtagcagtggagacagtgagaagtgttagattctagatgtatcttaaacatatggttgtcagaactaacttatggattattaagcgacaagggaaaaaaaccaaggatgactcctaggcttttggttggcatatttacgataacacaggagaaggaacaaattcaagggcgcagtaaatcaggcgttctgctttggatatgttaattttcacttcccagtgtggatgttgagtaagcaacctaatatatatctccgatctagaaatataaatttgggagttatcagcatatggatgacatttaaagccatgagattaggtaagattacttgggaagacagcacagattaaaagagggccaaggacatagactgaaagcacatgtgaaaatagttaagaatgacttctagatttccagtttggagaactaagtgaatatggtgccatgtactgagatatctctacttcaatgaataagagaaaaataatttttttaatttaaaaaaagaaagcttgtgaaagctaggacatgtggggaatttgtattggatattctgaaccttaactacacataggacactcagtgaaactaccagtatacagtaaatatacaattctatagaagacatgatttggagaaacatattagtagtcatcaaatagcagattatagttgaaggcaggagagtggaaaggtcatttagcaagattatgcagagcagactgctaatagcaaaaaaacaataggacaaaatttatctgagggactgaggaagagcagcccataaattagaacactaatatctttttttttcagtagtctaattgccatagtcaattaagaggaaacattttggaagaaaaggccttgaaagcttgaatctgaaacctagctctgttatctgctagctgtgcctttggttcttcaacttctctgtccctttttcttaaacagtggtaacacttgtttcattctatgtcatggatatactatgaaaattgattagcttttttgattcaagtagttgtaatgaaaaagccatgacaattaaaaactattagacaactctctgtgggtcagtttttctattctttctcttggaatagctacaaataaatgaaaggtaacataaactctactgatgaaaccgactatatataatccaagaaccaattatttttattaacaggactcacggaggaagacagaagagggaagagaagtattaaccagttaattctactttaaagcaaagtggcaaaaatatactcagcttcacaatgagcctgaaagatgaaatttgtaaaccaacttcctacaatgatcacttttcttcctcttcttttagagaggtagaggttattttataaactaaacacaaagtatacttgccacagataagtggaaaaaattcacacactcaaaaatagtgatgcagttacgacaagaatggtcccttcatttatccttttattcatatattgagactagattatttggatggccaaccagtggaaatgaacacaactgcgctgcaaaaagaaagagaagtagctatcccattggcttaatgtcagctttgactttgtgtggaaagttttcaaacagtttaagaaattgggaagcagttattccaaatgataatttaactgcggtagcagcacaagcttatttatttcttgttcgcagtagtgtagaattaaaacaaacaaagcaaaacaagctctaccgagtctttaggcctggttcagggaagcctgcctgtgtattgaagaggtgtgagagccatcaacacctctccctccttgtggtaagatactggttttcatgaggtttacagacaacatgcatttgcaaatgaaatattaaattgtctccaaattttggcaacactctgtgcacgctgagattttgtggacccaggggtctatctctccaatttctgactaaaataacggatcgggaactggacgatcaatacgagggaggtcacatcttcagtatgtactatgacttcacttcaaagaaaaaaactgccttttccagcaagtgatgtcacttgcagaaaatgagaagcggtgattttctttcaagggcagtttggggacaaaatgtaaggctaaaaaccaattcctccacgagtgatcacaaagaacagaaactgatgggtcaagtccctcgtctaaggaaaaagattttcgagaagaaaatgagtgtagaaaagtgaccagaaagcgatcagcagggactcttcctccagctgcaggaagcaaactctcgatcggggtgagtggtaaaccagggccggcagacgcctctctcccccacggaccggcttcccgcaggtttgtggcgactgccccatgtgctatcaacgggcactctgagggagaagcgcccaaatcagccacggagcatctccacaagggccgcagcgggggcttaggggatcccagccatagcgcagcaggggaggggagagcacgtgaaacccaagccggaatcagcggaggaggatgcaggacccaggctgggcctagccctacctgcccagctcccgcagggcggggatcatggaagccagctccaggccatgttcccccatgctgaggctgcgaggcactagtcaaccacgccaacgcgggttcccggcgtctccaaagctaccgctgccggaagagcgcggcgcccgacggagccgtgtggaggccaaaactcctcccggaa

SEQ ID NO: 1540 - DNA, 370381 bp, Homo sapiens
tcagtttacaatgcataatgatatgtctttatttcatcaacagaaatggtgtctagacaaaattcagttaacactagcaattcaattgagtgaaaactttttttgcacaatagtgtatttacaatgagtaaatgaagtttcaattcattagttcatagcaatgcttttttcccccaaaaggtaaaaattcttagttacagagaataagcatcaacagcctttcattttttacaataaaaaccacgagaaaaaccacaatcacttagaaaaaaataaggacaagcctaagaactagtacaataaaatgatgcattgaattaaattacattaatcgcatagaatctgtgtaaaaagtatgtagaaaaacacctgatgtaacctgttacagtcgttgaccagttatgagaggtacagagggttatacaggtagatatgtgtgaaaactgtccgtattgttcaacctggggaggaagagaagaggggctgcagccccttgcatacactgagaagaccctgttttgaatatggcctctggagtttgtaaggcatatattagaggtgcacttgcatcagactggttctggaacaaattgtcaaattgtcacaggctctcttggcctcactagcaaaggtggtgcttgccttgaatggctcactgtgtctaacaagcacctgaagctcccaaatgcatatggaatcttcctgatcactcactagaggtgccatgtctttatgtcagagcgtgaaacgggcatcccaggatttgcacacacaaaatacattgttaggacttaaggggaggtcatagttctgcctccaaacatgttttggtagaagactgagcatccatctgtaggaaaacccctctttgtccaagtcccttcactctttcgcaacatatgcgtctgattattcccatgggagcacttggcactgaatgtgagtctacctgaaatgaatggtcttggtgcacacttctgcttctaagaagggccagtgttttatctgaggtcaataaactggaatgagaatgaaagtcagagctgtttatccattgcttgacagcaaaatgcatacaccgtgtcacaacattaaatcaaagctatgaaagttggcctctgcaaccaagtgggtattcttcacaaaatggcagcatcgttttcatattacatttaaaatgcactgatattcatttgatagaaatatcatctcccagggtggagtgtaggaaaatactataaacttttctttgcaagtaatgtttttgcaccgtcagttgaataatttatgctcaatctgccacaatgagacttttctatgtacaaatgctatttgcacacactatttgtgtacagatatgttctgttctacagcatcggttttggacgctggggtcatgagatggctcaggcagtactataaacatacactttcaacacacaatgcctcgtgcacacagatttcctgtatgaataccaactccacacagggcattgtattgtggactgactcaccagaaattgcacttccaacacagtcttcagtttggggaagaaacactaactcatgatacaacgaacagctttattcttagaaaacaaaaacaaaaacaaaaaacaccttgttctttagtctatttacagtcatttgaggaccaaacttgattcttgctccttctggatctgagactcctcctaaactgtaagcaatagtgaagcagtttgaagtcatttctaagacagctcctagtttaaatggggcataatgtagagaagtaggtagccaaatagggacttgagaaagctttgcaggcagctcttcctcattttgagaggattatgctactccacaggatgtcaagcagcttcacgggacaggagtttttggtgtcttaacaggcttatcattttcaaacctttgtctgttccttctttttcttcttctttgatggcaatcataaaatattaaaagagaaaatgtgggtttaggcctcttgacaacagcattaaacttcacactgtgcacacttcactttagccagtcctctcatgagtcttgtcgctggtcctggctccttttgaaggagtagtggcagttggcatactaatcactagacttttgttcccttccttggaaaagcaatgtaaggattacatcccgaattatagtgcatcttaaaagcagcaaacctttagaaagacagttaataaattactcgcacaacattcagttgcagacacacagagtcaggttttccactgcagcatcatctctgatgcctgagtcattgctgggaactcagaagataaatagcaggatggcctcgtaactttgtcggtttttttttttttaaagtttttctaactgttttgttccagaatcagtatgtaataaagttcgattttaatcaaggcacccccaggtaacgcagagaaacaaacacatacagcaaatcactcacctgtccaaagcctgaccaacttgaaaagaggttgcctggatacacaagcaggacaaaggcagatccaaggggaggactggatttaggtgggatgttcattagtctcagggtcactcacctccactggctctgccccaacaaccattcctaccccagccatttggagacccaagcaggcatcctcctaaacagcccgtggttggagggtctcttatttttgtaagaaaagagccttaagaacaaccaaatgttactgtactgtgcaaacactcttccttgctgttcactcacttttctttttcctaaaaggcgtggggttgacagagggatcccagggaaaagagacaggctaggttttaaaattccacttgaggccgtttggattctggtccccagcaagtcctccctttgaatcaacccagaaataattttgacaagcacatagttctgaataggaaaagacacacacacatcacatgaacaactgcacgaagctagtcactgttcatggtggattatgaatgaaataacttgtgagaaatctctatgaaattggaagatggtttttagagcagtgtttttaaccagttcccatggcagaagttaggttgggggaagaggaagaaaagcaaggcaggggtgggtgggaggaaggtgaggtctgagttagggtggagagaaataaagaggccccgcccctgctagaaatggctgccaaacaggtctgggctactgaaccacagaaacctgaggaaatggatggaatgtggtcaagactaccagttgcacatgagttgttaccagggtaaacctcatgccaagaagctgggttggacctggttatgatatgagcagaaagtgttctttttttaaaagaagaggagaggtcacttggaaaggcaacaatagagttaaaaagcaaaatactgtcagctgactccactgtaacacacgcctgcgaagtatcacgtgattcacattgagtttatattctcactgtcaccagttttccacaaaggcaaacctcatggtgaagcacagaactgtcctagtaggccaagaaattccaacaaccataacaaaaaccagcagctccaacacagagctttatcaagatctgtttcagacacacacacacacacacacacacacacacacacacacacacacacacacaaacaagaaaaaacaaaaacccagaggcaggttttaaaagtggaactgtttaaaaagaaaagccttttttttttttttttttttttttttatcctactgcatgaactgacaaatttctggcattcatacatatttaaacatttagtgctaatatttgtacagaaaaaagttaataatactaaaacatatgttactatgatttcacttttagcctacatcatatactaatttccccttttacatgcagctttaatattgtccaaacaatggcacaaataaagaaacaaagtcaaccatctattccccactgcccaccaccccatccccacatcaaaccgttcaggactctcttccccagccgggctggagtggccctcgggctgctcagtgagacccggacccaaggccactggagcgagggagctgattcctcctcctctggggcacaccttcctgtaaacgtggctggggccaacacggccccagagccaagggaagctgctctctctgggttgcaagccaaccagttttgcagcaagaagagaaaattatcatcaggtgagggtagggtatgtgtgtgattcgggaaggggacagggagggttcccggtgatagcttgtccaaagcctcagaatgaagtctgccttcagacaagacactggcagaaaaacctcagaagaaaactccaagcctttggagaaggaaaggagaaagaatgtgtcagcctgtgtcagggatggatcgcagatgccaggatgccctgctctctcccaatggggtgaaggcaggaccttcggggctgtgattcaaatcccctcaggccagatgtcctgggaggccaagcctgggcaggaaagccagtggctggttggccccgtccttcaggggagcaggtcctactgcacaacacttccaagagcaagccgaggcctcaggacgtgttgaaatgaatgggacttactccctgggtgaaaactttctaacttgatttctaggagccaatgcctgctgagttctggtataaaatcacggattcctgtttttctgatgtacttttgagtgagatgtccaaactctctccccacttaggaatctgaacatccagcatcaactctgaactctctatctgcgtttaaactttgcttagggaaaggtggggaggaggtgaaatataaaaatattcaagcagattattgtctacacatcctaggatgaattcattatttggcaagattgtttttcctacataattatcacctgagtgctttttaattagctaaaatgttttacttttttaactaaaagcaaagaatatacagtatacttgagttataccgaagttacaacttcatttaagaaaataggtttgacccaaaactcagtgcaagtggcaaagttgaccattactgtacagtatctgcaaggaaaacaaaaacaaaaacaaaaacaaacaaaaccccccaaacaaacaaaaaacaaacctacaatgctcaaatgacaccacttggaggtgccaaaaccaaaccaaacgaaaaagaaatctgaaataaaaccttgggaaaaagcttccaacactgaattttgtccataaataagtacgaattgaaaattgaactgtgaagcaagaaaaatgaccatgttaacagttaccaaactagttctagcatcagagacaaaagaagaggaatgttggaacctgtttctaaatgagaaataagtttccagttttaggatgagaaagttgaggcatgcaggacttttgcatatggatatatatatatatatatatatattttatatatatattatatataatatgtacagtctagctataaaactttgatgtgtatagaagctgtcttcaatgaaaaaaattgaacattcagaagaaattcctgagatagggtttgtgacatgggccactgagaaaaaaaatccgtggttggggcctagaggtgttgtagtctatccctgtgaagactgaaattgagccacagacagacagtgtcatcactgctgtctttccttgcctgggcaaggggtagcaccattgtgaaggtaactatcactcctgctcgagaagaggagaggatacttcggaacagtattgctgctaagaccgctgtagtgtgcaccaaatgtgttctcggtttcttcgggacagcagatgaacagtgccacaggctgactgaagaacgcctggatgggagaggtgtgcggactgggaggcagagccgagtcactaggtataatctttcctgggctgttcgtcagttgtacacttatcagtcatttcctggcagaagtccacggtcactgtttggctcctgggttcaagaggaggtcctctctctgagaaggttcccgggtcagtgccttctagtctcctcccagaggtacaattctcggaggtgttgctgggtgcccaggggggtccggggggagccgcgcctggctccaagcagcagggcacgttttcccccactgcgcattgggaggccgcaatgttctgctcagcacccaagggcgcagggttaatactggaggccgtgggcaagtccatgggtctgaggacagggcaataccgatgcagggcctggatctgctcggggctctggatgtctcggcaaacttcctgggaaaggcaggagaagttgtccaacagttcccccatgcatgctttcagttgattcctctctgacaacagtttctctttctcacacacctggacagtagagaaaaaaagagaagggttgatcaagcctgaactggaggacagaaggcctcgtttcaggttttccagcctttgttttgcatcctccattataatgtaactcaagaatgactaggtcaggctctagaaacttaaagatacatattcagggggcccagacacaggcttctgccacaccttccatctgatgccaacaccttccccaggacatctcttcatccctctccaaggcccgggcaaacaaccggcaaaatcgtcacgaatcagaaaacttcagagtccatgttttggtttcctggaatttggggtttgtagagagttaaatgaaaaactctcagtcccaatcttgtgactgaaaatctcccccaaatgtatcaggttgccatttttgaaaggcaaaaatctaccattccaaccgtatgacatttcgaaaaaagcaaaactatggaagcagtaaaaagatctgtggttgttaggggtaaaaggggttgaacaggtggagcacagaggatttgggggcagtgaagccactctgtatgacactatactggtggatccatgtcattatacatttgtccaaaaccatagaacgtgcaacaccgagagtgaactctaatgcaaactatggacttgggtgataatgatgtgtcagtgtaggttcattgactaacacatgtaccactttgtgggggatgctgacagtgggggaggctgtgtgtgtgggaacaggaccatatggaaactctctgtatagtgtgttcagttttgctgtgaacctaaaactgctcctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtactagcccaaggttctgagatgttcttctccttaaacaaaatcctacacatgctcctgtgttactgaaattcaccatcccaatagagaggtgacttcagcagcagactggagactaattaaggttttaccatcaacatttgtgagaagggggctgggcatggtgggtcatgcctgtaatcccagcactttgcggctgagatgggcagatcacttgaggtcaggagttcgagaccagcctggccaacatggtgaaaccctgtctttactaaaaatacaaaaaattagctgggtgtgttggtgcgtgcttataatcccagctacttaggcggctgggacatgagaattgcttgaatccgggaggtggaggttgcagtgagccgagattgcaccactgcactccagtctgggcgacagagcgagactttgtctcaaaaaaaagaaaaaaaaattgcgtgagggtgaggggaggagatggggttccatgaggcacacacaatgaagtggatgaagaaaaggggcatctgaagcagcatgaagtcagttctcaccaaccctttgcaagcgcaggcaggagaagaggacgggagagaaaatgaagaggagaaagggaggagcaggcatgcgacacgcacaaggaacaggtctccgacacgggagctgcatgtgccgtaacatgaatgcaatctggcaggcggcgtgggcatgtgtgtcggaaagagagatttacaccgggaaagggcacctcctaaaatatttataaatttatcaagaaaatatgttttaaaaatgaaaaataaacagatgtacaagtgcaacttgagagaaatacattatgcgagtttgcaacagctgagtggcgggtgtgtgggagacggcgtgggagtggggagtgagtgcagggcctgctggggaccgggcagggcagggagggacttggggagaggtggaagctgctccgcccaccagcgccatccctgtcaggacatagcatcctcaccacagggtggcagataagaaacaaaacacatctgggatgtctccttagggaaaaaacttatatgggtggctgtgcaacctggagctctccccttttagtacagaaatctgcaatgtgaggggcaatactgcttgggcgctgggagaggaaccccaggatcattctgccacattaccccggccaaagcacggacccctccaggcctactcatctgttaaatgttccaggccactttctagggggaagaaaatgaggtgccgcgtgtgacagcagcaggggaaggcattgcaaatcatgccttggttaaaaccatgaagctctcagtcacagacgtacactgatgaatgtgttcttattcggcactgaaacacaacgtgttatttaaggggatgccaaaaagtggttggagaactagatgatgctctaatttggttttttggttgaaaaatgctagcaaagcgctttagatatctgcctggtctgtggcttggaatttatttgttcagtatcacaaaattacactaagcagaatgcaaattaccaaaaccaggcatttctcaaatgtgggtgactgaagttattttactaccttaagaggagtgcagggcactatagacatgtgcctaggcccctgtagactcacacccagtggacttaactacctaagcccagcaggctttcagaagacccacactcaccagcaggaatgtcgtctccttatgtgatttaaattaaattttgttgtttaacgacattaaacatgttaaagcaatatttgaaagaaagaagaaactcataatcccctgaactgaatagtcacaatgtccagcgaattttagggcaatagacattttctgggcgccagcaatgggtccaacactggatattcagagatgatcaagtcactgtccttgtccttgaggaactgacagttgagggctggggagacagacaaatgtatagataactcaagagtaagtgataagcactaagccagaggtcagatcaggcttccacaggcaggtgcccagcctaactggggactcaggaaaggggcttcctagagaggtgatgcataacctgactcattcattcatttagagatggggtcttgctatattgcccaggctagtctcaaacttgtggcctcaagtgatcctcctgcctcagcctcccaaagtactgcgattacaggtgtgagccatggtgcccagccatgacctgactcttaaagaacaaaggagatagaaaaagtggaggaatgtccaaggcagagaggaagtggcataggcacaagtgcagagtttgattttatcagggatcaagtcctaggaagggagtggatggtgacactggagaggtagctacagactggaacacaaatggcaggagatatcctactaagaagcttggactttctttgttggtgatgggagctgctaaacacagacattttccctggtggtgagtgtcaaagaaacccacaaaacaacaacaacaacaataacaaaaaaccctgacgtccagggctatcttgataacatataacatcctgtgcttttctaacatttcatccttgtgctttcgttctcattagctggtggctcaccatgaggccaggaggtgctgcaaacagtctgaggagccacacttagatcatgaccataccatgtggcctccctcttcttcagcctgacacagacatggcacctgagatgagtttctgttatttggtggcagaaaggtggagctgaaggaggttgagttggttgtcttcaaagctacagtcaggagccagaggtcacctggatttactttctgtagtttatggttgcttatcaaggagaaggggcgggggcacatagctctgagtatgggggagcctgggagacgggagtttgttttctgtgacaaaacactctcaggcacagggatggcgatgacagccaccttgaggcagaactgcaaaagaaaggaccctgggcctgcaaagaatgtcaggagatcatctcctgagcaatggcccctctgcaggtaggcgtcctatctctattccattctcttctgccaggaggcaggagaaagcagtggtacaagacacgatttggaatcagacacctgggtttgcattcaagttctaccaagtactgggaagttttccagcccttctgcagttccctcctctgtaaatggggataaaggagtgcctgagtcatagcgttcatgtgaggattaaatgggatcatccataaaaacagtttagaagaatacctggaccatagatgctcataatcaacatcagttatttattcatttttttttgagacagggtttcactctatcacccaggctggaatgcagtggcgtgatctccactcactgcaaccttcacttcccctgctcaagtgattatcctgcctcagcctcccgaatagctgggactacaggcacgtgctgccatgcccggctaattttttgtatctttagtagagacagggtttctccatgttggtcaggctggtttcaaactcctgacctcaagtgatccacccgccttggcctttcaaagtgctaggattacaggcgtgagccaccacatctggccaacatcagttattttcacatgttggatggaaaataaaaaataactacctctatatgaataatgactgaaggatataaaatattgacacactattacacacctgcgcgcatgcatgcgcgtgcagacacacaaacacacacacacacacgcacagatgtaaagctattatttctgttgagaaacttcttaaaaaataaacccaaacttccgcaaagggtgacccttctgtctacttttccaactttcattgctgttactttacattagtcctggtcacttcaggttgctgatcacaatggatgggtcaactcaccaatttgcggatttcacattctaaattctgaatacagtccagtttccttttgcggcagcgctgggccgcgatgcggttcttgctgcgccgtcggacatcatgaataaactctaactgttctgaggttagcttgtgcattttaatcatcatctggaaatcgttccttggaagatctgtgatttgatctacaggaaaaggaagttttacctgaaaccaagaataacagaaaatgattatggcagctggattttaattctggcaggcggaacatcaaaaatgataaaacctcctttttatgatgaccaagtaatatggaaactactgaaagcaagcagtgattacttatttcctgtttaaagacagataagatgtaataatacctggataatcaaacagaataagaacacatatattgcaatgttattgtctctgagatttttgaagcaaatgacatgaacaatattggaaaatgtgtcatttttcattgatgtagcacttttgtaagaaagattctagttagttgaaatgtacttccataagacctacagcctaactcaataaaatgacaagttatagggagataccacataaggacatatctaaagcccctgaatgaagagagccccatgtatcctgaaaatgctggagacacaaaaaacccagtgtgattcttagttacaatagcatatgggagataggaggagataacttggataggcttcactagcatatagtaggagtcaaaagaaccgggctttcatccttctcaccagacatgagacctcaggctagctactccacctctctgagattcaatttcctcatctgaaaaatagggcattttaaaaaagccgtacagtgctatacaagtgttgggcactttgggaatttattttccaattttacaatgaaatgttgacattcctttatcaaaaggtgagatgcatttttcctgccttttgaccaacagaatgcagcagtagtaatggtgtatagtttctgaggctaggtcgaaaattagctgccatgcctcgaggacattcaagcagctctgtggagaggcccatgtggagaggggctgatgcctctagtcaacaaccagcatcaccttgccagtcatgtgaacaagccaccctggaaagattctctagccccagtcaaaccttcagttgagtgtagccccagccaacatctgacttcaccttatgagagatcttcagcccaaactgctcagatgggcaactcctgaattcctgactcacattcacatttctcatagaaactgtaagaggtgttaagtgattactattgttttaggtcattaagttttggggtgatttattatgcaacaatagacattggatgcaggtacttgccagcaaaattccaaatcttgacaaattccaattcttgacaaatcaaggcaaataagcattatctaaagcgaggacagcagtctcctgaaggatgggtttgtatccttactatgttgttaaatgattgcttatatttcttttttttttttttttttttttttttgagacagggtcttgctctgttactcaggctggagtggagtgttatgatcacagctcactgtagccttaacctcctgggctcaagcaatcctcttgccttggcctcccaagtagctgggacaaccctgcccagttaattaaattttttttttttttttttttttgtagagatgaggtcttgcgccacagagaaggggaaaaaaagagatgaagtctcacaatgttgcccaggctggtttcaaactcctgggctcaagtgattctccctactcagcctcccaaagtgttggtattacaggtgggagccactattcctggcctgaaatatttcttttcttttttcttttgagatggagtctcggtctgtcacccaggctggagtagagtggcacgattttgactcacggcaaactccacctccctggttcaagcgattctcctgcctcacctcctgagtagctgggattgcaggtgtgcaccaccatgcccagctaatttttgtattttcagtagagatgcggttttgccatgttggccaggctggtcttgaactcctggtctcaagtgatccgcccgccttggcctcccaaaatgctgggcttacaggggtgaaccatggtgcctggcctgaaatatttcttaagaatagcaaccagtgaaaaagactgcatgaaagagccccaagtgcggaaggtgagcagcaaaccactactctatctcaagagcctccttggcacccatgaggtgacacaggcttgcacctttgagcagtttgtcactccccttcccgaggctcttggggattcagcagcttctgggttcagtctggtcctgcttcagaagctcctggaataaaaaggttgtgtgctgccaggctaagagacaacgtgtgggttagctcagattgcttcattcttgtttacattcacgtctgctccggatgagccagcagatggcactacaaacctaaacttccttcaagcactagcccagccctgtctaatacaaacaatacgagctacatttgtgattttaaattttccagcagctacattaaaagaagtaaaaagaaacaggtgaaatgagtttgaatactgtatgttatttaacccaatagataaaaatacttccaacatatagctaatataattattaatgagatagtttacagttttttttttttttgtgctaaactttccaaatccaaagcacattttatccttacagcacatcataattcagactagccactttcaggggctcaacagccacgtgcagcatgaggcaaatggactggacagtgccactctaggagacagaataaatggactcaatgaatcccagcagccagaaaaacatatgggtctgggctgaactgatcaaaatgctcttgggtgaagaaaccaacccctcgatagtgttcagatgctgcagggttaagtctgtgttcttcaagggagtgaggatgaagacatttgatcctgagcccaggtttctctttggttacatcatttgcaggcagacacgagtcccggctgccggcatgtgtggctagtcaattcccgtgcacaaaggcaaatgtacaaaatgatcatttgacttttctgtggttgggtgcaagctctttgtcaggttccatcacagctccgagcttgtgcagtgtggcatttactgaaggttcccagcaggtgatctgattcaacttctacctggtgagctctgtcccatgacacctgtaaaattttggtccaagaaagcaaaatcgcagtagggcccatgacaccactgtcggcttggccctgctccgactgctaaagacaggcagccaggacaaacagttccttgttatgggctcgggaaaggcctttgtgcacggggctgtgtttgcacagggcttctaatgatatgaaagaatgtttgatttccctcttatacccgttggataacaaacacactcagatcctgcacggtgtctccggaacacagaggtctgtctgttggagatgtggatgttccaacacagcagaggtggtggcgctttgggggcttgtggagttttccctctgatgacaacaaagccattctgcttctgctctaaatgtgtttacttactctcagaaagaagatatccctatagttcaggccacagggaaagtcaaaaggatgtctataccaagagctactgtatttaaatcatccagacagtgaatataaaacactaggggaataggagggagagttgccaagaaaaagaaaaaaatcaccaatgctagtttcaaagtccttgagacaaaaagccatacaacacttcagcagagctgctgcaacacaatctgctttttaaagagggtcagaggaaaaggtaatgggtcaactatagactttctcccaggtgaaaaaaaccccaactcactcttgtttctctttacaagtcttggttccccctctagcaagggaggacttatgttcactgacatgcgggggtctctgaggtgttctcagacaggcaccgggtcggggtgggtgggaacttgaccacatccaagttgtttcttgagtaataagttccaagccaagaacatcttgtctggaaataaggagtagccactgactgtttggtcccgtggaggacatgcctctcccaggctctcggcactcaaaacattcctcaaatggggctgaggagtcagagaaggccaacagaccttggaaagcggaaacacatcaagaaggttgaggcccacctcttttccttctagataattattctgagccaaacaggcccagttgggcttaacatcttattaactgtccctccacacacttgctcctccaggatctcacttcccagcagtggcttggtttcctaaagagtcccaacagccaatgtgatgaggtgaagagtcctgtggactgtcgccatccccactagttatactcagccacccacacacagctccggacacacaggctgcatataaggggaagggcacgagggattcatgggcgccactctttagccaggggtctaccactttggttctcagtggagaatcggagaatcagggcagccactgagtcagcaggccaagggccaaacagggcaccagaggcctgtgccacagttggcacaataagctgctgttgattttattcagcccagcaaagtgttgactcttccccctctggaacacgacaggagcagcaggaccgaggtgggtttttagcacggtacctgccctgtcctgctaagcacggctataggagggttagttcttctggagattccagctttacacattttttttcttttaaagacagggtctcgctctgttgcctaggctggtctcaaactcctggcctcaagctatcttccttccttggcctcccaaactgttgggattataggagtgagccaccacgcctggctaggctccagctcctgagcagtcagtaaaatggatagtccctgcagtgtgtccagggattcttaggtccaggtgtgacatctggacagtgcatggaacctacatatgtctccttgcatgctgtctgcaccaacgaggcagaggggaggctgtaggctgggccctggaatgccggtgcttccttctcaccaaacagaaatcggctgctttatttctcttccctgccaacagccacgaccattcttcagcctaaaccatcatccccttcctcccagttaaaaggaaacattgaaaaattatataagtattatataattatagattattctgtaagtattatataaaaattacatattatataaatatagctttcataaaatataagacaaaagaagggaaaaaaaattctcatccccaaatgatgactctcttgctctggtagatttccccgtgatctttgttttctctgcatcttttttaggagttgcaatcaagtggtgctgtatctatctcacccaacaaacatttcgcttgcctagtgtctctgctttgctgggtgaagtttactggaaaagcaggaaagtagctgcaaattttgcagaaaaagccagaaacaaatatttcctgtagaaatctcagtggaagactagtttgttaatattttttcctacttcatttcttggttttattaccagatgttgattgaaacccatgggagtagggtcacattagcatgataccctgagacactgatggtgtggtcagctctccgaagtctttaacgcctgtactctgaggagaccctcagatcccagggagctgtcgagggaggaagcaatatgcccattggagatgattccagtgctgctggaaccaggacagccagctcagtgctgggcagatggcaatgacaaaatctcccctcccaggtgaagaaatgtttctcgcgcaattgtccttccacgccctcttctcatggtccagtttctagcacaaatatgggacacctgggattcagttgtgatacgtcaattaattagttgtgtgatctcaggcaagtcttcattctgtctgtcccaaagttcttggaggatctaggagtcacagggcgataacgcctgccctacttagcttacagggttgctatgaagaatacaactggatgacaggtggagaaagtgcctgggaaagtttcaactgcctgatagatacaaggtattattatttctgtttattagccctatctatctctgtcacatggtttcgtcttacagacatgtgctttggaattccagacacttacaatgttctagacaacataaaaacactgttttaattagaaatatggctgatttctatgctgcccagcaaggtttctttttattaagcagaccaattacagacacttctaaaaacttgcctgattcaccaaaccacaaaaatgattgtgaaaattttacatacaacatgtgtctcaaagtcagcattggggtgggaagagttagagtcagatggctcttctattctgtaccatttccatgttttctctggactttatctctctcttcccttctctctctctctctcccgccccctgcctgcccccaacacactctcttactctcatacacttttatctctctcagtgtaaaacatgttaataaagcaagtccaaaaatccatacttttgactgtgcaaagaaactctctgtggtgcttctttactaaaatctacaattaagtagaaatggtccagttacaaagctgtcttactaagaggcttactactttggaaaatgactgtaattttctataatttccaacatctaaaaacaaacctataaaccataatgagataaaccataactactcacacccactagagggcactaacaaaaaagatgggcaataacaagtgttggcgaggatgcagagaaactggatccttgatacactgctggtgggaatttgaaatggtatagccactttggaaacagtctagtagctcctcaaaaggttaaatacaaagttatatgatttagcagttccactcctaggaatattatggaaataactgaaaacatgtcttaaaaacaacttgtactcaaatgctcacagcagcattatttataatagccccaaagtggaaacaacccacatggccctcaaccaatgaacaacaaaatgtggtattagtcaacaaaatggatcaacattatggaatattactcaggaattaaaagcaacaaagtactaatacatgacaatatacctggtgagtacatcaatggcaagggtaaaccttcaaagcattatgctaaagtgaaaggagctagacacagaaggccacatcttgcaagattctatttatacaaatgccccaaacaagtacatctacagagatagaaggtagattactggttgcctggggctgaggggagtgggcaatgaggagtaactgctaataggtacagcatttccttttagggtggtgaaaatgttttagaattacatagtggtgatggttgtacaacattgtggatatatcaacaaccactgaattgttcatcttagtagggtggattttatgatatgggaattatgtcttaatttaaaaaataaacctgtgcaagatagacatacataaaattcaaacattacagacatacatagaaatgaaactttccctacactcctctccaacggtgctcccagttttttcttattctctatgctgattttatttatatggtgtgtatatttaggaaacaaactaggaccttgtgcatactgctttgtgattttcacttatgtgacttgttcatttttttttactggaagagaaaaattcccaacctgacttcttaaggaatatagcaaatccagaagtcataaagaaaaagacttataccttgactacataaaactaatatttttttatatgggaaaaggtacaataaataaagaagcagactaagggaatatctaagcaacatttatgagaaagggttaatattcctaatattagggattaagattcctacatgttgatttaaagttaaacaatacaaaagaaaaataggcaaagaggtaaaccagcaattcacaggaaaggaaatataaatgttcaatacacataaaacaagatgtcagcctcattagtagtcaccatttttttgcccatcaaattggcaaaaattaaaaagactggtgacaactagtatgggcaagaataggggaaattggacactctaagttgctgatgaatatgtgaattgctacaacattttgggtaggtcattaggtagtatttaataaatgggcacaacctttagcccatctttgaaactaacccacaaaaataaatgcaccactactaacagtagggtcacaaaatgtttattgcagcaatgtttatcagagggaaaaactgaaaacaactgaaatgtctggtgataagtgacagctgaatgaactacgatttacgagaacgagagatattggagaaacatgtcttggccctgtgtgatcgacctacagccacgtgcatggtagacagctacgtgaaaaaaggaagctgctaactctacaacataatgccattaaaataaaacccaaacccatagagaggtgaatatatatttgtatattgttgtaggcaaagagaaagcctgttaaatttggtatgtttggggctgggtatgctgtgttctagaatttaaaaaagaatgtcattttaaaaagctgattattgataaaggataatactgcgctaatttgatctttctcgaagccagggaacagttaaaaaggatgggagaagccaacgactgtgagatggaagggctgcttaacacggtataactacaacatcttacagaatacaaggtatgttaacacttcacttttggtctaacgttttggctccctacggggtggaggaagacagattgggaaaacacacgcgaagtattacactggcgtctggcaaggggtggaaactcctgtcttgatttctgactctggtgtctccgtggggttcacttgaaagagaaggcacctggatcccatatgaaagcagggcagggcagaattagcccaatagatgctggcttcttctggatcagttcaggaaaacaagttttgacttgtggagaaggatctgccttgagcactattactggggataatacttcaaccagggtcaaagtaactccctaaagcaggttatcaactcctcgagcagcagtcatggcaagtccctgagacagttcttggaaacctaacctcctctactctaggaaaactaagatgtcaaattgggaaaaaccttaactttactgtaactgtcctgtccaaactgtaccactgagaggggctatgttttccaaaatggcatagagctttggtaaatgtctcttctttcactgttcaggaatgcagaagatggatttttctttctttttttttttttgagacagagtctcgctctgtcacccaggcaggagtgcagcggcgcgatctcggctcactgcaagctccgcctcccgggctcacgccattctcctgcctcagcctcctgagtagctgggactacaggcgcccaccacgacgcccagctaatttttttttttgtattttttagtagagacggggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgctgtggccccaagactttaagctctcttttgggatattggcggcgagggtggggggacacaaaagaagatgtatctgaaactgacagttctttgaacatatgcaaatgtcataaaaacaccaccctcccttgagcttaatggccagccttttatttttttttgagacagggtctcactttgtcaccgaggctggagtgcagtgccaccatctcagctcactgcaacctccttctcctgggctcaagtgatcctcccacctcagtcccacaggtagctgggactactggcacgagccaccacgcctggctatttttttatatttttggtagagatggggtttcaccatgttgcccaggctggtcttgaaatcctgagctcaagtgatccacccacctcggcctcccaaaatgctaggattacaggcctgagccaccatgcccggccccaggctcctcttaaaggagagacaaaaaacaaagactgcaggcctttgtgctcttctccctccaccagtccttggtaggaagccatgatgcggatgaggtggacgcagtgacttgccttccacatcaggcacgctcattcacggtttcagaacaaaaggaaaacctcacaaaagaggtcagagggaaagaatgagtgaggagagagaaaacacagcctttcactattttcgggaaagctcaatcttcccaatgtcagggacacagatgtgagcctggcttggggcactgggcacaacccaccaccccaaacctaaggggaggtggtatattcgcatgggaatagctcccattcatatttcctttctaatttattttaaattaaatccttgcagtgtttctctttctccatgtctgctaggcagttaagagaggggcagaaaccaggctagcaagcaaagaaagtgaccacagggcatttttgcagttggcacaggggcctttggcatctattttcaaaacacgcccaaactaaaacctcatgtgcttctcgccaatcttgcagaggctgaataaactgcacgtggctctgtgaaaagccacctcatcccgtatggcatttctgctttctggctgggttaacatctctgccttacagaggctggtaacatccagagagcacagatgggtaccaaggttgccggcctcaggaggaccatgtttcatttcttcctgtgtttttgggatacacagctctgagaagggacttgtcactgggtttgttcaatcccgctcctgaggggggtctgagacacaggtagcagtctcaagctggtaccttgtcaatcagcaagacagtgcagtgaacgccaggtcacgacacagactctctcaggtctttctagggaatgttcatgttattggggaggtgggtcctctgcaggggcctcttctttcctctccttagtcttgtgagtcttgctcacgatgtggctgctgttgcccctgttcccctcttccagcaatggtaagacacacatggagcctctggacatttttcctagcaagtacattgctttcagggtggatgaaactgctactctaccccactacttctcaaaatgtcttcctagcatttgagggagcttgggaaatgatccattatacattatgtgtggctgactagggtgcttctgtgatgaccccaggaccgggataaacggtgaggcttccatcaccttcactgtgatggacatgggatggccctggggtcttctgttgacaaggaaaatctaaaaggtgctgggagagtgttgatctatttggtttcaatcaatcaatctggaaagagattctatatcttcctttacgctgaacgggtgaagggcaaggatgagggtgatgaacatggcatcctttcaaagcaggtgtaggagggggagagagggaggagaaagaggggggtctggagtgcctcagtgtacttcatgcattagacttcagtatatttttactcagcagcttgcctctgcttgtcgagtattgagatccagatcaaatatcaagtgcttttctaggacagaagtggttaatgtggaatcaccttcagcatcctgcctctgtggatggggaaggcagtctctctactgtcatctttaatcttagcacgtaagaacaatgtgggagtggtggggggcagggagtagtccagataaagggcctagagagtgggtcacatgcttgaatttatgtgggttccctacctcctggcccctgtcctgcacaggacacgactcactgtctgcttccgagaacgatccggattcgtcactggagttggttccataagactgctcacatttaatttggggccgcacttggttgtacattccatctcccatcaggcctggttcctgatgttctgtggcaaggaatctggctccctgggaacagggcgaggaggagaactcacagagagggaggctgcagggtgagcccccgctcccgtcctccgcgtaggaataggaagagcaggagctggaagtcctggtcctggtctccaaggggggtgagcgagggcagactttgattggtaccgggcagctggtgttgggccgcatccttcctggcaagtggtcggccatcagcccaccgtgggagtaggcctgcgagctggggagggactggccggctcccacccacagaccctttggcaccggctcagagaggtctttgtccaaactgctcaccccagaataagaatgcaccgaggtgctcacttggtcacaagcgctggaggagaagatcacgctcctccggtccagctctccctcctgtttacagagagcctccaacccaggccccctgaggggcgaccccatggtgaagttggacacctccttctggcccacgtggggctgtccataattccctgtgaaaggggtgtagtcagttttaaggtcaccctgagtgatccccttgtcaaaagggcaggctggactcctggcaaagtgctgctgagatgtactgggcaggccagacagctccacacttttcgttatgctgaacagagaccttaagcaggagggcgaggccacgctcctggatctctccaggcaggcggccccagctggggccgtgggggtaggggcagggctgggctgtttccggtccatctcgacatcccccgctctgtccttggcgtcaggctcatctccagacaggcagagcgtgatgctctcttcctcattctcttcactgggcggctcacttttaatctgccccctggcaagccccggcttgaggctgttgctagagttatcttcccggaatgtgcttgcaaaacctgaggtactgtgtgatgatgcattatagacattcttggtacatgcaagctggtatttcttgtatctggggtactgcgttaacgcgtccttttctgagctctccttggtgtctgtgggcacgtcaggctcgggcagcagggcttcttccttctctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacaggccatcctcactgttcaggagctgggtctgcaggaagctgaagcaggagtcctccaggttgtgcatgcgcaggaactcagcacagcggatgacctcgcggatgttttctctgctgagtaacagcttggcagtgtaggcaaactgtaacagcggcccaaagcccctggctgtgacctgcaaaacaaacagggaaatcgccaacattaccatcagcactgctattgtcccgaatccctcaactgaagcaagataaccagacagtgctaatgtcccagaataaagactgcaaaggggcagttaatcttgtagtactgggtcagcaatgattctgcttccaataattagtgcctgtctcgtgcatgccactgttgtactccatcacagcacaggcagaattgaaaatcaccagggtcaagtggctaaacaagatgacaacgggttcagtgtttacactaatgaaatatcctggcaaaaatgcacggtgacaatggggagcctattaatttccctcccaatcagtcctgttgagagccattctacacgaggggggagtgttgtgacacttcttgcagcttgctggagcccaagagagccttaacgttttcttgtcaaccacaaaaatggcaatgtgaccctgcaaaaaactaactccagggagttgtaaaaataggttttcctcacttacaatgttaaaagagacattaaaacaactcctgttttgctcatccatcacagtttctacttgagactttcggtcatcatgtctacctgatcttatgatgatgatgatctcattatctcaccagagatgacaacaatcaaaagtggtgtgctcaagatgaaatcaacccctggcccataatgaatgggggttgcagagttaaacaaaccggctctcatttaaatggttgaagctgctgagtggcacagggtatgggctattccttccctaattattagcagcagctttgccatgcagctgtctttttttcctggtaaatcttcaggggctaagcctactgtcatttgctgcttatctgttatattttacaaagattgaaagtgtgctatttatgcacagcttgcatatgcacacaaacacgtgtgtgcccacacgcatgcctgctcacacacaatgacttagacaattaagaatatgttgcctaaggccaattgttttttcagatggaaatggattaaacttgctggtgttcatcagggtaagcttccttaccctgcacataaaaccacacatcctctaggttcttgcaagcactgctgaccacacaggaaggtgacgcatgtctacaaatcctgtacaaatcaaatgaaagcagcaatcatggggtccttgctagaggctatggtagcagtgatacaaaattttagcggggggagtgagtgcacagcaaggtgaactggtaaactttgtagctgacttctgtgtgtattaaactcaccgcagcatacagagccaaaattcttgcaaggacctgtaattgatgttcaagattcaacctggacattcactcctttgggagtgctctccagtcctcttagagagaatgaatgacattgtcctctcagctctcatagccagatgaggagacgtgctggattctccagggcagcactgatttcatatcattgcattctttccagtaacggaaatttcttagacatgtaactgaacgggattttaattgttaatctttttaaagtactcaagtaagattccacattaaatttttctgtcagatgatgagtccagagatatttggttaaaaaaacaaaacaaaaagccatgactgctagacccacattataaattctatatgggcaatcagtgccatctcccttttattatacctaattgtgcctgtttctaccataagacagcaagctccttcagatcaggaatggttttgtctgtctttgtaaccttgcatctaatctaacctggggtctctcacatggtaaatacttgttaaaagcttgtatgttaccaaatatgtcatgagtcaaactgtgtcctaacatactactactgtgtatgcaaggtgacaacacagtatgtttagagagtgttgtctcaagttacttttggagcaaggcatcatgtaaaccaactaactgaaccgatcaactgatcaaaggcaggcaggcaagggtctttgtttgccccgtgtcacagtaccagtattaaaaaggaggtctgaccgacacttttgtatcctgctaagctgacatggtaataggttcagcaaatgtagtactgacaatacatctgttttatgtccttttcttccaagaatctttaaaagaaagtaaaaaagcaaggaaatgtgtatttataggtaactgaagaagatgacaagaatgtcacatgacctattcctttactgccacatggctccaccacaaagaaagaaatggtgaaatcaatgcagagttgacccctgccctcgtaatgatcctatgctcctctgtaatgtgccagttgccaaaagggtggataagacacttcttgagttttggcaaaggtgctcactatatgggaaatgtaggaaactaatttcaatgctatttatactgttcacacagtttttctttttttttttattattattatgctttaagttttagggtacatgtgcataatgtgcaggttacatatgtacacatgtgtcatgctggtgtgctgcacccattaactagtcatttagcattaggtatatctcctaatgctatccctcccccctccccccaccccacaacagtccccagagtgttcacacagtttttctcatactcccatccttatcaccattttttttttttttgatgctgtaggtctaagtaagtcttaccactatcttccactgtggcctcttgtaaagaaaatttctaaagaagccagggacatccatggggatctgtagatcaggaagcagtactgggagtcaccctctgccacatggctgcaaggagctggagaaagcatctccgctcagggacgagctgatgcttaaatgtatgaattggaccaaggaggtgaatgagcaaagtctccacatcacaaatcaatggcactccttagatcactgaggcttaggaaacttcctgagcttgaaatgatcgtcatatggtcatgaaagagtcatagataaaaaatctggtttgtaaactgtcacttaagcccaagggcagaggaaatggtgtcctcaccatgaaagttcaagagctcataactagctcttctcccattctggtttcagtcctgctttgtcatatttaagtctgcaagattttgctcagcttctgtgtgtgaggctttgtttggtgagccagaatgaccatttaccaagtatctcctagtgcccagcactgtgctcttgtaacaccctgcaaggcaggcatgactgcccttattctgtagataaggaaactatgaagcagggaggtgaaggagtttatccatggtcagtgctagtcagtggagagctaggattccaaaccaagtccagtctgtttcttcttctgtgctagtggtgtgagggaaggatatgtgtaggactcaggcctgtgctcaagagatctaagatttagctttgtagaagaggtacaaatgatgaaaagttaactaagtaacaatgtaagcaagtcaacaatggaaaagccattgcaagattatatgagtagttgtcaactgagaaatccagacaagttcaggataggagactactgaggctgaggggactagcaagggggccccttgaacacttttatcagcacgccttgagtgtctgctctaggtcaagggttgctttgatacgatggctactttcggaactgtcacaagggtccctcccaggaacccatctctggtctactttcggcagtggtaatcgctccagatacacaaaacagaaagcaagtgcccatcacacctgccagcaagtgttacaacaggcagaggctttctaaatactggcttagcctccatcttgagaaggtggcactgtctacccatttttagggaccatttaaattcattcattatactcagaaggcaaatattcaggtaccagtgaaaagctgtatgttcatgaaactgtgaccacaagtctgcattgttacttactttttgttcttaacaaataaggctctaataatgggaaaaaataagaggggggtgggaggtggagaattacacgcaaaactaacaactcataaaatggtattttaaaaagtaatgatcataaagttaaaatggaatgaagtggctataaatagaagaatagttccaactcactgatgttaatggagttgcatccctctgctctaagcagacccatctagactaaaatccactggtcagcagtggcctcaaggtatgagaaacaaatgcaaaatatggtgttagggacaacttgggataacagtcttgcattttgaatgaaaatattttgaatgcctcatttcgaagaacattttttcattgcacttaaatatgtaactacctggtctcatactgtgcaatactcattctgatacagatgagatgggatcacacattggggccagaatacagtgtgccatgtgggggcgagacctcggagaaggcagaaagttaaccctccaacctcccacagactgcttcctaggaggtgatgacctcagctagcagttggcacatagttggttcaaccctgaaagaaataaggccagggtaccgtgtccgatggtgcaagtcaacatgctgacaatgtgttgaaatttgacccactgtaactatgacccttaatccttcattacattggattctaacatatcatctctctgctgaaaggaagatgggctgatgaaaactcaatttgtagagaaagtttgggcactgtttgcaaagctggggagctcagtgttttggggagctcagtgttttggggagctcagtgtttcatgagacatccattttgctgcaggacagagtttatgaggatacttacaacagttccatctctggactatgatagggatgaggcagtcagccttcaggcatttattgaaaatagggtttgaggatttttgagacttggaacatcattctctatataagctacatgactaaggtgtctccagttggttttggcagtatatacacatggctgtagcattgagcccatctgcagaaggctgatcagatgaatccggaggacaggtgactgctccctgggagagggctggcacgcttctcaaggtcccttaatcacaacttcacaaaaaagggaaacttacatcttcagcaacaccatgtacactttcctgatgaagctgaatctcttacacactgcaggaaccaggaagataaaggtaatgaacccctgcccaagggctttttaaaacgctagaccactgacaacccctctgggttgtatttgcacagcaaggcacttgtcaaatgatgaaagcaatgctggtgacaattaactctcccttcccactctcttactgcactgcaacccactctgcaggatgaaaactgacttagtgatcaggcatcactcctcatcttaattttctataattcatatccacattatcacattcttcttccaaagcagcatgctagacatttagaaagtatttgtcaaattaattcaccttactatttcaacaaagcttctggttattttagtattaatttttattttatctatttttacagacagggtctccctatgttgcccaggcttgtcttgaactcctgggctcaagggatcctcctgcctcagcctcccaaagtactagaattacaggtgtaagccaccacatctggcctcgtattaattttatttatttatttactgacagggtctcatactggttgtccaggctggagtgcagtggcatgatcttgccacttactgcagcctcaacctttggggctcaggtgattctcccaactcagcctcttgaatagctgggactatcggcatataccactatgcccagctaatttttgtatttttagtagagacggggtttcactatgttgcccaggtggtctcaaactcctggactcaagcaatccgtctattttgacctcccaaagtattgggattacaagtgttagccattgtgcctgggcaattttattatgaattttagatagagcttattttgtgttctattcctaaggtaataatataaaaactaaatcaacattgaaattgatttatacatatatcatttcatatggtggttcttttagctaaagaaaatcattatttgtcttagtgaatatgtcttaaaacataaacggagtgtcttttctctcctgtgcaggtttgaacttggatctgcagccataatgtaaaaatccttcccctatttgtaagttttactcctgagactctatctgatcattcagtcacttataatttttttgtttactaattttattttattttttagagatgaggtctcactatgttgtccaggctggcctcgaactcctgggctcaagccattttcctgcctcagcctctcaaagtgctgggattacaggcatgagccactgtgtccatccatactcattttttcattctccaacgatgtgctaggcactcactgtgtactatgcaaggtctggggactccactttcttggattcaagtctcagctctgctgtctaccagctgtgtcacttgggctggttacttaacctttctgtgctttagtttctctatgctttagtttctacaactgtaagacagggatactgacagtgcctgccttatagtaaaacctttggaacaggacctggcattaagtaacaaccagtattattgctgttgctacaaatatgaataaaacaccacctttttctccaaggagctaacaagtgactggggagacagatgttcaatataaatgtttacagtgtcacctgagtacgtaacagaggtatttgcaggatgctgggaggacagggctggagcagtaactgctaagggaattagtgtaaggctacttagaggaggtaacacttgccaagtgttgagggctgagttgaagttcttcagaataagtaaaagaaaggcatgtctcactccctcatcatcttccggcttttcctcaaacgccatttcctcactgagacctttcctggtcctctattcacaattgccctcccctaccacaaaaccagaactggctagatggtttgcagggcctagtgcaaaatgaaaatgttagcctcttgttcagagattaagaatttcaagtgacaagagaacattaaacaaagtgcaggacccctctgagcatggggccctgtgcaattagttgcacaggttttatgctcatgaagctggccctgtcaataacacatgcatgcacaagtgcacacacacacacacacacacacacacacacacacacacacacacacacagttacctattccctgcagttgaaatggactccctgatttgaggagggggtgatggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactcgaatccccatgatagagagtcatgacttgaatcagttaacagactcagactccctgcaattattctcaggaattcttgaggacagaccctaccataacccacatttttgctatgatttctcctgtcacagggttttccgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaacttaactaccttaatacaaacataaccggaaaactgaaatagtccttaccaactactaattttgacttctattatttgactgaattttagtttgatgttgtaaactcatatgttggttatttactattgtctctcggactcacatccacttttctcatatttccctcttgctgaggctgggagttcaaaaactcttgtttcctaggctcttttgctggttaacttattatcggacctgccaacaggtgcacaggtgggtgagctcagaaggtgggaggcatgaagacgctgtggctccttctgtctcttgctctgtttatctttcctttcttggcggtgtgttctggaagtggctgcatccctgactctgtggtggagtgtccggaaggggctgtctgccccacagctgcagctcccgaggcacccgcccctccaccatgctcacaggtccctttcatcccctccagccctaggagtggtagatactttctgcggtcattaatcattaggttagctctccttcccttttctgttcttccagttttccaacacctgtgtaaccaatttcctgttttatagcccctctatttgaaacacctggcatggtttctagttccctgacttaacaatccaatttacagacaaggaggccaaggcccagaaaggtgaagggatttacccaaagtcacagggctgcctggccagggctaaactcatgtcttccgaccgcagagttcaactctcatgctccctttctacctgttgctgtttctctgaagtgaactaggaaagaaatgctatttcatatggaaacatgttattgtaaattttattactctctctaaaatattgttttatatagctctatccaaagaagtctggccaattggatgcagtacatcttttggtatgcagaaggtgaatctcataattggttctatttttccagtgtctgcattcctcctgaaggatgaagataactgctgtgtccctttcctgctcaatgaaactctgcaaatcctacgaagcccttttaccacatggggatttggtaaattatcaggcctagctaagtattggtccttagaatctagaagacaaagcagaaatgcccttctggcggggtgccacatggcaccagagctttgttccacagtggaatggcagtcggatgaagctgatgtctagggggagcgttacgtgtcccctctctgtgatagtcggctcagaatggttatggggctatataatggctgaaactgccccttaggtatttctttggttgtttcaaggttgatgggaacaggagaaggtcccaaaagcaaacattccatattgtctttcctgagaactggcgacaccttgggtatgtggaaccttcgtttcaactgggtggttttgcccatctcatctcacctccttcatatgtggcgctcataattttcccattcaggtatagatggttatatttcctaggttagtgacaggcaaaagtcatatatgatacagatacaaggaactatattcatatttaccctaaaagcatacggtgaaaacagaaaatctcccttctgaaagattataaaatgaagttcacagaataatttttaaaaatccaatttcaatataagtgtaggtcttaaaatagatatgaaatagtagtaatgtttcacgtttttcagtgtaaaataaaagtgaaaagcatcccactcactggtaatgaagtagtaaaacctgcatcaaggtttatggtttcattcgaaaaactgcctccaaaagaaaattatttttaaaaagaagatttagaaaaaattacctaatttccattttaaatgaccctcttcccattccagaaaccagtgattttcctaggcgagaatttcttgactcaaggtctggtttcaccctctcaacccctctagtcatttcaaaccaactatgaaccacttgatcttcaaccagaaaatacaaaacatttttgaaggcttccagtgatgagaagtttggcccctcattagcaccttctaatggttcttcatgttaagtttcaggaatggaagttttggcttagtcagttatgagttcttacacctttcttgttactctcctctgaaccacactgcctgcgactacacccctggcagatatctggattgaataaatgctccaatcattggtacagaggacacactatcacctctctctgtctatatcctattttctagaaatgctcagatttcactgtcacttattatttacaattaacatctctgagcttatttcctcccagtatctattgataagccatgtgtccattttaaccttgcaaaatcaaatttttgacccaagagtgtgtacttgtctagatactcagaaatcattcctattataaaaactactattcagtcaaatttttaaagatccactttcttctctttgttttgcaaattacgatgcaatttctgatctctagtcttttgacactttccttagctccacagtccctgaaagattttgaccatagcaagttgtatcataatcatattattccccctgcagtttgggggctttacttcatccagtctgggagcttagcattttctttttgttcatctacctagggcttcctttcccttttccaagttttttctcacttttcagtcttatggtcattcattcagtcattctccttgatgcacaatataaaattaactctgggctttttgccatcctcagtactacacagtcagccccaatgagcagctgttggttccctcatctttacgctccaaagagaaccacaaattcatttttgttttctgtggtcctcttcgaaaggtctccactcattttgggcttgagttttcttgaacgccttatttgtggttccatacatgttcccatagttgttcgtgtttttccagtgtttaaaataaaactctgaatgaaacacaactgctggcacaatttaccctcctttttcaagaaaagggtcctcatgtgaactttgttttggacacttctagccctcctgaatcatctttccccacagatgcataatttctacctttttcttgttaacataaaaatctgtttaaaaatgtcttgaacccaaaattataaaactctagaagaaaacatgggggaaaagcttcatgtcattggacttggtaatgagttcttggatatgacaccaaaagcacaagaaacaaaagcaaaaatgaacaaatgggactatatcaaacttaaaatctgattctatcaaaggatacaatcaaagtaaaaaggcaactcatggaatgggagggaatatttgtaaatcatatacctagtaaagggttgatatataaagaacccctatgtaaagaactctcatttaaagaactcctacaactcccaacagcaaaatataaaataacccaactaaaagtaggcaaaggacttgaatagacgtttctccaaagacatacaaatagccaacaaacatatgaaaagatgctcaacgtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttgtttgtttttgtttttaagacagggtctcactctcacccaggctggagggcagtggcatgatcatagttcactgcaggctcaacttcccaggctcaagtgctcctcccatctcagtttcccaagtagctgggacaggaggcacataccgtcatgcccggttaatttcttatttttgtagagacagagtcttgccatgttgcccaggctggtcttgaactcctgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactaccatatgatccagcaaacccagtttgggggatattttcaaaagaatccaaagcagggtcttaaagaggtgtttgtacactcatgttcacagcagcattattcacaatagccaagaagtgaaagcaacccaaatttccattcatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggtgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaaagaaaagtagtcacattcatagaaacagaaagtggaatggcgtttatcaggggctgggggaagaaaaagagggggagttgtttaatgagtacagagttttggattttccaagatgaaaaaactttggagatctgtttcacaacaatgtgaatacttaagagtattgaacttatttaacactactgaactgtacacataaacatgtatggtaaattttatgttattttttttaaaatcacaataaaaaaggtcttgaaatattttggaccgtacaaaatcttctttgacttcatgttctttaagatgatactgccgctttcttctaaagatcttctcatgtgtactcttattaattccttttagccagattacgacccgaatagcagttctacctttgcatcttctactttctggaaggtggaattgccaatgtggcaaatcaataaccactcaggtattcaactactggtcgaggagaattctggtagctatttgacctaattctgtacatgggaataggaacatggaacctttaattgtcctgacaataggacccataaactcctacaatatcaattttgctcctctctcttctaatctcctagtgctcttcagagggcccctgccctatgtttctagatttgcttacagaccttattagatgtaattcttttttttttgagatggagtctcactctgtcacccaggctgcaatgtagtggcacaatctcggctaactgcagcctccgcctccaggttcaagcgattctcgtgcctcaacctcccaagtagctgggattacaggcgtgtgccaccacacctggctaatttttttgtatttttagtagagaaggggtttcgccatgttggtcaggctagtctcgaactcctgacctcaagtaatccacccgcctgggccttctgaagtgctgggattacaggcataagccacagtgactggcctagatatacttttggctctgcttgtctttccagtggttacatttttattttgaatatggaattccttcccatagccatatttcactgtgatgtccttctgcttaccaggttacttgggttctctgagaaattctatttatcactgtggcaataatctccaagtccatttttacattactcctgcttcaaccatgaatagacattggagactgtaacttcttgatttatcccatgatttaccaaatattttactttcctaccaatatcaaacttgctgggttctgacctaattggtattatgagttaagcaagatattcttctctcttcctccccactccatcactttcaattgaaagcatgtgccttgtacaccctagagtctcaataactattagttgaactaaaccgagctagccctagtactgcccacttgggcaagcaatttgaatccctctttcacatgacaatccatcacatatttgaagacatctgtcatacctggttagggaattttttcttcaagaactgaagtcatattttccacctgaaatcagaactgaagaactgacagatcacacgtctcttatggaaaatattattttcttcttgcctctggaagcaagtagcttgacacaccactaatcctccaatagccttgagaacccaggtgctaccaggggaggcccactggtctttagcagggaaagcaatctgaccttgatacctgctgtcatttgtccctttcatttgcaaaataggaataaatagggacaagctgaagacatgtaggtagttaatatacttgaaaggcttttgagagaaaagtactaaaaattctgaagatgtatgtatcagcttctcaagcagagccctttccttggcaatagaaatggtgttactgtggcttacagaaggaataaagctacagagtatgccttatcagcatggttgatacagcagcaatgatagtatttctacagtctttagtctctttcatctaagtcctttaccaaccatcatgtaacaagctgagatatgctgactgggctactcaaagctgtacagtaagctgggataaaaatcatacatggaaaccagactttttgccaaagggacgatacacttctgatttctcctcccttcttgtgcttctgcaatgggctctgccaatggagaacagttaatgctgatgcaatgcaggcaccatctgtgctctgtgaggatttaaacagcagccattaacacaaaaccccatatgtgaattggacaatggctgccctgaagctacaggactctcagatagaacataccactctgtagcttttagggatgcagaaattgttatgatccaacacccacgcccctgaataagagcatgaagtcaggtttgtcagtcacccacttcccctccctgcttcttaactgagtttgaatcttttctatatgttattcctgtctgtcaagggaggaaatgaaacgggagccgataccatctatcagcacagccatgggtgccatttttacctgaagccattgggttcttgtcctgaagcttcccccaggacaccagggttccaggcatataaatgacattgacagtgactgggtgcaagcctttgctgggaagagcagtgtgtccaggacttcaggttgctggggcatgaaggcagggtcctatttatttttaatttttgtagagttaggggtctcactctgttgctcaggctggtcatgaacttctgggctcaagcaatcctccttccttggctttccaaagtgctaggattataggccggtagggtcctatttttgacaatggtgtcatctctggcagcagcagagatgctgaggcaggggagaaagaaatttctaacaatgactggttggttgtgtccagtttctgtggggctgaaacacgcttttcacaccaacacaggggatggtaagaaaaggaagtaagtcacaggtgcttcagaatggtaccttggaggctgttctgggccatctattttgaacatggcttgggactgttatgaaagacctcattatttatagctcgtaactgggaaaacaccttttctcctagaaataaagatatccaaacttcctgaaaatgaacctttggtttttgacaaataccaagtctcaagaacaccaggtgttctttttctgggtgaatcaaactatttctgagtttacctttaaggatgtgagttaaaacacctacagcatcccgggtgttccagtatttggatggaattttagtcaccgaggttgcaaatcagaaacctaagaaaccttaaggaaaaataagccctccagtttccttgcactattatagcaagaaatgtctggttcatggcagggaggattcatagagctcatccacagtagtttaatggcaccttcccagagaagcgtagctttgaaaacctcaactaagctagcaggtgtctggatggcatcgtcatttctttctttaacaagcgtgggaggccagggcttaagaatctctaggtagaggcaccattgtggtaaaaatacagagactcaaagcaaaagggaaaactaatactgcttttatatcccacttctgtgctcatgaactctcctctctgttgatgccatctctcctctctcctgcccctccatgatctctctggatagtcaatcaaagggaggctggagagtctctgagttaatgcttctgacatggactatgtttcaagcagcaactccctggtttagaaagcaaacctgattctctcctgcctggccttccaaatttcccccaaatctactcccttttcagtctcatctccagttatcctcttgatcctgactcctagccttttctttgacttactagcatttgcccaagccatgaccactgcctagatgcactgctgactctacttcaccaattccaactgtaaaattccaacatatgaaaactgtggaggacagggaagatggtatccaccaatgtggaatgaaagggccaggggaaaccctggcaaaggaggtggcaattaaactggaccctcccttctatgacctggacaatcagcacttgcttacagaccatcagtttgggcatttaatcacaggagggctgttttgcgttgttatctgaatattccactggacctgtcttgattagaaattcctcaaagtcaaggaccaagtcttacacttcttacatgtcctctgcataaattctaataaaatctgttaaaaatctgcattgtgatgaaagtgtatttttttaagaaggcaataacattacatgtttagaaagaattaacaaaagtccacgttttcatgctagttggatgacagtatttaagaaaagttaaattgataaaacatcattagatcacagaaaggctaaagccataagtattttgtgtacatatgaggcattttgcataaatgttactaaataatcaatgcaaaaaatttacttgagcattcactgtgctggatgctgaagtgaacttgaaagaagcaaaaaatgtagttttaaaaatctgtcttgggctgggcacagtggttcacgcctataatcccagcactttgggaggctgaggctggccgatcccttgaggtcaggaattccagaccagcctgaccaacatggtgaaatcccatctctactagaaatacaaacattagctgggtgtggtggcgtatgcctgtagtcccagctacttggggggctgaggcaggaagactgcttgaatctgggaggcggaggttgcagtaagctgagattgtgccactgcactccagcctgggtgacagaatgagactctgtctcgaaaaataataaaaaaagaatgtgtcttaaaaatgtagtctttttttttttttttttttttaggctgagtttcactcttgttgcccaggctggagtgcaatggtgcgatcttggctcaccgcaacctccgcctcctgggttcaagcgattctcctgcctcagcctcccgagtagctgggattacaggaatgtgtcaccacgcccagctaatttttttgtattttcagtagagatggggtttctccatgttggtcagctgatcttgaactcctgacctgaggtgatccgcccatctcggcctcccaaagtgctgggattacaggtgtgagccaccgtgcccagcaaaaatgtagtcttaagaaggtaagaattcctggaggaactcacaatgtatcacaatcaaataggagaataattgatgctgacctatccattgttgagactcctggtgcagcagaagatgagagacaagggacggatgtgggctgccaccactctaccactacgcttggatgggagcaggtgggggacagagagcgcagcaccaacaggagtcagcctttgtccttcaaatattgtgaccctgaccttggcagcctcatgctttctaggaaaggctctgccatatgcacctgggattaacacccttctctacctgagaaaccagtgccctccaccccacctaaatgaaacttcaaatggggctcataaaagggaatgacatgacaggaagagaaacgatctgttgggaagaggctgacagtgctcggaaaaccatggagcaaaacagatggaagaggacacatataccagtcctgctggaactgcaggatggtgagaaaagactgcaagctggcttggaaatgaaggctgggtgagttgagtgagcaaaactggttcatccttaacctgctaagttagagtaagagaattttagatggtgggggttgggggatgactgtcttttagatcagcttggaaaaaataaaaatcctcttctacactaaagtaggaaagaccacagagttagcaaagaaggcatttcagaaagtcaaatggggaaaaaagaagaatgttagataaataggtgaaattataaagtgtctaaaagcaactccaacaggagaaagaaggtgggcagggtcagagttcggaggatgtgaagggcaacagaggccctgtgaagtacaggccaccctcgtgaggagtaaggacagtgctgtcctgccacctcaaggtagggcctggcagtgccctgttcccagttctgtgccccgaagtgaagcgccgccgacaggctttgatgatctttccacctcctgactcttggcgggcagagcatacagtcacagaccagatattagaacactttatctagcatatggaaggaacagaatgtcaaaggggtttattactgtacctgaccagataatcaggtaattagcactattaacagaacagattggacacatttatacatgcatttgtatatctccggggaggcatagcttcaaaaaaacataatatcaggtgttttttattataatgtttgtgtgtatgtgtgtttttctaaagaacattttatttctcagaaaggataccaggcatgtttcttttctgcacctgtacggccctttttcacttagtcaagctggactgcaaacaatgaagaaggaaatttgtttctggccccccccagatcttacaacaagcactgccgagctggctggcttctttgttcatatgcccaggcccccacctgggtggtgcgcaattctaggaatatgctctggctgaaagacagaaaagaccaggagagggagcacaagaacacaagatatttctatatctgggtcgcagggaaagtcacagaaagagagcaaggcaaagagaagcaaatgcctcaaaaaatatatgcgggatcttaacggtgtattttttaggtgcaataaaaagggaatttggaacttatggtttgttcatcacatagaatacatttttagcaaattatatttaatgcagaataaaggctattttatttattagtttgtcctgaatgatatcattactttatgaactgccaaatctgtcagcaattattaacactccacagctagctgccttcccctaggtgtttcagttcacctttgccacacagtaacatgggaacaactgcgtcagacgacaagcatgcagccccaggcacagatcagtgagtttcagtgacactacagcacttagctggattaagtttataggctgagaacaaggtaatgacaccaggcattctcctccacaggaattcacaatatgggatgtcactggtgggcaccttttcaatataagatacaaatcaccttatccctttaacgaatgcatactgaccactttgcatggttctattgtgtcttaggtgctgggggcataaaacaatgaatatgaaggaaacggtacttggtctgagaggttctaggctattgggacagagacaagtcaacaggtaatcacaacacagccatgataagaactgtcagtacggttcttacttacagggtgtgtaagtccattttcatgctgctgataaagacatacctgagactgggtaatttataaagaaaaagaggtttaatggactcacagttccacatggctggggaggcctcagtcatggtggaagatgaaggaagagcaaagggacatcttacatggccgctggcaaagacagaatgagagccaagcgaacagggaaactccttataaaaccatcagatctcatgagacttattcactaccaggagaacagtatgggggaaaccgcccccgtgattcagtttatctcccaccgggtccctcccacaacacatgggaattatgggagctaaaattcaagatgagatgtgggtggggacacagccaaaccatgtcacaggggaagtacagctgctggcggaagggcatctaactgaggaggtgacaaatgagctgcagcctgagggaggattagttaggttttgggtgggagctggtgttccagatggaagaaatgaaatgtgcaaagacctaagagagaacatagcatgcagtgtggtgtggcaggagcagcagctggggcaagggcacaggtgaaactggagaagggagcaaggggacgggctgggaaggtccttccgtgtccgccgccgaggctggcccaggggcctcactggagtctgttgcgcaggagagtatgagggagactcctttggctgcatttggggaacaagccagacgggcggcaagccagtcacagaagtccaggcaagcaccactgtggccgggatacaggcagtggtgttgggaagggaaatatagacagatgagagaggccattaggaggaagagttggcgaagtctgagagtataggccaattcaagactgagaacgactaaaaaaagcatcatgttgcttctaactaaccaaagccacaacctggataccccattgacgaaaacaaggtatctttggaagctatttgggacgctttacagtgtgtaataggaattatgtacaggttcccaggcagacccaaggcagtttaggtttcagagtcataaattttggaggaggatagggctcagaattctgtagcctggggctttctttaaatggacacctttgatgtcagtctgttgtttcagtttctgcctaatgtaggatttttaaaaacagcacactttcccagtaagtcattctgatctggcaatgagaaagaggtgaaagttctcacaggatgtaaagggtctttaaaaaaaacgacgggctgggtgcagtggctcaagcctgtaatcccagcaccttggcagggtgaggtgggcagatcacgaggtcaggagttcgagaccagcctggctaacatggtgaaacccgtctctactaaaaatacaaaaaaattagctgggcatggtggcgggcacctgtaatctcagctactcgggagtctgaggcaggagaatcgcttgaaaccggaaggcagaggttgcagtgagctgagattgtgccactgcactccagcctgggcaacaagagcgaaattccatttcaaaacaacaacaacaacaaaaacaaagatggctgggcgtgttggcttgggcctgtaatcccaactactcagcaggctgagggaaggggatcgtttgagcccaagagttcaggaccagcctgggcaacactgagaccccatctctaaagaatgaaaataaaaaaataagaaaatataaaaaataaaggtgattggaaaatagatgagctagtataatgtgagatgatgctgcatacagccatggtcagaaacggggaaaaggcaggggaaagttgactttcctcccaggacctgtttgttgatttccatgataattgtggagcaacctaccaaacctaccagttctatgaccagggtctccacttggacctttagaagcttcttcaacacttgagtggacttcaaacttcaaagtggactttgtgattccgaccctcctgcctccctcttttaaggacccttgtaatcattcaggacactcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggttgcctagaggagtcttattctctcggtgtctcaaaatagaggagttccctggcaaaggtaggttcttatgtaagttaaagtgatgcaggcattaatgtcttcatgtgatcaactgacgtaaattgaggagagccattaatggataaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtacagagaaacttgaactagagctggagatactcactgagtctccaaacctaccgctgactggtttgtgaccctggacctgtttcccacctgttaaaaacacagacatttgcatctttagtgagtcttactcttgtcattgaagcaaggagttgagaacttgggctctggagtcaggctgcctggccttaagtcctggctcctctgcttaggagctaaccttttggcaagttaattaacctctcctgctccagtttcctcacctgccatatggagataataatggtagcaatcccatagcgtcaatgagttaaacacgtaaagtgcacagggcagtgcctggcataccctggatgctcagtaaaggttatttaaaaaaatcatcatcatcatcactgtgttagacacaagggatatgcaaaagataaaacagagtccttttcttagtgctgggtcagataattttttaagactaaggttttacgattccccatatatcacgggagaaaaaacgccctgatgtcctcacacgttccatgcatcatgctgtgttagcaagatcttttaacatttctccttgctgccaattaaagggcaccaagtcaaagttgatacgtaaaaattactgtcccattagcaccttctggcctcgctaataaatcctaacttaattaggcatatgtatctttttcgtgggacaagggatagccaaaactagaggtatatgggctccagcttgtttacaaccgtcccttaaaagagctcaatgcataattgcatacccataaatacaaatgctataattttcttggatcaaagatcattttcaaaaagtagacacgtatgtatcttcatggtagcttttaaagcaagttctacaaggtctaacaagtcagttttgagagcaggccttccaatagctgtcctccacttgaaatctgaagtgcggaaagtggagtggatgcatgttttactgaaagagtcagcaacagaaaatagagtacactcacagctgtagcgagccaggatgaatttatacagtgaattttaaatcagactcaaaattggcttgcactatccattgaaaaaaatcccattgattttgggcttcatgatgatgttttctgggagaggcagaccttagattgagagccaagcaaagcttcagatgcagattttttcttttattttccaaggaatttgaagaggcagaaattgctaatggaatacagggataaaaatgaatattgtatttctacttgctagcaactatcttggtatggaactcgactgatactgttctgtcctagtggctgaagcctttcactttattaacttttttagatagactttaacaatttcatttttttctttgtctttttccattttctctcttctattcaaacacttctgcaaaatacagtgtttccattaaagtccctcagctttcttttgtttctcagactctcacatctttgcaattttgctcaagttaccttcatattcacttggcacacagtaggtactcaataaagttggtttcttccttcttcctctgcctggccgctgtctggtaatgtacttcttcctttattttttggtttacaaactacttgttaaataattggctccaagagcctccttcagagtttacatcatttcttgggaagctcagcccaaacagagataactctcctaagatatcctggaaataaggttgcagagaaaaacaaagtcccacttatcaaaatgaagtgcttttgttctcgttttggatctggtggcagaaacgaaataccatctttcagaggtcccaataaaatatttgacaagatatgtgaaatgtttttcttcacttggactgctttcttcataatacagtctatgtgtttcaggagaaaaacaaggtcaattcaattgatcaaacactgtgtcagcgacagacacacatacatataaatgctcacattctctcacagttataacaacatggaatctaatttagaaccacaagagctaggaaattaagagttaatacttaaaccccatcctgaatccatcttgtcatgcctgagtatcacttctcctatagcaagcaagatcgcccgctgttctgaggccactagacagagaataaaatcagctataacattactgtgtcacaaggagggaattagggatgagtctggagaactggcttgggtgctctttgtacgcaagagcgtgaagccggatgggagagaaagaaaggaagacaaaaataaagcgtaaaaatgcaggcacattagccgcaggcaagctcccgcttgccttctatcctattattaccatctcactactgccttagggggcatctgtaaggcaggggcaagctgctgctctcattacagtgggctactagcagtctaaactccaaaacaaacttgaaagatatatgaaccacaatgatcacagccgacaatatgctgtggccttatacttgctcctgcaattgtgtgtgtgggcaggaaaagggggtcttctcttttactcaactcaaatgtcccttgctttgcttattttagaaacggtttgaatgactgttccttcaacagcattatgggtcacgtacccactaaaacgaaacaatcacactttatgtctctatcctgaatcactgttttaatttttaacctaacctagcaggaaatcatgggtttagccctgtttgatcatataaaatctctattaccaaagagaaaaaactcatggtactagcccaaaggcaataacagattttaggagataattgtccagatacctcgttggctctggagcaggtaaaaaaaatcacacataaaatagcaaaaagcaaatttattaacttgcctgagctttttgcctcccttatctactacttcaccagaaaaaggtctgctcgctatttacaaattcacttttctttaaagcttcttcatatgactaggtcctgccgataagtaatactctcaatttgtcatttgtctgtaaacttttaatgttaatactttttcatttttgcaatttggcaaattttatcatgcagtgagaaattattatctagatgctatctgctaggatatacaatgaactttctccttatcctactgaaagtacacctctcaaaaagaatacaaaataagagcccttcttggatttatttgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagagaagtctgagctattggatttgccagcttggattaataactacccatttcaaatcattaatgatgctggttccagttcagtgattgaactgggtaaaaaaacatttcatcttattctttccttatgaaagagctgctggctttgcaatccatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctgtcaagctctattacttcaaatggagcctatcgcttcttgagttcattatatatcgagattatattacaatttatgttaggttaagtcattgctgagatacaaggcggttgaaaaaaattacacagcagtgtcagtaaatagagcaaagtcactgcagtgttcagaaaggcaaaaagtcatcttgctaaatgaggatccaagctgtcctgtacgaagactgttactaataaataaaaggcctctgggaaaagtgctgagcgtacgctggatctattttcagcttgcatcagcagctgctgcccctgggatcacatctttacgcatactctacaccatatgtaatcactccagtgctgcaaccagtaagataatgaaagagcatggcataaatctatacttgagtggaatgctaaatgagaaaaataatacaaaaaggggggaaataaaccgcattttcaagtcattaggaagaaagactttgacatatgaagtgctgcaaccattaatagcacttatcatatagagtggagacaaagagacaaattaatcaaactgacagaactgggacattttatgctaatacaggctcctgggttttagtctgtattcctctgcgtctggaaaactgataccattacagggcaggaaattgcatgaataacatgcaacagatcataaaaattcacacaccaactgcagaaacactgccaaaagctctgtaaaaacaaggatggagacctcaacagagaaactaccagcaagtaatgaatgcaaataagtccaggaatatctcccattcatgcattgtaattaactataggcttctcgctcataattacagtggtgaaactgaagcctagagagcgaactctgcagttagccagagaaggctgctcaggctctgattcaaggctgtttgccatcagctggggtgagtgccactctgacctaaattttctgactgggttgtgttggctttaaaaaaaaaaaaaaaaaaaaaaaagcaaaataaacagcagaacattagcttaagactttaaagtggaggagggagagaaataaattgataatgcaaagaaaagttgaacaaaattttctatgtatgtttctgtgggtggtacaaataaagagaatctgagactgaaaacatttttataaaatgcacgctgtccctgacttataaacatcccctactttctgaataagctgtatgtacttaaatccgaatggcaggcaagtcctcatgaaagctcgtgggagcaactaccctttgttctccaattgtgaactccgagggggttggtggagaaagagccgctagctcatttataccaatctatagagataaattactgctgccttgtgatctctgcctttccctaaggaaagtgtatgtttccttgatactggaagcagatgggttccttagctggaacaccaaagagattttcccataaaaaataactgtatggacagaagtgtggatgaaaaaaacgcatcagaatttctttctccaatgataccatgtttgctggcattcaaggcttcagggcttagtgatctggtttcaatccttcctctcattctcacctaatacaaaccacatacttgcctgcctctagaactttgctaaatgatctctttcatttatttgacaaacattcaccaaatggctattgtgttggcctggatatatagggtagatttgtacaccgaaaacactcccctccaattcttgcacaaagaactaactgtccaaatgagaagacagataagcaataactcaatgacaatacagtgtaacagctgctatgacaaatatggagaaggtactacagacatacagcagagggacactaaaccccaaatggccatttcccatctactgaaattctacccacatctccctctccacgatgtagtccctcatcttctcattagaattacgtgttcctgctctgtaccttcatagcccttcacttatacctagaccataggattaatttctgtctctcattgatgataaatatctgttcattgaacaaaccgaaacaaaaaagaaatgctatacagatatgagtttgggagctgacttaggaaactaaccattactcataacctgtttctaggaaaaaatacattctgggttcaaactaatttctttacaaacttttgaaatgtaatttatccaaactgtttaatcttccttccttagacactgggctaccgaaaatgtaacctgcatttgcatgaaccaaatgcatgagataatggaaatgtttcaagtagtgcaaatatgaactgaagattcttcttacagtcatataacttgtgtattaaaaatatctgttttagaggccaggcgtggtggctcacacctttaatcccagcactttgggaggctgaggtaggcggatcacctgagaggtcaggagttcaagaccagcctggccaacatggtgaaaccccatctctacaaaaatacaaaaattagctgggcgtggtggtgtgcgcctgtaatcccagctactccggaggctgaagcaagagaattgcttgaacccaggaggcagaggttgcagtgagccgagatcgtgccactgcactccagcctgggtgacagagcaagactctgtctcaaaaaaaaaaaaaaatctgttttaggggacgatcctcatttcacatcatccttggtaaaatgaaaactgaaaagcacacctggacacacacatgagcatggggctctgtttggccatgtgctgctctgtacagaaaagtgcattataagtaagtgccctaggttaatctattgttatgattattgccattatgatgacaatcatcaagtgaggctgcccacagtggctggtccagggacatagctagaccacaagggctaatgttatgacctggtacagtgcctcagtggccaccatctagagggaggagaagggctaggtgtggtttttctttactgttttttggccctgaggacattcacctgagaagactttgggtctattaataacctaacagtggatctgcagaaccctgctggcctccactggaaggtgttgagtcttttctgaagtccatacacttcttatttcttaatatcataggattctgaaatgtattggtttctttctgtttatcttgtgtagttttagcatatttaccattttaaccttttgttctcatcacaatcaggtgtcatactattgactgtgtatggtgttaattttcagtttttttttttttaaccagtgaatggggttagaatgttcttcttccttgtgtattaaccacaaagagacgtttgaattaaagtttaaagatgacaaatggtctaaattctgattaggcttaattagatattggtattttgggaagaaaaaaaatataacccaaatgcaagatagacaatagttgttttagcttaaagatgataaaaactaatagggttcatcgtgattcgctttttttttttttttagacaaacagtctcgctctgtcgcccaggctggagtgcagtggcgtgatctcggctcactgcaagctccgcttcctgggttcaggtcattctcctgtctcagcctccccagtagccgggactacaggtgcccgccaccatgcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatttgtctacagtttatggctccttatttaagcatattaaaactgagaaaaaaataaaaagatcagaaaagaggtcaaagttaagaaagtcttggagaaatggaattattagcgagaaaataattctagtggtaacattattttcaagtggattctctttaaaaatcctgggtctggggaacagcatgagaagttgacacacaggcaaagctttgagcctttcttgtaaggagttacctagaggaagcgtgtgatttgatacacctaaatcaatgcaatatattatttgacagagttatacggagctcctgataaccaactctgtgctataattacagagactgaagaaagggatatgggggtagggcaggaggggaagtgatgggtctgtgagatgcaggttgctagagatttctttcttttttttttggagacaaggtcttattctgtcgcccaggctggagtgtagtggggagaccactgctcactgcagcctttacctcacaggctcaagcaatcctcccacctcagcctcccaaagtgttgggattacaggtgtgagccactgtgcctggccaaaaagatatttcttaaggaaaggtgacaagtgctgcaggagaatttgtaagttcagggaggtcagctcatagagaaaagagtctaaaacagtgggcctgaggcaggtggtaaaatatagagcagggaagatgagagaagagagtgaagaggctacagtggcaagtgggaggtggtcttgggcacgtgggggtggggtagagaggtcactactgcatctaaaagggcagagatgggatggaaagacacaaggaacatcctggcagcacgcatactgaatcataacaaggtactagaaaaaggctgtggcatcagctttctcagagggtttttaatattaaaagagataaaagtctgatttggattgtttaggttctgttttggatgcagatagaatttgataagttatttttctttttctgaaaggcacatataagaattatattttaatatagctgtgctttttaggagtacgttcggatatcactccagcttgtgtgtaccataataaatatctgaacaatactttatggattataaaacacgattttcctattatttgttcctcccaacaactcggtaaatgaggtattatgattcttattctcattttctaggcaacggtgttttggagagtataagtaacttaatcaaggttacagagccatggcaagcagggccgggtcttgggttctgagcccctcattccaaattacgcacaatctcccccatatctcttcagccattctaacaaatgttttcttttccccattcctgcagaatgtttttcattttgatgattacccttaacatgtttcaaaaaagcataggcattggaagacccagaaacagagaccaagaaggcagggaccacaggacagaccctggccttgcccatcacccagtttcattggttccctttgccttgatttgaccccacctgcaggtgctgagagcttcagtttaaaatctgggaatatcctaaatgtttataggaaatccccatcctctgcctccttctttaagcaggtgccaaaattctcctgaaaggagtatatggatttgaataggacatcatccttgcttctgttttatagtgcttctttgtatttattcattccatcatatttattgagtacctactatgtgctcagctctgtgaaaaggcaggcatgacacttggaacttgtactccagtcctgcactgtccaatagggttgtcacatgttgtctaattaaaattaagtaaaatagccaggcgtggtggctcatgcctgtaattacagcactctgggaggcagaggcaggcagatcacctgaggtcaggagttcgagaccagcctggccaatgtggtgaaacgctgtctctactaaaaatacaaaaattagccgggtgtggtggcaggcatctgtagtcccagctactcgggaggctgaggcaggagaatcacttgaacccaggaggcagaggttgcggtgagccgagatcacgccattgcactccagcctgggtgacaagagtgaaactccgtccaaaaaataaataaataaaataaaaaagtcagttccttagtcacacacgtggctactggctaccatattggccagtgcagaagaacatttccatcatcacagaaaaggctacttagcggtattgaaacatgtaagagtaatcaaaatggaaaacatattctagcaggagtggggaaaagaaaatgtgttagagccactttgttagaatggttatacagttataggggataacacacatgcttatttcatggtcttattactccttgcttagtccgttgcaacaacctggctgttgtctctttcttccccgatccttcctttgtataggtgcctgactgaccttcctgatgacagtgactttatctctttgcttcttgcagaataaaacctaagcccttcaagcatggcattcaaggctcgtttaaatcaggctcaatggacctgtcctctctcccaccatgtcctctccataaactacaatttagtaacagaaagcggggttattaatatcaagcccactgccctccacatccattctgtaggagaatatctacaattacaagatgtccacaaaagtcaaacagacagaccttttaaataacttcattgaactgaaacacaagaaaagagaaaaggagggaagatatggtcacagagaaacgagaggattattgtaaattatctaaattagtcctaaacaagtaatgccacacaaagcactagtaagctagaatgtcattctctaccctcaccataaagagggctacagaaataggtgaggaggctggacagatgcttagggaatccaagcagaagagctaggatattttggaaaaaatatatcagataaccaagaataggtgagtgaaagaagcagacacaagtgtgttcatctacaggtactgaaccctaaaagcctattcctatattctatacacaatttaggataataggtgctcctgacaagatgccactgtggttttctttgagtagagattatacaaaacagacagggctggtggactgaaaaagtactgaattatggtttgtttcccaaactacaggtacttaggacccactgttagaattgtaatattttctctaattgcaactcattttcttctttaaatatagtttaaaaagaaacttgtcctaagcaatatctgcaaaatctcaagtttaacacacgaatcatactttctgcaatacatattaagataaacacaattattttgaaaaaaattctccatataccacctgaagtcatttcacttttaggttatgctgtacatattcctattctgggaaacactgggaacccaaacaattatcctggctgagtcctcgggcaggagacatttggccgtgcctttcctattttccagggataggactgtgagttacttccgtgtggtgggcggtgggtgcttgcaggggtgaagtactaacaggtagcaaagtgttggagacacgaagcattaatcatcagtcaacaacagcagtggcagcactgctatctttcctggggctagtgagaattaacggattaatgtttaggagagcacagaagtttccaagcatctactgtggttctcaatcctttgcagggaagtaaacaactgaggtggccacctgggattctcatctgctggcggggctggtgggagtctgggttttgtgggtggcctcagggggccctggcggcagcttccagcctctgtggtgacaggccatctcctctctgtctagttcacaactccagatgctgtggggaggtggcagcagtccagtgggggcgggacactaagattctcacattaacaatgcacagacatccgtccatccggcactcctgggtcatgtccctgagagtgacacagggctgcccctggggcagacacatgagatcatctgaactggttagctccagagggcctcagctgggcaggggctctgcagcttttgtcagaggctgtttccctgcaaaatggggggaaaatcggaatactcaaacaaaggggatttctgtaactcttctgccatttttctctcaccttttctgtgtagctgagctcttaggaaactggtgttaaagcagttcagtgagaagcaaggcaactgaaagccccttccaacagctgccaatggttgtggacgagcaggcagacaccagggctaggaggaagggagccaacaatcactccacagtggcatttttcaggactcagtcatttctgatgctggaaagaagcttgagaaaccaaagtacagctgtgggaagacagtgtggggctggagggatgcgggtgtgggctgctgcccacgtgctccctggccctgttatagccggacttgtaaggctttcttaagccttgcatctgagaaaggcagagaccagagaatggaaagacaaagctggggagactgatagtggcggcggcgaactgaactcagccccctgcctgtggaggggatgggctgttagtgcctgggccatggatgggggagctctgtaaggatggcttttttcggtatgtgtgttaaagtctgagttttttttttttttttcctgtggggtttacaagctcattccattgtccagaatccttgtgggcatatttctcctagggacgctggccctggatcgctggccttgcctgaaagaggctgcctcctactgcgtttttgttcaacttgctttctctgtaatagagatttgcagcactgtgggcttcagggattcaaagtttttgttttttccctaatatccagcttccatttctggtttttaataatatcccaatcttttcagccattctcccaagaattgtagtgaatgatttttttaaagttttcttttaatttttataatgaatacacataatggagcattcttttctctgacattttccctgtcactaaatttgaatgtttaggtggcacttaaaaaacctttccacccgctctctgaatgttctgatgctcttggtgagtaaaacaaagtctttcaacaccacctccatctgaattgtatacttgatctttctgagcttggcaaacaaaccatcacccactcagaacctagacaggaaagtggcagatgattcaagcttcattaggaacaagtcatgccaaaataacttcatttctggttttgatgggattacagctcagagaatgcagcagaaatagcatcccaggatttcagtatgtcagctgacatctttaggtcactctttgaatgatacgaaaaaatgaggtctggagacagtaaaattgagcaatgagtagctgcttgatggatcaatgttaactgcagctcaaagagaagtgtctggtgatgtgacccagccttccgtcgcctactctgtcacacttaacttgtctctctgtcttagaaaagatgtgagtggcaactggtgagctactccaggagatagaatcaggatcccaaatgatgacccaggctgatattatgtgttaaatgcagaaagatttaacaaaaatagatgtcaaatcctgtatcaggattaaaaaaatcaactttgtaagaagaggatgggagagtcctggcttaaggagttgggtcagtatggtgacacaggtgacaggaaacttaccctgatgatcctgaactacactgaaagatgtgtgatgcagaaagcgagtcacgcctctgctctgctctttaccactcaaatcagatggaggctgtcgaacttagtcctggctgtgtgtgagggatcacactgatcactgagtccatgccccaggtggcatgtggaatggcagaagtacattaaacactgagaaaggcagactcatgggcaccctataagagttgccttcagagagctaacaggctaccatgtaaagatgagattagatttgttctctttcatgccagagggtgtaaacgggatcatgagtgaaattttaaggaagatagatttctgccacaaataaggaagaacttgctagtagtcacggttgtataaaatggaggaaggagctctcttcagtggtggtgagctccccattgttgcatgtgttcaagcagaggctgaagaggtacctatgccattattataaaaaaaaaattccaaattggatggggcctggactctaacatgccttattttttaacctccaatccttgatgcttctccccttatagcacaacagcccaacacgtgttatggttcttagtattccctcagcataaagttgaccaggaagaaagacaaggttgatagtattttcatttactctggataccactagcaaaacaaagagagctctcttgaacttctccaagtctcctataagtctatgaatgacacctacttcgatctacttcagtttggaatgctggcctagtccaaccagtttgctgagatcatgaacaatttgcaggaaacacagggagcattgataggatgaaatagaaggcagtattttaaaaaaatcaagtcaataatttcttatgtaagttttcaaagaccatcattcctattcaacacaaatccatctgtactgttgcagaagcttgaaattaaataaatgttgaccacagcagtctgaatttcatcacatttatacagcatttttccaggcatgagtttccctcactgaaaaataagctttttctacttaggcctatcaggtgagcaagggtagtcagtcacacagacccacagttttgtttgaatggacagcagcctgccccatcttgtattttcttgggcttgacataataactgagccatcaaaaaagttataaatattgtacacaccctgccattctatacaccctaaaatggcaggagaaaatagctcaaagcctttcctccttaatagctccttagacaggttttaggacagaaccgggtaatctcagaatctttgctaacaaatggaaaagaaagcagaagatctgactacaagtagaagagttggaggacgcaagacaatgaaataaggagaggagggtgaagaacatactctaaaagatggctgcaagtactggcatttactcatggtcgatatccaatacatatctattatttatcaagactgggcaaaaattaggaaagaaaatcgtttcttatgagcaactggaggcaaaggcaaaaaagaagttcatgcaatgatgggactgcctaactcctggaggtcccctgtctagagctcctgtttagccatctgttttctgtgacaatggttagcacctgactctgggttaaaattttttgggtagttccctcaggtctgcaaccttgatttaattaccaaatctaggtcgaactctagacacaaatttgaggtgaacaatcgaaccaaggtgtcatgctgtgcattgagcagtggaaggaccttctcttgacctctcatggcccctgatcacagatggctgtgctggcacagagcatgtccctccagttctccaagatggagcaagaaagaaggccctgtatgctaagacaatcatactcttttcacaaatatttcatgtgacctagaaatgtacacagtttggtagtgttaaatatattcacactattgtaaaacaaatctccagaaccttttcatcttggaaatctgaaaatctatacccattaaacaacaactctccttttccacctcctcacacccccggtaaccaccacttgactttctgtttctatgaatttgagtactttaggtatgtcacataaatggaatcatttagtaacttttttatgcggtgggcttatttcttcaatatagctttgaaaataaacccagggaggtgggaagggagggcatacagagcgagagagagagggcaaatccacctcccttctgcttaggtggtggccagaaagggagtatcctgggatatcctccgggcgtggagcatgttggcagcatgcattatagttgcaggagaaggtcctcctggcaggtgggctcaaggctcatcacctccatcaagaagcatctactaagggcccaagttgtccccatgtcaaatacattctctgaagtccatagaacctcagcaattcttgaagaattctcatgaaatgctctcagcatcttcctgggggaggaggaatctgaataaataaggctgcattattttaagagcagtctctgtaggaatcttggagggagagcagaagaggcaatggaatgcgaatgaatagtctcaaagctgccagagcctgctcttgaggaacgaaatatgcttagaatgtgtgtccctcatggactcatgcgtggggcatagaaggaagagaaatttggcttcaaaactgaaagacagtctgtgaaatttagtcacatgtcagagggatcactggcaaaaaatgtctgggaaccactgttacactccagctcaaccttgcggggccactcccacaatgccacctcatatgtcactgtgaatagggccacatcttcaccacatattctccctttcccaccaaaacttccatccagcaccaagaacaagggaggcctcctacagcagctccatgtggggagctatacccttagagacaggagtcggtgcaaactgggagttaacattttcattggagctgattgagctcaacttaccaataggttaatttgtaaatgaaaaaattctattgaaagagtttttgtaaggcaaactcctaattatccttgcacaagtctgctgcgaaattctcaacagaactttaagcttttgcctttttcatccactagactctttcttcatggctgctggtcacctactcatcttgccatccacctacccaaccctgtgtctcctctcccagacacttttctgcttcttcaggccaaaatccatagtcatactggcttttttttttctttatttcacatcccatttctaatcagtttgcaagaaaaactaaaattgtgaaggcaacccatctaccttggctggtctctctcctcccaatacccacccccaccgacccctccaacctctggtccatgttcgtatgtcaccttctcactgagccctgtcctaactactgtattcaaaattccaactcctgtcctccctaactactcccctcctcctagatttattttctcttaagttgctgatcactaacttaggtattcctgcttactgtctgtcatccctaattgggatataagctctgtgaaagctcagagttttgcctgttttgtatccctagtacccgcaacagtgcacacagtagatgctcaatgcaaatctgttaaatgaatgaacagcttcttctggtcattcaggtctcaacacaaagttcttctccttagggaagccttccttggccatcccatctaacgttgcacttccctaaattactgtctatcacatcactctgctttactttgcttctaggacttacaataatttaaactgtcttgttttcttatttgccctccacaatacttgtaggcccataagaactccaacttactctgtcttatccattgctataaccctagcacttaaaacggcttaacacagagcaggtactcagtaaatacttcttcaatgaatggagaaccttcatgacaaaaccaatcaaaatccattatttattttccccaactttcctgatcttgaaaattctaatccacagaaaagatggaagaatcatatatccacctacttttagtctggattcagctgggggtgaatctggaatgtcgggaggaactagactgtgttaaatcattacatttgctaaatttgtgtgctctcttctctcaatgtatatctatacagtcctgttcacgtaagcgtgcacgcgcatgcacacacacacacacacatgcatatgttttcccagaaccatttggaagtaaattgcagacaccatgacatttaaccactaaatacttctgcatatatctcctgagaacgagaacattctacataaccaaaataccatttttccacctaaaaaaagtaatgttgatacaatattataaattaatatatagtctacattcagattctccaaagtgctccaaggatgtcctttatagattttttttttttcaatctgggagccaatcaaggatcactcattacatttggtctcattagtctcttttaatctagggcaatccccccatcattttgtctttcatgacagtgatatttttgaaaagttcaggccagttgtcttaaagaatgttccacagaggatgtctagtcatagcattatgtttaaaagttaatctaatctatttgttctttagtttattattttaatatacggtgagttcatttttgtttgttttaaatttttaagtctgctgattttcatctttgttgattagattttaatttcttgactacttaaaacatttaattggttcaaaagtcaatactgaacaaaaagatacagagtctcactcctatcccaaacctttcactctgttgccacctactttctataggtaatcttttccactagtttcctgtttatcctttctgtttctttttacaaagtatgcaaatgtatgcatgagtatatatttataaatcacacatatatatttatgtgttacaattatgtattattttcccttctttgcacaaaaggaagcataccatatatagtgtacatatccctctgcaacttgtttttctgcttaaaaatatatctcagaaattactcatattggggccaggcgatgtggctcatgcctataatcccagcactttgggaggccaaggcgggtggatcccctgaggtcaggagtttgagaccagcctgaccagcatggaaaaaccccatctctattaaaagtacaaaattagctgggcgtggtggcacatgcctgtaatcccagctacttgggaggctgaggcagaagaatatcacctgaacccgggaggtggaggttgtggtgagctgagatcgtgccactgcactccagcctgggcaacaagagcaaaactctgtcacacaaaaagaaaaacaatcaaacaaacaaacaaaaaaaaacaaagaaattactccacatcggttcacagagaacttttttctttcttatggctacacagtacatgattgattgtgtggctgtatgtggataactttgtgcacatgttgttttgtatctgcacgaatctactattttttcataggttgctatagagttttttagtaggttgttataaagtttactctttaacacatattgaagccctaatccccagtatgattctatttggaggcagggcctttacaaaggtaattaaggttaaatgaggtcacaagggtggggccctaattggatagaagtgatgtccttataagaaggagagacaccagagcactgtccacacacgcacagaggaaaggctatgtgaggacacaaggaggcggctgtctgtaagcccaaagagaggcctctaacagaaaccaaccctggtggcaccttgatcttggacttctggcctctagaactaagagaaaatgaatttctgttgtttaagccacccagcctgtggtattttgctatggcagcctgagtgaactaataatatacatgtattagaagagctaaatgctgtagattcacatgaaaacaagctaaggattgagttaagagaaaatcacttaacttaataaaacttaaaaacttgtctcccaagatatcacttgagaggcataccccttaaaaggtaatttagggagcaactctatatgtatcctcagtctgataaactgtgatttaaaaaaagtgataaaaaagtgaaaaaaagataaaagatatttctggaggctcctgagaaggaagcaaggaaaaccctggcaatccatggaccaccgagtagtttgcgtgaagtcattttaaacattagcgtgagccttacaggtgcagatccattatagcatcaccttctattctgactcactcttctgaagtctcagtcacacaccaattaagttgtcttcttctacatcttaggcatgatgaagggaaaccacctcattaccacagggtccacagtaaatggttcccagactccaattcaagtgacatgtggatagggaggaaggtggcatgaactccaaggacaccagggcccaggacttccaggatctagggtgactttatgtttttttttttttgaattttttttctatatttcatacttgaataaactggctcagaaggtaaatgtcttcttttttataaaacccagttgaggatggaaatggcctcttttactattagtttttaaaatgtcatcattcatctgattaatatgaaaacatgcccttattactgaacattgtgatatatccttgaagaagcagctacttggagatattccatactcaaccagagcctaaagtgtacattatgcttattgagtgacttaccaaagcacacgcttacagacatttatatttgtttgaaaataaccacgaaagcagtcttgttttcttcaacttcagtacttcagtatgtgtataccaagggaatgggaaaggagagacacctttcctcacactccctgcttccttcacagtcatacaagatttgatcagaaggtaagaatttccttgtctgtcagatacagtgtctgacatagagtcagacagttggaaaaacatacgagttatttccactgaaaatgacactagtcatttccagagatgtaactccagaaaacatacaggaatgcaaaggcatctgtaggtttcaatggtcggggcaaatttaaatatgggaaaaggtcttctaactttaaattagaaggaaatggaagaaatctaattgagttcctttgttgctttttggattttcatttaaccaatgagactgtgagtgaaagcccattcagccaaagtttaggactttggttcttagaagaatgaagagccccgagttggacggaagggaccaggaagcattggtccccttaggtcccactggtggctttagagagaaatcccatggggcatgcagaacctttgaaatcacaagcaaagccatactacagagtttcattgttccagtactatgccccatccttttcctgatcttccttccctttcatccacctacccattcaaataaccctttcttcattatagaaatgtaataatgtacactgtaagaaattagaaaatgcacacaaagaaaaagaactccattacatttctaccattcacaggtcaccctgttgatatttttactttgcacacgttctcatggctcttcgtatgtacacaccacttgcactcacatttgtatttttaaccacagtgagatcatactgggcatatcgttcctccaaccactttttctgatcatcacctttcatcaactacttgggtcatatttgagtttctccaatttcccccactccagagtcctttataactggtttgtgtaaaccagtaaccactccaggaccatgaactacatctggtttttaaagctcttaaatcttgtttaacttagcgcagtccatttttatgtcactgacttattgaagaaatcaggcctgcaagaagttgtcctgtagaattaccctcaccctcccaccccaccaccatcccccgaccccagatttgtccctttgcttcctcatggtgttggtaagcttgttcctctaatcctttattttcctctcactggaagttatatctcaaagctttataaggtcaaatcataccgactacgccagtggggatgtgtgacaaagagacatcatggctgtcagcgaagggtattgtatttcatgaatatttggatcagaagatacctaacacctggctgacactccaggctcagattgacccctgcccgggttactgtgaagacagtctgatcctttaatgcacagttctgacttatcgcttgtgacaagaaaagagtgtgtgtgatgttactttgtttccgcatgtgttgttttggtataataatagtgtccatcaaacattcaccttaatggctttgaccccgagtgatcacctgtacctgaatttgttcatggcatttaaaacaatacgtggcactagattacaaacagctttgagaacaagtgctttgtcctttagaaatttagcatccccttgcaggatcttgcactcacctatgctaagtaagagttgatgctcgcgatatcacttgggaggcataccccttaaaaggtaatttagggagcaactctatatgtattcctcagtctgataaactgttggggcttaaatatgttccaaataaatgaagataaacttaacaccagcaattcggagtaaaccttgttcttagtggaggaaccagccatggagcctaaatgttggagctcaatctcagcccctgccccttttttttcctgtttctcaaaggggtcagcgatttctagtgtttccagtcattgcctatgctggtgttcctcctatctgtctatacctttggctctgtgatctcagtgccttaggcacatgtaaagcactacggatacgtatcaaggccatcttgatggcctctttcaccatccatgtgctccctacccaatttcttggtatctctgaaaggccccctcattctcccagttctttacccaggtgtagaccttcctcacctatgctaggctcaggctgtgtctcctgactgtgctctctgtctgtggtgggttgttgttgccatccaacatgcattccattgctagacagatattccttaaactgttttttattatgtcacttcttggttcacaatgtttcatgaattcctattgcttacctggtcaagtctaaattcttttgtctaaattttattcttccatagtaaggccccatgtagtgagaccatattttgacttatttccccaaatctctcatttgtgctgataaaagatgcctcctcaaagtcctgcaagtgcctctttttgggtctttgccacaccagtgtcctctcctgaagggtctctccccacttgctccctagtgaagtcctgtccatcctgtgggtgttgattttaggtgagataaacttcatgaaagagatggaagaaaaatcctgtccttccctccacctgaacctctgcagcacaaacaactgccagtaccctgccatctacaatgaatactcttgaatcactcacctttgatttctatgtttttcttttgattcttcaactgtattgtgggttctttgaaggaggtaatcttgctttacatttctaagttaatcccccaaagaaatgacctctggggtcttgtggtccattcctctgcttctatgaagtgttgtacttaaggattttgtcttattaagcatctggtttaagcacatgcacacgggcacacacacacacacacacacacacatgcatgctcctctgaacgtaattctgtattttttggtgcctctctcccatgtctagcatcttatactgttacaaaatcctcctttaatatagctgaaatccctcctgtatagttgggatgctatttcttcttgtcagtgaatgagacatctggtcaacatctactaaagcagccttaaataggaggaatggaaagactttgttaaacagaactttgaaaggttactgcacttctctacatgaacaccttgtgaattgaatgcatttaactcatccaaaaaaatctccagttacgaaaactgtgcttcaattatcttcccttagtaacttcagttatcttccctgatttcccaaactatgaagttcttaccctgaatctgggtgttccacatttttaatctttccaccttcctatttgtagggtacaattcaattcctgtgctactacagatccacttggcagatataagaaacacaaagaatactcccacatagactaaggcattcagtgggaaacaaacagtgcacacatcagaacgcctctcatggtagtagagtgttcatctttatagagcaagacgcttgagggtcctgtctgttaacagccattctcctggcctttttagtaacttcctgttttccttacacttctcttttcttaactatcatacaaaacaagaaaaacagataagcagggaggcatcagaagggtttctctggatagatcttcaaagtgacccatataaaccttccatttgactggtgccactcaacctggcttgataaacccaagggtgtggccactgctcatagactgccctgccctacccagttctggttgttaatgccacctccaggaatgatgtcatctatgtaacacttttgggaagaataagctgtcatttggttttgcatataaagaatacaaaaattaaagaaatcaatagaaaatgatggcttaaaaataatcaggaaaaaatgagtaacaatgacatttaatagctgtcctttataaaacagaagataaaatgaaataggtatttcttcaacaagctggaggcctgtaattgtgaccttctgtatccttcctttggttttcttctaagcccaggaatctttcattggctaaatcccagcatttttttttttcctcccttggccaacttttggccttgcttgggaacagctgccagtatttctctttgctgccagtcagtcaaaaatgtgctcacgttggaggcctggctccatcccacccagggtgtggaatgcattaactttttcacaaacagccttcgccaggctgcacacgaaagtccatctcagcaaagctcaccgcattactagctggcttggaggtgatgccaatgtcagttacagagactgtcaacatattttaggagtctatggcaaagtgatgaattttactatgtgtaccaaattaatggcaaaaaagaacacttccgagatcctaggaaaccaaaagtgttattatttaattgcttctccactcctcaaagcaaaacaagccaattcttttctagcctgcaatttggttcagaacccaaacaaacaagaaaataaaagtattaactgattagtgcccacaattttattctattttctttgtgcttttaagaacagccttctttcttttttccctttttttttttaactgaccaccatgcatcactccaatgcctgggtatgatccattttattaaaaaattcctgaatcaatttcctggcttacagcttatccaaccaagattccaggtgttctcaccataagaagggcctctttcaaaagctgtctgcttttataactgcacacccaccagaaatgtcatgaacaccccaacaatggagttgaaacctgaagacattgggtgacattccaaatttttgaatggaatgcgaatccattaagattattaggtaactttattgatatcctcagatttgtgccaaatgttaaagctgccaaagaaaagacagaacaaaaactgactcttggattctaactctgagtattttggtgtggaaactgtgttttcttgtaactcacttaaaaaacacaccgtgctttcactgtttaactgcaatctcagttttcaggaagcaagagaaatgagatacataatcaatgtttgccttctattcagctttcagcctaaatgatcctgcacttgtattggcaaatgaggacaggtattaacagcgaacaggaaacctattctaagaaggactggctcaagtgaagcaccactgcatcgtgagtgactcaaccatctactcaaagagtgattactctgcaaggatgaagccatgctaattggacaatggcttgctgccagttcgtgctggcgtgacctacaatacccttggctgacagccatgatgtctctttgtcacacctttttttttttttttccaagggtgtagggtgtaatctggatgggaagtagaaataattttgaaaaactctcacaagtgctatttaaattcttatcataaattaaaaagtttaattaagtaccttggtaaaggcccgggttctatgattaactacgacaaaataatagttatgatgactgatcaagtgaggaactttatagctctgaactttgtctttaaagctattattaattttaattgaaatagctaagagactccataatgggagaaagaaagaaacatgaaggatattttgttcatatacagaggagtttaaaaatgaatagatacgccggtaactattttaaaaaaattgatgcaaacaagtttactttcagaggccttgtcataaatctatttcaaaatgttgattattgtggtcatcctacatcagatagggataaatagacatagtgaaaagaaatcttaaaaacggctttgaaatcaggtcacttaaaatgatttttagatatgtcttaggtttttgtctactcaactcctactactatgccaaaagaggaacacatttctgcataagtttctttaaataggcttactggcctcaggatttaaaaaatgtaagaggtttggaaacagcttatgtgtctcagttttaaaattagctattgctgtggctattttcacactagatttccctccctctgtatcagcaccacagcctccagggctggagtcacaatagtattagctcccctttctgtggcgctgccttaccgcaactccatccgagactgaggaccacatttcagggctagcagtcacctctgcgttactataaataagttctgcctttaggcatttcaaaattatcagtatgattctaggacttgaaaacttctcatttgccagcaagtagttacctgaaatattttgacttcttatttatttgcttttttttcatctgctgccaagtcttactaacgcaacttggaaaattgcaccacagcttttaatgaggattctgaggtaacagccatttcatcagagaagactgttctttccttttaggggaataataacacctactgtttctatagcaccatccttccaagaagtttaacacatcacatttcatttatctgaacagcggccctgcaagtcaaactggtaactagcattgttactccttgtacactcatattgaaattgaggtcattaaatgtgaactaattttctcaaaatcttaacaccttctgacatggttaaagagccatgatccgcctatgttctaggtgatcagatagcccagaagtctctttccgctctttagctgtcatctcctgtgaatgcctgtaaggaaggccctttctgaaaagtcagggaaaagtcataaaagtgggagaactgagcttgtgcctcttctggagtcctgtggttctctcccttcctggccagtttgcctcccatctttatggcttttccctacctctcaatccaaacatccctccactcttcctgaccaacaggattttttctctcttcctccaacaggaagctagccaagttcaaggactgtaaacctgtgtgacataggctaggatctcagagatcatccagccccaatccatcattttcagattaggatgtgacttattgagtctggccatttggttagtagatcccatcctctgttgcatactgaaggcaattgaacttctgtctcctgtatcatcaagttttctctctcttttggaactttcccttcagcccaggtattaggacaggttaggctttgctgtgctaacagataaaacaccacatcttgagagattgtttggagcttctagcaggcagcacagctatgtatatacttgtgaatgaagaacggtcctcctctatcagggaaggtcgtcctcttcaaccaagcctgcagcttcaggagggacacacgtggagcagtgagggagggaaacgacacccactgagccagccagatcagcccaatcaacctggcgatgttggggtgacagatgttgcagccagattgccttcacatccagaaacaccaaatcttgagtgcttaattaacttaaaagtttatttctcatcatgtcagagtctgatttgagtcagatggattttgctggctctcttccaacagtgactcagggacctaggctacagcttcatcactctagagtcctttgacaccagctaagtggatgggacaaagcataaagagcttatacctacttttgactgccttggagcagagtcctcacctcacatttcatcagctagatctagtcatatggcctacctgattacaaatttagtcttcctgtgtgtctaggaaagaggaaaactgggtgtgggtgagcaatggtaatcttcaccacagagtacaaacatgttgggatttcttcctacttaaaataaaaaaccaaatgaaacctcttttgacaccgtttccctccagctactgatctacttctctgttccctttcactcaaaaagccttattctctctagaacacaatcaaattggtttttgtttctactgctcccccaaaagtgctcaacgaaatcacaaatggcctccaaattgccggatggtcagtttttggccttcatcttagcttacagtcagcatcatttgacctagttgatggctctctcctcctcgaaatgctttcttcacctggcttaccacgcactatgctttgttgcttttcctcccacctcaggcttgctccttcttggtctaccttgccggctcctcttcatctccctgacctgttaattcgagaaagctccaaggctcaatcctgggacttcttttcctttctatctccactcacttccttggtgatcgtatgtagtcctgttgcttttagtattcccaatattctggtattacaatttttatctctaggatagacttctcccatgagttctggccatgtaagtccaactgcatactagacatctttacttagatgtcaacaggcatctcaaacttaatatatacaaaatagaaggccgggcatggtggctcacgccttaatcccagcactttgggaggccgaagcaagtggatcacttgaggtcaggagttcgagaccagcctggccagcatggcaaaatcccgtctctactgaaaatacaaaaattagccaggcgtggtggtgcacacctgtaatcccagctacttgggaggctgaggcaggagaattgcttgaacctgggaggtggaggtggcagcgagctgagattgtgtcactggactccagcctgagcaacacagtgagactctgtctcaaaaattaaacaaaaaaataaacaaaactcccaattctacccgagtccccaatcctactcctctcagtcttcgcttcacccatctcagttaatgccaactccattcttccaatagttgaggccctaagcctggatgttatctgtgactcctctctttctctcccaccttgtatccaacatataagaaattcccatgagctctaccttcaaaatatcaccagaatctgacaccaaccaccatgtcactgctatcaccctggtgtaggccatcaggtcacacctgggttgctgtcttagcctcttgtgtcttttccctgcttctgccctggccctctttcaatttattttcacgtggcactcaaaatgacctgtgaaactctccagtggccagctcgttccaaaaaaagaccaatcgctcagtgaggtgcacagtctggaccatcacctctctgactcacctctccccaccctgccttggctcactctgctcctgggtggcaaacacgccctgcccaccacagcctccttgtgattcctcctgtctggctcaccctttccctagacatcagcacagccagctccctcacctgctccaggtctctcttcaaaagtcacccccttgaacaggcttttcttgatcactcttcttaaaattgtaatacttgtatcctaactcccttctctgttttattttcctcaatggcatctaacaaagtatatttaacactgattaatttcctctttttcctcctcctccccactggaatgtgagctaggttcgcctagcacctagaatgatgtctcctggttacatagcagggtcttgacaaatatttgttgaatgaataaataaatgagtgaggaaacagaagcccagagaggaagactagtttgctgaagacctcacatgcagtgataccaaggtgcagagtgtggttttcccagcccctcaaggctgatgatcctagtttaaaaaaatctgcccattactctttttcaggtaaagagtggtggtgtcttcttcagagttttgtttaggtgaatggggtgaggccaaagggcaggctctgtgctctgggctaagtgagtgttttgcccttctcatcctggtcatgccacttcccaaagacttcacccctgtttcccaccaaaactccaccttcccttgtcctcaccctcaggctcagaatgctgttgtcaccctgtgctgtggcgttaactactttctgtactattacatactgaaagggttgcccaaagataatcatgactgtcttattgcttccttaagactgaacctaaaccatcccagagacattaacagctttcatatcctctaaaaacttccagacaagaagattccataatttccttgttggcatctgtgcttggcagtactgctgcaggaatgttctttattgcagcctgtggttaagacttaacaacaaatgccttttctttagaatccttctgggtcagctttctttcctgtatagcactgaaaagtgagatttgccccaaaatgttgagtgagagagagaaagcaaaagatagtgagcacaagcgagcacaaacctgaaatctatttataccgaggaaaacataaggtctacctgcaggggccatactcacccccagcctgtagctgttccctgcatgaacccgtccccttctctagagggtacaaggacacaggaagcaagccagagaaaggtggtgagaccttggcagtaaccttttaacagccacttttcccctagcattctgtcaaggagccaggcagccacgtaagaatagtgttgatgtgcaaacccactgtgggctgagcatcttctaaggaagcacatcccctccctgtcctctgaacttgacacgccataagactgaacttcatagttgtgatgctacttccgtcatggctggcatccagcccgaaatggcctccatgactatagctaaggaggtgtcatactaatgagcagtggaagaacggccctgcaatgcttagcacatcaactactttctcttcatctcttagcaaaacatatacttactcattataaaattgaatgatctgctttattatgtaatgaaagtactaagtacagtggcttatctcctactatttgctgacacaattacctgggtgtgtttttcagtggggaacaaacactcaagtcctagaaatcctagggattgccatttgtttttttttaaaaacgcaagataattcaattattccttgatttctagaaggaggcctccctctatttttgtctgtctttcagtttagagactatgctgggctctgtgagtggctctaatgtgctggtaatggcgtggctcatcaggaattgggatttgggggtggaattgcacaactggacagtcgctggacggcagatctgggtttggcctaaggtggatggggagttggggggaggagtggcagtttgtgttcggaagtttcaggctcctaggaggaactctcaggcctggctgtgctggcccccttgaggagcacagcggttggctgccaagggagtgtagatgggtcaaatgtgactaagaggagggcagggccagaagttgattcaaatttggcgataggattatgatgaggtttaaagatttccaaggagctaatctaatggtttttcttatatcctatgaaccaaatgccgattagttccagaaagctactttctaaggtagtatttagaatgtctgcttatttaccacttaattcaaattttatgaaatcactcactgagctaagtgtgacaattaccattgagcctgcagggacatttcagtgtgcacacagcaagtcaggaaaacaatgcccagcacgtgggtccacaggcaggtgccctgagcagagggggagggctcttcaaaggaggcctcagaaacaatgacagagcctcaaaagaaaatgccactggggctggcttgcatgttccatcaacaagatacttagagctggattactgaaagtatgaatttgcgtttcataagaaaaaaaggatctagttctacctgaagatttcagatacgtgagcaaccagaatgtttcaatggtttcgaggatgtagatgatgcagggatgataatcattttacagggggaggaagaaagaaaatcaacacacagcaaattctcacttaaatgagaacacacagcaaattctcacttaaaaggccaaatagatttttgtgcgatgtctatacagtgtgcctcttatttaaaatgccttttccaatgccatggaaataagcaattatcagggatttgatctaaaaagaaactttaaggttatgtcatatacatttgtatcccagtttcctttacactttactgccttggtattgtatttttggtaaataattcaaggcaggaggatcccttgagctcaagagttccagtccaacctgggcaacagagcaagactccacctttaaaaagagacttacgtttgtcaaatgcctactagaggataagggctgtgctgagaatttttgtatttatcatctcacctagtcctcatggcaggacagctagttaagtatgtccccaacagcgcagttaaggaaaggccagctcaggatcccctggctacagtgcagctgccattcctcggccttcccgttacttggtacccagtccccactccttatcccagccccagtatgtcatttagctgatctgtccttttgcttctagtgttgggatctctctagctacctacttgctagtggtatgtggagtggtaatggagcattctattttgagtatgtaacaaggatacgaatgtgaaaacgctagtgcttatgcagtccttatttatttatttatttttttgagacacgttctcactctgtcacccaggctggagtgcactggtgtgatcatggctcacttgcagcctcgatctcctgggctcaagcaatcctccctcctcagcctcctgagtagctgagaccacaggtgtgtgccaccacctctagctaatttttaaatcttttgtagagatgggggtctccctatgttgcccaagacagtcttgaactcctgaactcaagtggtcttcccgctttggcctcctgaagtaccaggatgacaggtgtgagctgctgcacctggccccagtcctcatttttatcagctggttgccttcctgctcagcaggggtaatagcagatgttgcttaacaagggtctgggatttgaagaaacctccactacccatatcttgtttgtctatcaaatagacaaacacaaatagtgttttaaaattttaattattattattattttttttgagacagggtctcgccctgtcacccaggctggagtgcaatggcgtgatctcagctcactgcaacctccgcctcccaggttcaagccattctcctgcctcaacctcctgagtagctgggattataggcacacaccaccatgcctggctaatattttgtatttttggtagagatggggtttcaccatgttgggcaggctggcctcaaactcctgacctcataatctgctcgcctcggcctcccaagttattatttttttaaagatggggtcttgctatgttgcccaggcttgtctcgaactgctgggctcaagggatcctcctgtgtcagcctcctgagtagctggggctacaggtgcactctactgcacctggcttcttgttttttgttgaatttagatgccttttggtggagcaggtgcttgccccatcacttcctactgtcctatatacaacctacttcactcatttatattatttgccaggcccctgaaggcgtctggtttgtgacttctgtgatttaatactggttgtaaccatcagcatcatatctgggtgatggggtctttggtttctcctaagatcactgtgaagagctgcttagtcaaacaccacacaactctagggaatctatttgcaaaaactatggatgtgagttgtactcctgggagttacaaagtacaaagcttgtgtaactgttggtggtggcccaagagatgcacaccgcgctggtggtacacagggaatgattctgcccgaacacaaagtattatccttagtcccataggaatgacggaagtcaggatgatgaaccaagaggtagtgtatatatggttcaaaggatgaccatttaatggtttgccattgtgaagcccatcttttggggtcctacaacttaaaccatccaattaaatgtcatctctggacagaccaggtccagctactagtgttcccaaagtgccaaaataaccgtattcactgatgtgattaagaaacctgagtgggctgttttcaacaacggtgagaaaagcaagtttacacttcttagaatcttactgaattaatggtgaaaattactagttgcttttatttttcccccaagcaaagaaggtgctgtgaatgctttcgatcttttactctcaagggaaatctagtgatccttacaccatctgaaagacagaaatcatagcaatgattcagatcccacatctaggactgtgccaaacttaggctgaaccactcaaaacctgaagggtaagtgaactagaaactacaagtgactgagccacaggtgaggttcagttcccttcaagaaagatattcacattctgtgcctctgagactttaagtgtatcaaatagaaactgactatgccacagacctaacatgtgacttggacatcaactcctgagtggggacatggcacctagtacatcttctagctcctagtcagccagttttctgtaagtcaataaacattcattaacaatcacacaaaccaaattactgtacctcctcaggcaagctgaccaccaaatcattttttgtctgtccaaccagcgcctgccaaaaatattcactgcatgcggccagcacagcccggtgggcccggaactccttcctctccacgatcaaagtcacgtcacagagaatatcctttttccgctggtcattgaggcccaggaggatgttggtgcagtggactgtggactcatacacatacatgggggagtcaggcttctcatccacagacatgccgttcacaccctgaaagaaagaaagaaacaaagaaagaaagaaagaaaggctgagtcaccacagctgtaggatcagagagaggaggtgagaaagaacatcatggttcctgtgtcccactgccatgagcatggcaggaaggaggggaattaccaatcagcatatttgtgcttactctgtacaatgagctcaggaaacatatctgtaaagtcaagttccacagctgacttttatgcttcctacttaccgcattcttttaccccatggtaacaaagccagatcttttaatagaacatttaaaacatttaaaacacattggtattttaaaacttggtggttctgattttgttagtaggctgaaaaagaaatttcacatgtaaatagcctctatgcaaggactaacttagatttgtgtgaagaggaaatgaatcattttgaagtatttgtaatgttgtcttgatgaagtatatgtaagttcctaaggtgaaatttggctgagatgccaagtagagtaaacatcaaatcacaatacatatttaacaagtgaaccaaactgtctgcacactgaagactcagtagagtcagctattgcatctgccctctgccacttcaaggcaaagcacaattgccataatgcaatagttgctcagctcttagaaagatgtggaattgtgctgtcgttatcccagctgaattgatgtacatcccctttaaggaaacacaatatatcacaatagcagtcatgaaaaaagatgcattcaacagtcaagattacttttacaaaaggttctttgctttaaaaaatatccattgaaatatttctttttcttttttttgagagggagttttgttcttgtcgcccaggctgaagtgcaatggtgcgattctcagctcactgcaacctccacctcctgggttcaagtgattctcctgcctccgcttcccaagtagctgggattacaggcatgtgccaccgtgcctaactaatttttgtatttttagtacagacgggatttcaccatcttggccaggctggttttgaactcctgacctcaggtgatccacccgcctcggcctcccaaagtgctgggattacaggcgtgagccactgtgcctggccccgctgaggtattttaaaatacagtatctgtaattaatttatatagttacatagtttttctgtaatgtttgctagagtagtaagaattccagtagcgagtcctactttctttttggctttcttatttttttaaaacagctttaacatacaataaactgtacatatttatagtgagcaatttgatgttttgattgtgtatgtaactgtgaaaccatcatcacaataaagatagtaaacaaatccatcatcaccaaaagtctccttaaggcccttgtaataatttttcccttgtacctctctgtaccccaccgctacaacgactgatcagctttctgacattctatattagcttgcattttctagagtttcatataaatggaatcataaactacatattcttttatatctggcttcttctattcagcataattatttcaccattcatccatgttgctgcatatatcaagtttgttcctttattacttagcatcctattgtataaatatagcgtaactttttttttatccattcatctattagtggatatttgggttgtttccagtatttatttacaaataaagctgctgtgaacattcacatacaattctttggatggacatatgctttcacttctcttgggtaaatacctgtgagtagaatgtattatatggtatgtgtaagcataacttttaaagagtctgccactgttttctaaagtggctgtaacattttacatttccaccagcagtgtatgagttccagttccttcacatccttgccaacatttggtatggtcactctttctagttttggacattgtaataggtctatcatatttctttttgggtttaatttgctttctctaatgcctgaagttgttgagaatcttccatgtgtttatttgacctctgtatattttctttgaagaaatgtctatttagattctttgcccatttttaattgggttgttttcttatttttcagttttaagagttcttcatatattctgaataaaagtcctttatcagatacatgacttgtaaaaattttttcccagtctgtagcttgtcttttgattctcttaaaagtgtctttcaaggaacagaaagtctttatttgatgaagccaaaaaaccatcttggtgtcacatctaaaaaactaaaccaaggtcataaagattttctcttgttttctgctagaagtgttatttttttagcccttacatttaggtctatggcccattttgagttaatttttgtgtaggtaacaggtatggattgaggttctttttttccttttgcataggaatatccaatcattcccgcagcattgttaaaaatactcttttctctcctgaattacctttgtatttttactgaaaatcagttgtttttacatgtatgaatctatttatggactctgtcttttactatttttatgtttgtctacttttgttttttttggagacaaaccttgcttatttgtacttttactgaaaatcagttgtttttacatttatgaatctatttatggactctgtcttttactatttttatgtttgtctacttttgttttgttttgttttggagacagggtatcactttggagtgcagtggcatggccatagctcacagcagtagctggcactacaggtgtgcatcaccgtatctggctaatttaaaaatattttttgtattcctgtaatcccagcactttgggaggctgaggcaggcaggttacgaggtcaggagttcgagaccagcctggccaacacagcgaaactgcgtctttactaaaaatacaaaaattagctgggtgtggtggtacgtgcctgtaatcccagctacttgggaggcggagacaggagaatcgcttgaacccagaaggcggaggttgcagtggccgagatcacaccactgcactccagcctgggtgacacagcaagactctgtctcaaaaaaaaaaatatgtgtgtgtgtgtgtgtgtgtgtgtgtgtgtgtgtgtgtgtgtatgagtgatgaggtctcgccatattgcccaggctagtctcaaactcctggcgtcaagtgatcctcctacctcagcctcctaaagtgctgggattacagatgtgagccactgtacccagcctctatatctacttttatgttactatcatagtgtcttgatttgctctttttcaaagttagtttgatcctttgcatttccatatacattttataatcagcttgccaatttctacaaaatagtctgctggaattttcactgagattgtactgaatctactgatgaatttaggaagaactgccatcttaacaataatgaatcttctgacccatgaacacagtctctttatttagatcatcttgaatttttctcagcagccgggcatggtggcttacgcctgtaatcacaagactttgggaggctgaggcaggtggataacttgaggtaaggagtgtgagaccagcctggccaacatgctgaaaccccatctctactaaaaacgcaaaaattagccaggcatggtagcgtgtgcctgtaatcccagctacttgggaggctgaggcaggagattgtgtgaacccagcaggaagaggttgcagtgagctgagattgcgccactgcactctagcctgggcgacagagcaagactccacctcaaaaaaaaaaaaaagaaaatttttttctcagcaatattttaattgaaaattttttttggagacagtctcactctgtcacccagatggagtgcagtggtgcgatcttggctcactgcaacctccacctcctgggttcaagtgattctcctgcctcagcctccggagtagctggaattaaagaggcatgtgccaccgtgcttggtcaatttttgtatttttagtagagacgggttttgccaggttggccagactggtctcgaactcttggtctctcctcggcctcccaaagtgctgggattacaggtgtgaaccaccacactgggccctcagcaacgttttatggtagtatataggtcttttatacctcttttgtcagatttatacctaagtatgaatatttttgatgccattgtaaatggcagtcttttaatttcaatttctaatttttcactgctagtatatacatacaaataatttttgtattttgatcttgtatctggaaaccttgcttattagttctcatagcctgttttttcttggtagattccacggtattttctacatagaagattatgttgtctgtgaataaagatctcttactttttttccaatttggataattttaatgtctttttcttaccttactgcattgtctagaagctctagttcaatgctgaatagaggtgatgagactaaatatccttgctttcctgatgttaggaagaaagtattcaaccattcaccattttgtatgacgttagctatagatgcttcataggtgctccttttgagctgaggaagttttatttctttctctccctctctcctccccttccttccctcccctcccctccccttgttttccctttctttttctttttcttttttttttttttgagatggagtctcgctctgtcgcccaggctggagtgcagtggcgcgatctcggctcactgcaagctctgcctcctgggttcacgccattctcctgcctcagcctcccaagtagctgggactacaggtgcccgccaccatgccaggctaattttttttgtatttttagtagagacagggtttcaccatgttagccaggatggtcttgatctcctgactttgtgatccccccgccttggcctctgaaagtgctgggattataggtgtgagtcactgtgcccggcctctttttctatctttctttctttttcttcagtggcactcatggctcactgcaaccttgaattcctgggctcaagcaatctcctgcctctgcctcctgagtagctaggactacaggtgtgcaccaccatacctggctaattatttcttatttttttttgtagagatgaggccttgctatgttgcccaggctgctcttgaattcctggcctcaagcaatcctcgtaccttggtctctcaaagtgttgggattacaggtgtaagccactgtgcccagccctgtgtttgccttcttatacattgttggattcaatttgctaacattttgttaataatttttcatctatgttcaatacggagatttgtctgtagttttcttacatagtttttctggcctggttttagcatcagggtaatgatgatctcataaaatgagctgggaagtatttcttcttctttaattttctaaaagcttttttttttttttctttttgtagaattggttttatttcttccttaaatgtttggtagaatgtacctgtgaagacttctgagctgggatagtctttaactataaattcatttttttaaattgtcaaatttattggcataaaattgtgtgtgtgtgtgtgtgtgtatatatatatatatatatatatatatatttttttttttttttttttttttttagacagattcttgctctgttgccaggttggagtgcagtggtgcaatcttggctcactgcaaactccacctcctggattcacaagtgattctcctgcctcagcctcccgagtagctgggactacaggtgtgcgctaccatgcccagctaatttttgtatttttagtagagacgggtttcaccacgttggccaggatggtctcaatctcttgacctcatgatccacccgccttggcctcgcaaagtcttgggattacaggcgtcagctaccgcccctggcctttttattttttttattttttaaagagacagtgtctcactttgttgccctggctggagtgcagtggcgtgatcatagctaactgcaacctcaaactcctggggctcatgtgaccttcctgtctcaggctcctgagtaactaggactataggccgtgccaccatgttcagctattttttttttttttttgtaagagatggagtcttactatgatacccaggctggtcttcaactcttggtgtcaagtgattctcctgctttggcccccacaaagcactgggattacaggcgtgagccaccacacccagcccatatatagtttttaaaaatattccttctaatatgggttgaatctgtactgatgccacctctcatattactgatactgaaaatttgtgtcttctctttctgatcagtctggctagaggcttaaccattttactgacattctcaaataactagtttttggttagtttttttaaattattctattttctagtttgctgatctctattctcattgttatatcctttattttgcttactttgggtttaattgggtctttttttcttttccagtttcctaaggtggtagttgagcccactaatctgagatcttttttgtcttttctaacacaggctttaatgctataaatttcactctgttttagcagtatcttgcaaattttgaaatgtttaatttttactcaattcttaatgctttaaaatttcccttttgatttattccttaatgcacaaatgatttacacacgtgttttttggcttccaaatatttgggggagtttttagttatctttttgttaatcctctctgatttaattccattgtggtcacagaacaaacttcatatgactttaatccttttaaatttatggagacttgttttgggtcccagaatgtgacccaccttggtaaatactacataagcacttgaaatgtatattctgttgttggctggaatgtcctgtaaatatcaattaggttaagttgtatgatgagtgttgttcaagtcttctaatatcttttctgatcttttgtctataggttccgtcatgtattgagaaggagtactaaaactttccggctacaattgtaggcttgtctgtcagttattgtaattctattagtttctgcctcatgcagtttgaaatcctattagatgcatatatatttagggtttttattttttcttgtagtatttattcctttatcactatgaagtcaccttttaattcctggaaatattctttgctctgaaatctactttgtctcatattaacatggtcactccatcttttgtttggtgttagcacagtatatctttttctactcttattcttttaacctttttgtgtttttatatttaaaatgtgattcttgtaagtaacatataattgggtcttgctttttaaaaaaatctaatctgaaaacgtctgagttttaattctggtgtttaaaacatgtatgtttaatgtgacaattgatttggctaggtttagatctgccattttgctacttgttttctatttgttctttattctcttttccttcatcttctgactctctgtgttaactatttttttatgattcaatttcatttcaattattggcatgttgttttgttatttcattggttgttttaggatttataatatgcttctttaagttatcacaatctgccttccagtgatatcataatatgcttctttaagttatcacaatctaccttccagtgatatcataccatgtcgtgtaaagcacagtagtatgcttccatttctcccttcctggccattgtattatacattttacttgttacttgttaaaacccctgtactatattgtcattacttttgtttagtcaattaccttttaaaaagatataaataatgaggtaacattacttgcagtgcaggtatactagtgataaattatttcaacttttctctgtaaaagcctgctgccttcatttttgaaagttatctttgaagggtatagattccaggttgacaggtgttttttttttttcttttcagtactttgaaaattgtcattccactgtcttttcacctgcattgtttccagtgaaaaatctgtcatcctcatctttgttcctctgtatgtaatgtcttttcttctcctctgttgcctttaggactttttcttgatcacttgttttgagcaatttgattatgatgtgcctttgtgtagttttcctcatgtttcttgagcttcttggatacgtggatagttttaaccaaatttggaaaaattttggccatcattttttcaaatatttttgccacaatttttttgtcttctcccctcttctcccttggggagttacatataatattagaccatctgcatttgtcccgtcgctcacaaatgcccattttttttttcttttggtactttaaagaaatctcttacattttacattggatagtttcttttcttttcttttttttgaggtggagttcagtggtgtgactttggctcactgcaaccactgtctcctgggttcgagtgattctcctgcttcagcctcccaagtagcagggattacaggtgtgtgccaccatacccagctaatttttttgtatttttagtatagacagggtttcaccatgttggccaagctggtcttgaactcctgacctcaaataatctgcgcacctcggcctcccaaaatgctgggatcacaggcttgagtcatcatgcctagccacattggttattttctattgctaacccttcgagttcactaatctcttcttctgcaaggtctaatctgccatcaatcttttccagcataattttcatctcagacactgtggtccttatctctaaaagtcccctttggtcttttataaaaaatcttccatgtctctacttaagatgttcaatctttcttctaactttttgaacacttggaatatagttataataactactgcaatgtccttgtctgttaattctaacatcttctggttcagtttttattgttatttatcttcattgtgagttatatttccttgcttctttgcataactgaacatttttgattggatgccagacagtgtaaaatttaccttgttaaatgctggatatttttgtgttcccataaataatcttgagctttgttctaagacacagttgagttacctggaagcagtttgatcctttcaggttttgcttttgagatttgttagataggaaaagcagcatttagtctagggttcattactccctactactgattcaagacacttctgagtactctatctaatgacccctgatatatgtgttttctagtctggctggtaggaaatgatgttattcccagttctctgagttccctttgttttgggtggctgtctctccatccttgggtagttttcttacctgcatctgctgatcagtactctgcagaatattaaagggaaactctctgaagatctctggagttctctctctgcagctctctcttctctgctaccttgctttctgaactctattatcatctttccagactcttagtgctgtctcttcaactgaagagtcagccagctcttccttggttcttccttcctgtgccatggcctagaaactctcaaagcagtatgctgagttcagtttgttttcctttcctggggattactatcttttggttcctgatgtcccatgtcttaaaaatcattatttcatatattttatctgtttctatagttgttttaggagaaagggtaaatctagaacctattactccatcttggctgaaagtaaaagccataggtttattttttatgctacagctactccaaacactttataaacaataacttatcacaatgcaaaccacatagtataaactttgctctgctatatataatggtttgtaatacccaattacaaagatgcctctgtgaagaattattagttctttggtattccaataaaagataaaatatttgtgaggtttgttatctggaatcattttttaaatggaattagaatagcattctaaataacacaattcagttataatgaccctaagccacggggtaagatcgagttcacctggcttctgtcaatgactaggaaattgctgctaaattctttattatctagtaagaagacaaatattttctattctggcttcttattagtccttcattttcgtggaatgttttcaggattttcttatctcccatatagggtctcaattctgatttgttttctccattcttagttttcaaattattattctttctcctaccacactgagtctcctcaattagtctatagaaattattgagttaaaaatcataatagcttgcatgtataaggaaacactcaaaacttggtggagcatttaatgttctaggtcacggatggtgtgttcaattcataaaaagtaggagatttataagggacatctcatttttccagttcatttatgggtaatacatattaatgtgcctacaccaagatagaagcttgtgttgaaagaaacaaagccataaattctttaatgaaacatgaaatgaaagaaaataaaaagagaaatgaaagtgaagtgcagtggaaacaggagtggaccaggcatgtttggggcttttggtttagctccagcattgaccaactttgtggatctggacaaactgcctaactgtttaggggcctgcttccatgtttgtaaaatgaaaagcatgaactagaagaccaatagtgttcttccagatctacaattctatgagtctataaaagaaatatacctgattgatcacaaagagcgggatactgtcttttttaactgagagaagctagttttctttgaccttctaaagaccattttgtgccgttatattgttgttgatgttgcatggcttaacaaaactgcccctgcagagctggttacagggaatggggtggacaacaaatatacaaggaaaccacagccttctgggagagtagaaactaggacccaaacccctgctctttctgggctctaagatggttgaagttctcaagagtagactccatattctgctaacagggcaggtttagaaaaacaaagatacagcaacataagcatcccaagttgatgaaataggctgtgacagtcacataaacatgggcatctgctttttgggctaaacttacttgagagctttggaaaacactgaaaaagtattagttttgttcatcaaatggtataatctaaaatatatcactttcgtggagctgttgttagactaacctgactgaagattttcttgaatatattacattatttctggataataattctttatgccatgtcagtattactttcttccccttggcctttacctacccctccttgttggttcctcttcaaacataatggaacatacctttctgctttctttaaaaatcagtcagcccttctcaacctccaattatcatgggtgcattgctatgggttgaatgtttgtcccctatgaaaatcatgttgaaacttaatccccaatgtggcagcattaagacatagggccttcaagagatgattgggacatgaaggccctgccctcatggattaatgaattaatgggttattgaaggagtgcattagttatcatgagagtgggtttgttacaaaagtcactttggccctctctcatgagctccctcaccatgtgatgccctgtgccaccttgggattctgcagacagtcctcatcagcaagaaggccctcaccagatgcggcccctagacctcgaacttgccagcctctagaactgtaagaaataattttctttatacattactcagtcttaggtattcagttagagtatcagaaaacaggctaagacaggtgctcttctatgaactccctccaatttgtctgcttttgactggccaatgccaaactgaattctgcttctcctgtttccactaggttttcttttttcacttgccttgctaatattaaacaacattcccctccgccccccactcctccatgcagcaaatcctgaaatctgcagcaggacccatgggatctaagaatgaaatggtttatagtgagtaacagaacccagaatagcatggaggagtatgacagccagtctttaagcattagacaacgtgttaaagtatgtagacattagctgaaatcagattgtaaggaagctttccaaaggttctgatttgggttttggctggatctcattcttccttttgcaggccaaaaaacccagctgcacatgtacatacacatataccccaatcatctcatcatatggttcagcagtaaaagtaaatcactattattttatcatagtatattcatccccttaagaagctacacagaccacaactcttattactcgaaggtatagtattaatgaatacagacttactcattaactcactcattgactcttcattcattatcgggtcatattcagaaatgaaaatgtctaatagttctgcaggtaaaagtataaagcaaaaaagtaaaaaaaaaaaaaaaaaaccaacaaaaaaatcacagtgggatctgaaaagctgcaattcacaaaaaagtagaatgttaagattttcagacaacctgtcatgtctagagtgcttcagatgaaaagaaatgaatatgccttgcaggtaatgaaaaagaccaaattataaaccatttcacttgaaattcaaactacatttctcccagaaacagtgcattaagtaaatacttctgtgaatcaaacactaaattatttagtaattgctgagtaaattcctgctcttataaaacatgcttttaaaaaaagttatttactgtaaaactgtaagggttagttcttataaaagaaagttttcaagtctatagacattttagagtgcacagtgctataaaaattacttacttattacttttggattggaaacactttctaatgcatcaagactaaaacttcttactttaagtgaaaagcaatccaatttcagtattttctaatggaaaactgcagtgcttgtcacttaatgtccctaatgccttagatagctaaagtaagggccctgactgacatggagcagctaaaacgttttgtgttccttatttactcaaacactccatctgcctgcatcctagttagtgccaagggaactgaaatttaaggctgttgttaggaggaagcacttgcaattgtatcatcaaatccttaatagctctgaatggttctcgtaattcagtataaacttctattttccttgaccttctaggggaaagttcaatgttcaaaaactgacaatggtttttactgcactgctgaaaaatataccaaaaactttaaaaaggaacagttgtaacaagtcccaattttttttgctaatttttgttattattgctgcttgtttattctttcaaataggccaaaataaaaaataacccaaatttccaaaatatctggtaataaacttgtggcaactactagcacttttcctatatttaaatgtaatcgacatcggtcaggcgcggtggctcatgcctgtaatcccagcactttgagaggccgaggtgggcagattgcttgaggccaggagttggagaccagcctggtcaacatggtgaaaccctgtctctactaaaaatacaaaaattagctgggtatattagtgcatgcctgtaatcccagctactcaggaggctgaggcacaagaattgcttgaacccaggaggcaaaggttgcagtgagccaagatcgtgccactgcactccagcctgggcgacagagcaagactccgtttcaaaaatgaatgaacgaatgaacgaatttaaccaaaatggagagtcacagtctgatacggaaactgaggtggaagaaatattagaatgttggtagcagactgtatgtattggtccaaaggtaataaagaattaaagatatatagccactaacctagaaacaataagaaagtttgacaatatcaagtgcattgatggtcagatcaacttctttggaaaacagtttggcattatctagcaaagttgaagatatgcatagattatgaccgaataattccatgcctaggttataccctagagatactcctggatatctgtaacagaaactctgtataaagagtgttcacagaattgttcagaataactcccaactggaaacaacatcatgtctatccgtagcagaatgcagaaatacactgagatatatttatatattcatataacggaacaaagcaaattagagccacatgcagcaacgtggaggagttgcacaaacctaatgctgaatactgagctacagaaacaagacacaggataataacatacaatctggtttcatgtatgtcaaattcaaaaatggataaaaaacatctagggatatatactgttatggagtgatatggtttggatctgtgtccctgtccaaatctcatgttcaattgtaatccccgatgctggaggtggggcctggtgggaggtgactggatcataggggaggtttctcgtggtttaacaccatcccccttggagctgttgcctcaatagtgagttatcataagacgtagttgtttaaaaagtgtgtggcactttccccctcctctcttccctcctcctgctctggccacatgaagacgcctgctccagctttgccttccactgtgattgtaagtttcctgaggcctccccacaagcagataccaccatgcttcctgtacagcctgcagaaccatgaaccaattaaacctcttttctttataaattactcagtctcaggtatttctttatagcagtgtgagaactaacacatggagtaaatgtgtcctctcaaaattcgtatgtggaaatcctaatccccagtataatggtatttggaggtggggcctttgggagtgattgggttataagggtagagccctcacgaatgggattaatgtccttataagagaacccctcttactctctttctgccatgtgaggacacaagaagatggctgtctgcaaacctggaagacagcccttaccaagaactggacaatgctggcatcctgatcttagacttctaacttccggaactgtgagaaataaatgtttgttgtttgagccacccagcctatggtactttgttatggcagcctgaattaagacatatacaaaggtggcaaaactataaagaaaagactcagaatagaggctccatttagagcgaggcagtgttcaccagaaagggacaccgtggggtttcaggggtgctgttgcatgctctatttcttgacatgagtgacaggtaaacatattcccactttaagttatacatttgttttatgcacttttctacatctactatatatatatatatcccagctcccccaaattaaagactgtaggagaatgttaacaactcaagtattgagcacctcctttaggttctgtgacttaatcacaaaggtcctagggtgcgctttgggcttcaaatgaaaaaaaacacacccacaccttaaatcctacaacttatggtcaggaaggtccttaaaggcaatcaaatctaaccaattccaagttgtacgttttcagtaataatctacaaaaatgggccaaatacagggatgaggccttttgggagatggtaagaaatctgagcccaggcctttgctttgcagtaaaacttttttcagagatctcgtgttttgtcttctctcttgttaaaaccaaatcacttcatgcacttctatttccttatctatgcaaggaggaaataaactaggtgactttttagttctagtttctatggttctatgaaagtataggaactttaggaaaatcctgaaacatgagcttttctaactgtggttcctgagaagactttttaaggaagctagagatgctcaaaagaacacaactggctggaagggaaaaatgccatcacataacttttgagagagatgaagaagaggggaagacccatccaataacagtgtgaactttcccccttataaacagagtcaacccaaaggatgaatcaaaggtcaactttcacacattaatggaacacagtgcccatcagtactgagcaatagttcggcattctctttccatggccaaaacagtgctctggtgtgcaggtcagcgtctccctcaaaagccgtcttaggtatgtggctctggaattaagcggggtgtccatcctctcctcttgtctccacccagcgatgtcagatgagactaccccgtttagcgggccagagagaaggctacaactgggatttaacaatagcatggtgcataaactgtcatctcaaaaaggagatgaaatcagcgggtgaaagggagcccatgtcaggccatccaaggggcatgattactgttagtggtggttggtggtggtggggcagtgggtgtgtggaccagggagaaaatgtgcaatttagccatgggcagatttggatatgcagctttgtgatcatcgcactggtcttttttatatgttgatgcttgcttttgcttcttttgtgtaaccccccagttaagagtaaagccaaagcctccatctattcttctgggataggtcattttctactcttggcaagccttcttttctatattgtcacttccagtttgtctctggtattacttctttgtgtctatgttctccatttatattcacttctcatacattaatctctgcttcctattagcatgtgcttcatgcctattaggagttagaggacagagaaaagtcatttcttttctgcatttctctttatcagggcatctgtgtgaaatattctctcccagtgtccccttccctccccttgtagccagagaaatattaccctagagcttcacgctgctaatgtgagaagaaattgtgaacagtgattaggaggctaaatgagggtggtggaacctatttacttcattaaagttccttcagggaaaatacgaggatgggaaactgagagataagggttaatactaaaagaataacagatccatttgactcagagcaatcttcagtctgcctggattctatcagacacccttctccatggggaaatcattacagagaaatgacatgcaaagtgcgccataaagcatctgagtcaaaccagagggaggatgactcaacggatcattttacattttaatagaaggcactgcagatttgtacctagtgcacagttcaacacagggctcataactcctccccaaaacttcttcatcgggtgggaggggagttcccagaacctgacagaaattattctgtcttagaaaaaaaccaagtcaaaactcacaacagagaatcaagactaagaaaagacaacagatagtcaaatgccgaaaagaggggagactgcaagtctaatttcaactttagcatttctgtcaaacctaagacacagcctgaaaattgagctcagtaattagtggacttcagatgtcataaaggagtggggaagatggaaggaggaatggagggagagagaggaaagaggagaacgctatcaaagtgctataattaaataattgtgtttcttaaattagttttgcaagattttccaatgataattactgtcagaagtttgcccaccaggtcagtgacaatgctgggcttgagtttccatgtgaagtcaagaagcaatatattagtcatgccattgttcctagtatgtttcccaggccaggtattgcttatagatgctaatatgtataacctgccaaagttagattcatctgaccagggattatgatgttaagagactggattgtcaaacctaactccttcttggaatgggggtgggggttacctccagacacacttttgtctgcctatacataaagaatatctatagtttcacagctgttcatccgcctgatctctactgttgcctgccccagctcctaagagggcacgcggtttacaggtaggaaaggaaacagaagtgaatactgaggcttggcagaaatacagctttcacagaaaagattcttaataaaaggaaacttgctcctttcatgcatgggggtcttttggacaaaatgattctgttctgaaacatcatctctgcagggatgcaggctagaacgaatgaagtttagattgcaagttggttcacccggtaactaagaaaatcgaaattcaagaccaaaggcaggcagcatctaatggggtgaaagtcatctagcttgagggtcattcaggtagtgttttgagaaaggtttgatttccactggagcctaggcacacctgaaacccactcctgtttttccatttaaaaatgatgaaaaccatgaggctaagaccactggttggcagtctgttaagtcccatatcaagtaacaaaagcatctggaccacctgtcaccaagcaggaggtcaaatggaactggaatgttaacacgcaggtcaaatgcccttcagagaacacggggaaaaggcagtgaaaaggaatgggagaaaaagaatgtgcttggagctttccaagtccctgtcctgtccttggcagcttctcagaatgacgattattgtgaccaaaaggtagtgacacacatgctacatgacacttagtatactgtttaagatacagacggtcttatatgcctataccactgccactcacacacgatttcacctcacagaatatgcttcagataaagccaagtatattaaggaagagatttttttttaattcactcattataaaaagtcagaattgtactgccatgggggcagacaataccccctctccaaacggtaaggaatgggtgccacaagggctcattggccaggtggtaccggagagacacagtgtttcgcactttcttgactctaaaatgcacctattttccatttctccttccatccttagatagaggggctccatttgaatccctgctctcctgcttcctagctgcatggctttggctttggggccattgttagactgtgtaatccttggtctttctatgtacaaaatacttatgtgaggattaaacgagatgaagcaataaagtatttaggatggtccttgttttacagtaaacacaaataaaagctattcttatgaaaagaaagttaatttctttgcacattatatacacttgtaattctacatatgctgaaaatttcttatattgaggcaaatctggactgcatgaagaataatgtatatttttgtttgccagattctcttgcttaaacctggggaagggccaatttgcttaatttccatccaagacctgcaagagaatgatgggataggtgtgcattctggtacttgctggcaacttcggccatgacactatgtagacttccttctgcaacatcccttgatgactgtgaaggtcaaataaggcaacagatctgagacctccctgagaagtgcagagtactctgctcgcatcaggaattatcctcaccactatttgactaatcctacacataattatataaagaatgtctgctcttatgggcacttagccctgatatagttcactctcatgccaaaagaaggcatctggcagatgggggacttgtattgattctcatctgataacatttcctaaaagattccattccttcagatttgttaaaagtgcgtgctttggatactctatcctcccattacgggcttttcctattttctctctctgctaccttttgcatgtatgttctgcccaaatcagaatcctctttcatcatgaggggcaggatcctgcagtggtgacaggtcaggctctggggccagcctgcctgcatctgaaccatgaccacaatgctacctcagacaaaccacgtgagctctctgtaaagatttctcatctgtaatccagtggtcacaaggcgtaagcaacttaaaacacaaacgtgggaaacagaatgactcctggagaatagtaagcacccattagatactgcatacaaagatggtctacagaggcaaggtagtgcagtggttgtggatggaggctctggtgccagcctacctggctttgaattctgactctgtcattcactagctgcaaaaccttgcacaagacacttaacttttccgtgcctcagtttcctgatctgtactaaaagtacctgataaagggcacctatctcatagaactgtgaggattaaaatattttacgtgtttgtttgttcattaattcaccaatttaacatatagtaactggtccatcaaattagctcctcttttccaaccatgccaattttccccattcacgtttcatttccagtttgacaatggcttgccttttcttcacgtaagtatttcctgcttttggccctgcccacctaacacccagactctcccggcctgcttcctatctctggaaataacaatagttctctaactgcatagatttagggtaaccacagcaggttcagcgatctgcattttaaccccatgacagctgatttcaaacaaccctacaaactaagactccccgccctgccattccaagaacgaggggacttgggcaatttatttaagtccttagagtctccttatgtgtgaaatgaagataaagactgtctcccgagagactgttaggagatgtaaatgtgatggctcaatccctggcctcctcaggtctctgtgcagacatcacattctcagtgaggcctccctaaccaccctgctccgtttaaaccacaaccccagcctcccacctcactctccatcctccctccctgtttatgtttctttataacgttttcacatctcacacacactatattttactcatattttgttaatgacctatttttctattgagggcaggaatttttacctgttttgctcaccattgaagccgcagaacttcaaagtgctacactcaatacatacttaataagaaagtgactaaaaaagacttttcctaatcccaacaggtccatatgtcacttctgtttctgctgaggtctccttccagcctgtttcttcacacatatccctacgctctccagagctgcttgtcttttctgggcctcaaggtcgccttgcctatccatttatccacagaaaacttactccattctaagcaatgcgaccgttagagaaaactaatgatataacctccaagacacacagccaagataatgggatggtacaaaagcaaaagaaaggcttagattgacacagtgaaggaaaagctcccatttgcagagatgctgagtagaaggtcttgagtgtgctttatttctgaagctctctgtgctcaaatactcacaaatccagaaacacattgcccattggctctatacaatgtggatccttgcagagtagaattaggctgttctctcctggtaaaagcttgtgtgctcttgcttctaagagatggctctgatcccacccccttatgtccacggcctatctcaaactgccaaacagaggaccaattatgcccttcctttccgcagccctcaggaaaacagccagcacacaggaccctcaatggcaccctcaggatgatgctttcagaatgtgacagcgaccacagcccaggcctctgctgccctgggagtagacgtggctctggaaggcctgggtttgagagaagatggtaggaggaaggtttctgattttcgaatgaaaatcagaccagcagggttttttgaaaagatcaacaacattgatagaccgctagcaagactaatcaagaagaaaagagagaagaatcaaatagacgcaataaaaaatgacaaaggggatatcaccaccgatgccacagaaatacaaactaccatcagagaatacgataaacacctctacgcaaataaactagaaaatctagaagaaatggataaattccttgacacatacaccctcccaagactaaaccaggaacaagttgaatctctgaatagaccaataacaggttctgaaattgaggcaataattaatagcttaccaaccaaaaaaagtccaggaccagatggattcacagccgaattctaccagaggtacaaggaggggctggtaccattccttctgaaactattccaatcaatagaaaaagagggaatcctccctgactcattttatgaggccagcatcatcctgataccaaagcctggcagagacacaacaaaaaaagagaattttagaccaatatccttgatgaacattgatgcaaaaatcctcaagaaaatactggcaaaacaaatccagcagcacatcaaaaagcttatccaccatgatcaagtgggcttcatccctgggatgcaaggctggttcaacatacgcaaatcaataaacataatccaacatataaacagaaccaatgacaaaaaccacatgattatctcaatagatgcagaaaaggcctttgacaaaattcaacaaccttcatgctaaaaattctcaataaattaggtattgatgggacatatctcaaaataataagagctatctatgacaaacccacagccaatatcatactgaatgggcaaaaactggaagcattccctttgaaaattggcacaagacagggatgccctctctcaccactcctattcaacatagtgttggaagttctggccagggcaaccaggcaggagaaggaaataaagggtattcaattaggaaaagaggaagtcaaattgtccctctttgcagatgacatgattgtatatctagaaaaccccatcttctcagcccaaaatctccttaagctgataggcaacttcagcaaagtctcaggatacaaaatcaatgtgcaaaaatcatgagcattcttatacaccaataacagacaaacagagagccaaatcatgagtgaactcccattcacaattgcttcaaagagaataaaatacttaggaatccaacatacaagggatgtgaaggacctcttcaaggagaactacaagccactgctcaatgaaataaaagaggatataaacaaatggaagaacattccatgctcatgggtaggaagaatcaatatcatgaaaatggccatactgcccaaagtaatttatagattcagtgccatccccatcaagctaccaatgactttcttcacagaattggaaaaaactactttaaagttcatacggaaacaaaaaaagagcccgcattgccaagtcaatcctaagccaaaagaacaaagctggaggcatcatgctacctgacttcaaactatactacaaggctacagtaaccaaaacagcatggtactggtaccaagacagacatatagaccaatggaacagaacagagtcctcagaaataatgccgcatatctacaaccatctgatctttgacaaacctgacaaaaacaagcaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctaaaagaaaacctaggcaataccattcaggacataggcatgggcaagtacttcatgtctaaaacaccaaaagcaatggcaacaaaagccaaaattgacaaacgggatctaattaaactaaagagcttctgcacagcaaaagaaactaccatcagagtgaacaggcaacctacagaattggaggaaatttttgtaatctactcatctgacaaaaggctaatatccagaatctataatgaactccaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacattggttagaatggccatcattaaaaagtcaggaaacaacaggtgctggagaggatgtggagaaacaggaacacttttacactgttggtgggactgtaaactagttcaatcattgtggaagtcagtgtggcgattcctcagggatccagaactagaaatactatttgacccagcaattccattactgggtatatacccgaaggattataaatcatgctgctattaagacacatgcacatgtatgtttattggggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctcagcaaactatcgcaaggacaaaaaaccaaacgctgcatgttctcactcataggtgcgaattgaacaatgagaacatatggacacaggaaggggaacatcacacactggggcctgttttggggaggagggaggggggaggaatagcattttgagatatacctaatgttaaatgacgtgttactggatgcagcacaccaacatggcacatgtatacatatgtaactaacctgcacgttgtgcacatgtaccctgaaacttaaataaaaaaaaaaaaaaaaaaagaaaatcagaccagcaggaaggccacagagcaacttttcctcacgcacaggaatgtgctttagttctactcacagtggtctgatgacaaagtcctctttaataacttataatttggaattgtaagacattggacccaacacaaccaatgtaaaaacaaaccactcatgatcttcctgggaaaatggaggtgcatttatataggaacagtcttctgtggatggttttctgagcagcttagcaaagaattgattaaataacagcatatgcgttgttaaattccctattacaatgctttcaaaattctttgaaagaaaaagatgctcacctgttaaaaaaaaacgtaagtttctaaaggagacacttgaaaaccagaaaggagcatcaccttcttaaaaaaaaatcaaaatggcacagcagaagttcacataaaatgcccgacaatgtttcttttcaatagaactcaagctgactaaaagacatgcttggattcagagcttttactggttacctaggttgcaaatgataccaaaagagacactaggaattcttagttagaatgccagtcaaggaaaagttcataatcctttcagattttaaatcctgtgtgtctgtgaggaggataaccatttagtattttagacaactggaaaagaagattagaccacactgtgtctataaagttgtgctacaccctgggttaccctcatcaaaggctgaaggaaatggctgttattctctttttgaaactgtagttatatggtgactgctggttatttagttagaatggaaaactgatacacagagaagcataccaaccgtatctaatgtattagcctgatattaacaactagcatctgattacttacaattgaccgtatttgaaatctattaaaatctcttaattattcttatatgcccatagtcactgctttctcttaaggcaacatgaaatgcttaatgattaatataacaatttcaaaagctttattgtacagactggactagactctgtagtcttcacagagtgatcattacttaatgaactcagcacactgtacattttccagccacctgaaactcccaagtattgtgtgagtttttggccaattaattatcaattacaacatcataaaacattagcacaaaaataggaataatgaaatttaattatacattattcttctgagttgctgaaaataatatacaagactgattctgattaataattcattcagcaataaagtatcaggaaagataattatgcagtgccacaattctcacactgatttctataattacagattacaacagtgttagcaatttaaaaggttagagagctgtggtaatttgctatgtcatcctcagctatattaatgtctctctttgagcaccaaagataactgaaaatataataatggaccaaatcagatggcttgcccatgctctcctcacctaaaacatctccaatctgagaacattagtaaagtccttgataattagcctcttatattatttaactagtcctactacacacatttggtttacagctaatcaaagaaagacaatatgtaggaatacatgccaaaatatgcaaacatagaaacataacctatagaaaagttacagggatacaatcacatttggtatgtgacatatctgaccatgaatacacatatatgtatacctgtataattaccccttagataattaaacaccaagtcaagggacacacataatgtaaatctctgtctctggcaacacagttgagtaaatagcacatgaaaaaatacaaagtttatctaactaccctctctgggttgttaacatattatgacacaccaaactactcttgcctttaagttctattacatcctgagaatgaaaatacactcagctgctagaaatactcactctgctctgcttgcattccatgggaaaaaacctagctagaaatttatggcctcttcccataaccagtatttaaatgagaattttcacctggggatgagcccaagtgaactaaacatacagttccacagatataaaaatcactttctcctctgctctttcttctcgctatttttagagaggagatttgtaagacatcttggctttactctcttgaatgccttaagtatctgactaacttcatgttcaactaatatggagaaacagatggaaaattcaccgggactaaaatcttaggcattatttaaatgagttccttgcagagtcttttgtgtgtcttgttgggaccgggggttcctcattctggagtatgccagggtttgaattcaagatttcattacagctggccccaacaagatgataaaggaagacagggtgaaaaaacagtttcatttcagtggtagaaagaacttgtagatcatctgattgaatatgctcttttaaaaattatagacgtttaggctcaaagatattaaacaatttactcaaggtcgcagaaccatttagtaacaataacagaagaaaaactcaagcatgtctgaatcccaggtttccactatattttattaaagaaaatacccaaggagaaggggcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctcatcagctttttttttctgggctacatgcaggcagttggcacaagatcatatggtaggacaccacactagatataaattcccttcaccttttttcacctacttccttttattcccagcagggcagtaaaacaggctccctgcatatccctgcaaatttgctcttggattcagaagtagacccctagcaggtgatattgttcccttgttaaagtagcagacattcaagcttgtaacaggggataaaaatggcaagtggactttggtcccacatttgcaaggtcctgtatcattttgtactttgaattttttctaacatattatgaacaatttcaaatttacagaaacatttaaagaattttacagtgaacacctacatacccatcacttagattccacgattaacattttattatgcttatttcattacacatccatccatctatatccatcagatttttttcaaagcatatcaaagtaaactgcagaaatcagcacactttcccctaaacatttcagcaggatattacttgctagagtttaagattagtttatagtttttttcttttgaggcaaaatttacatacaatgaaatgtacaaatcttaagtgtgtattcattgagttttgacaaatacatatacccatgtaaaccaaatcttatcaatctatagactataaccatcaccccagaaagatcccttatactccatcccagtcattcccctcctccaaaggcaatcagtgctccagtttgtctaacagactaattgtctgccctaaaacagttgaattttgaaactttaagtagctaagtgttctgtttttcttctttcagtcaacacaaactgagcacctaaaacgagacacacacttaaagccagtaacaacaaaataattattccattaaattaggaaaataccttccatggtggtgagaaccatgggattcattatacttcaagggcaatttagatgcacaaccaaaagggaagacacataccacaccctgcggctgttactcatttggaaacttgctgactcttcaatagtaaattaaaatccatacccatgcccagtgaaaaatggggctatgcaggatccttggattaagtgtgaaaaatgaggaggctttttaaaaaagcccatcttcaaaccaatatcatcgctttatgatgaagatgaactgttataacatgccaagcctgtaacctacaaagacacagccccgagttttacacaactataaaatcatgaaggaggctagtaaaggagccaaaaggctcttcatttattttctttaaacttaactacagtagtcagtgtggattaggccctcattttccagcagctgaattattgtcaaggtgctaacactcttggtggaaacagcattggattacctacctctttctgcaagagctcaacagcacgcttcacatatcagtcactaaaactgcattaaaaggctctcctacagcaactctgatactcttttaaaagttcattaacccctgttgtggattgaatcacaatattctccctccctccaaaagaaatgttgaagccctaacctcctgtagctcagaatgtggccttatttggaaataatatcattgcagatgtaattagttaagatggggtcatactggagtagggtaggcctctcatccaatatcatgggtgtccttttaaaatgaactccatatggagacagagacacagggagaacaacaccatgtgaagatggaggcagaggtgagagtgatgtggctacaagccaaggaatgccaaagatgaatggtcagcaccagaagctaggaagaaggaaggaagagttcttccctataggtttcagagggagcatgaccctgccaacatcctgattttggacttctaacctctagaactgtgaggcaatacatttctgttgtaaggcatccagtttgtggtactttgttatggaagccttaggaaactagaacaaccttaaagaagattttcccctttttggtaattgttttaaacaaaagtgtaatttacatgcagaaaagtataccaaccataagggcacaatcaatgattttctttcaagtagacgcattcatgtaaccaccacccaaatgaagactattatcagcaccccagaattctccttcatgccccatcccagttgttatttccaccaacagaactgctaattctaacttccttcaccttagttttctctttttgaactttaaagaaataatatataattttttgtgtgtctggcttcttgtgctcaacattatgtttgtgaggttcatccatgttgttgtgtataagagtggtttcttctaaagatggtttgaaaaatatcattaagtttttcttttgttttgctttggttggttcaaatttcctaaaatgaataaaatggtaaatactgaaattctccaaaaatctcccaatcccagcttcccagccatccagttccattttctagaggccacgagtgtctcttgtgtatccttccagagagaactgatgcctatttaagcaaagatatatatatttatagatagatctttgtccttttttttacacagaagtttacatatggcccgggcatggtggctcacacttgtaatcccagcactttgggaggctgaggtgggtggatcatgaggtcaggagttcaagaccagcctggccgacatggtgaaaccctgtctctctactaaaaatacaaaaaattagctgggtgtggtggtggacacttgtaatcccagctactcaggaggctgaggcaagagaatcacttgaacccaggagggagaggttgcagtgagctgagattgcaccactgcaccccagcctgggaaacaagagtgaaactccgtctccaaaaaaaaaaaaaaaagtttacatactaagccatgatctgcaccctgctttcacttaaaaatatagtttcttcattcttgttttatggtttcataatacttgactagaaggtcatagtacaatttatataaccaattctctattggcagctatccgggttgtagtcagtatgtgttattataaacaaggttgtaacgtgtaatcttgtaattttgtacacatatccatacattctcctaaatgtgaaattactggatcaaaggatataaactttgtagttttgatactgccaaattgtcctccattgggacagtaccaatttatactcctgccagcaatgtacaagagtacttttttttttgagatggagtctcactgtgtcgcccaggctggaatgcagaggcgcgatcttggctcagtgcaatgtccgcgtcccaggttcaagcgattctccagcctcagcctcctgagtagtcgggaccacaggtgcgtgctaccacggccggctaattttttgtattttcagtagagacggggtttcatcgtgttagccaggatggtctctatctcctgacctcgtgatctgctcgcctcggcctcccaaaatgctgggattacaggcataagccactgcgcctggccaagagtacttctttatccatagtcttgctaatagattatattaccaaacttaaaaacaaaacaaaacaaaaaacccctgcctgtttggcaagtaaaaaacagcgtttaattatagttttaatttgcattaatttttaataaatgacactgatatatttcatgtttatgaacagctatttatatttccacatctgtaaattgttaatagtcttactattcttttaatttttttcccctattgcattgttggtctttttctgccttggagaagctctttaaatattagggaaatcagttctatctctagatgagttgcaaaaatatttttccttctttgtcacttttttttttttttggccgtggtttatggtggtatttgctgctcagaaatttttgatttttgtgtcattgaattcattttatgactttccctttgtggtttctggatttttgtcatactttgaaaggccttcccaacttataaacaattttctcctgaatccttttagaacttttacggttaaatttttttcccaagtaagttttggaaccatttaggatttatcttggtgtaaatatgaaccaccaaactttctttttcccagaaggctatttaattgtcccagcaccatttattgaacatccttttttatcacactgatttgagatgcttccttaatgtaaactaaaatttcaaatgtatttgagattatttctggactctataaggtgccactgacttgcccattaatgccaattcaaatatatgagtacgtttgtagtatattttaatatctaaagagcaattttctctctttttattcttggctatttttgattttttttttttacatgaacttcagcatcagcttgtttggttacaaaatattctgttggtatttttactgcattcacattaaatttgtgatgttgaggttttctgtccaaggacatggattgtctttccatttattcacatctttgttttttctcttcatctcaggaggattttaaaacagtttcatttatttacaagaataaagatttacatcttaaggagttcttgagttcaattcctatatttatacacattacatatatatatatacacatgtgtatatattttatttgaacttttcttttttgctattgtaaataggatattaacttccattatatcttctaatcagctgttgatcacatatatgaagaatgtttagttttacataatccattagtacataatgggttgttattgttaccaccatcttccagctgattcacagaagaaagcatactatccaagtgtgcaatcatatcatctgcaaataacaaacattagtttaacctcgtccttttgactttttacacttctactttctttctcttgtactgcacaggctaagtacgttcagaacaatgttaaagaaataacaatgggcgcccttgtcttcattgtttctgacatggcttctggtgtttccctattactgggtatattcctttgggcatacacccagtaatgggactgctgggccaaatggtagctaatttgactctgcaatcccataaacactacatctactaaagcgtgatgctaattttataataaataatatatataataataattttatgttaaggaggtatccatcacttctgattttataaagtggtttttaatgaaaatagatgttgaattacatcaatgcctttgcagcatctatgaacatgatcaaataagtgttccttaaagatctattaatatgataaattatattaaaagatttttccaatatttatcactcctggaatgaacctcatttggttatggtacactgttctttcaaaatggtgctaggctctgtttgctaatattttatttagaattttacaattgtgttcttctatggtggttggtctgatggattatcctgctctttagaagtcagtgactaaattatattttcttagacaattatggatttttaaatttatctgtaaaaagttgagtaaaacaggctttatgattcctttgtaatcttttatttaccttatttttattatttcctctattttattaatcaagtcagctaaagtttccttgattgtgttgaggttttcaaacaacatgcttttgcatttattaattcttcaatttttcagtttttgaattcaggattttttgatatacttttatttccttcctgctatattttaagtttgttttattattcttttctaacgttttgagttagacacttaattcatttatttctatttttcttatttgccaaaataaatattttaggccacggcttctcttctgaccactgctttaagctgcagctcctggattctgctaaaaacacactgacacactgacacagatacttacctaaacattgcatataaataaactatgggaaactgatcatttaaaaagatgttagaaaagaccactaaaggaacccagcagtaagtctgttgtagggtgaagaataattctttttatttttatttttttgagacagggtcttgctctgtcacccaggctggagtgcagtggcgcaatcatgggtcactgcaacctccgccttttgggctcaagcagttctccctcctcagcttcccgaatagctgggactatgggtacgggacactgcactcagctagttttttgtattttttttttttggtagagacagggtttggccatgttgcccaggctggtattgactgaactcctgggctcatccactcacctcggcctcccaaagtgctggaattacaggcacgaccactgtgcccagccaagaataatccttttgctgccattcatggtgtattgaccaggtgcaccaggcacagtgtgggctactgtgagaataaacatgaaggggtctctgtctttccatcagtaaggaaaccacacatgagcacataaaaacacatactcacatatacaatatcacagaaacataaggacaagtcatacaaaccataaagagatacaaactttcacataaaataatttcccttcttctgctcaaaacatacatacctataatctttaataggcattcatttaatttatactgacctaagttgctcttccaacttaaaagcagttcacaataacaatatttgtttttgcatagaatatgggtcagaagagatgtagaaaggcttgttgggtagctcttgtaacagtctaggtgagtgatgatgatggcttggactagtgaggaagcataagagtggcaaccacggcctgatttggcatgaatttcaaaggtacagagaggtacagttgataggatttgctaatggactggatgtggggtgagagagaatgaaaagagttaagggtaactttgagaatttcagcttctgcaattacatgaatgagggtgtcatttactgtaagggaaaactccaggggaggatcatgtttgggggctggggttgaaataaattgttgcttcctggtagttcatctatccaagctcactgttatggtttgaatgtgtcccccaaaagttcatgtgttggcaacttaatccttgcgacagcagtgttgagaggtgggacctttaggaggtgattgggtcatgagggttctgtcttcattaatggattaatgagggagtgagtctgttataacaggagtgggtctttataaaagccattttggccatgtctcataacctccctcaccatgtgatgccagcctccagaactggaagaaaataccttacctttccttttcctcttccccctttcctttcctttcttcccttcctctctccctccctcccttcctccctcccttcctctctctcctccctcactccctttctttcttttcaaattactcagtttcagatattaacttacagcaacagaaaacaaactaagacactcatctcattcacctctcccataagttggttatattcaagtgtcactgacctttgtcctatcacagctccatgctgttgcatgttccgtttccacccaaagtgtcctgcctactcttctctgtctggcaaacacctgctcatccttcaagaataatctcaaatgtcagctcctttggttacctttctgactcctgcaggcacagttgggagattcatgctggagctttccagcctcccagccatctcagtctcacaaaattgcttatgtgtctgtctctgtcacctggttaagttccccaaggacagaagtcatgcttttttcttcttttttccctggagcacaatgcctgaaacaaagatggctactcaataagtgttttcattcattccatcaatattgatggagtgtctaccatgtataacacatgatgccatgtactgttctaggtacctgaggatatagcaatgaacaaagcaaagttgtgcttgtcatggagccttcattccattggagaaaagggcaatatacacacaaacgaatgaatctacaataatgtgctgtagaggaaaaaaataaggcagggcaagagcagtgaaggatgtgggcggtgaggtcctgttttaaatactgcagtcgtggaagatctcatttaggcagattctaaatgaagtgagggagtaaaccatgcagatatctgggaaaagagccttcctggcagaaataaacagctggttcaatggccctacagcaggagtaggcttgatgctctgatgactcaaaaggccagagtgcatggaggatagtggccagcgaaagctgcagaggtagtcaggaagtgaagggcatgcagttcgaggtaggagtttgggttttactctaagtgttatgagaagccagagtaggcaagtgataggatctgatttacactttaaaagattcctttggcttccatatggaaaatgggttgctgtagggtcagactggaagcaagaaagcatgttaggaggctcctgcagcagtcctggtaagcatgatgatggactgaactatggaaggagcagaaaagtggtgacaaagtgcctggatttgacaggtggagctgacgggatttgctagtggattggatgtggggtgagagaacggaaagagttaacgatggcaccaaggatttcagcttaagtgaccagatgaatgggggtgtcatttattgaaagaggaaaccccagaggaggatcaggtatgggggatgagggcagaacaagtgttggttttggatatgacaactttgaggagttgattagacagccctgtggaggtaagcaactgaacacagcctgattctagagagataaatttgggagccattagtatgcagatggtatttaaaagccacaagactggatgagatcaccagggagtaagcttatgtgggctgaatgaatgaataagcaagtttatgctcaggaaggaaactgttatcaggttgataacatctgactctacagagactggacaaatagataataaacacagggatgaaagggcacagaattaatttttttccatgtctagatggctaatccagacttttcccttacatgcgcagaaaagcctgcatcctaaattattgaggacaaagcagaccgcatgactctgtggagcagtttccactgcttggcttgtgtgcaaggtgtgtcagcctacttcaggcgtcttggtaactaagcacttttctgggtgagcatcttatcacagcatgttgtgcaggctggaacccatgagagtgagtccttcaggaaagaaacgacatcaacagatgtacacaacacgtttcaaattaataaaggtggggggaagatcacaaatacaacatctgtaacactgtacgtgcaacttgtcatctctattgaagaaacaggcaggtaagcttccacaactaagataaaataatctttgccgtaagtccgagataagttgcattgaatttggggtagttaagctgtatttctcaaaagtcaaaaccaagtcagtgggttcaccaaattcttttggttacttcaaatatcatattaccaataccaaaaacttctcaggcccacaggactctcatcccatgtaaaaacactaaaaggatggtgatgcaagaggtatcccactgtgaaaaattccttttgcatactttctaaaattaatatttctttccaagtacacagggttttgtctgccacttattttgctttttaatcatgaggcactaaaagttggcacatttttaaaggtgccagcttccatggacttttaaaatttccattcattcccatagtcttacaggcttctctcccctaaaaaccatgaggactctgttcatatctgctcccctgctccactatgatcaaagatattcctctgtatctctgtgtaatactcaaaacaggaaataaagaccccaaaatgaagcctcagtatctcatgtcttccccagtgtcccatccacgtctgaaagagtgaaagctctgttttagaatgactgctggctgccaatgagagctctggatacgttgacatggatgaacgaaaacacactcaaaaaagagcaaaattgtgtggaaacttggaaacatggaaagattcagtcatttaagcatctaagaaacatttagtatgtgtctaccacatgccagccactttgctaagtgctgggtcacaaacacaagcctctggagctcataatatagtggctaacgagacaaatgccatcaaggacagatgagactcttcccagcaatggcaatgcctaaactgaattctgaaggacaaaacagaaattatctaagggaaggcacagagggagaatcagttaatatttgtggatccctaactgcattctcccttgtaagcctggtactaggtatacaaagatgaatatggtacacctcctccccaaaagaagacaaaagacatagtagctattttgaaatttcaaaggagctagccagaagcagcatccgatttttctgggtgaacctgtgggtgatatcaatatggaaggtactaaggcaggagcacactggagagttgattccatgggctctttcagatgttttttccacagacctatagagacgcttttgtaaacaagttcaagtttacgagcattcaaaaatgaatgcatcagagctactagaatttggtgacttttttttttttaacactgtaattacaagaataaagggaaggatgaagctaaaccatattcttatgcccaagcaactcattaacagaggccaagcccaggccaattgcccatgtaatttctttctttctttctttctttttttgagacagagattcactactgtcacccaggctggagtgcaatggcatgatcttggctcactgcaacctctgcctccgggttcaagcgattctcctgcctcagcctcctgagtagctgggattacaggcatctgccattacgcaggctaatttttgtatttttaggggtttcaccatgttggccaggctggtctcgaactcctgacttcaggtgatctgcccgccttggcctcccaaagtgctgggattacaggcgtgagccactgtgcctgtcctgcccatgttatttctacaaacctttatcctcttggtgctttcaggaagttatcagggatggggggcagaggtggcaggggcctataatgtaactgttctgtgctgtacagccaggttcctttccggttgctggtgagaatccaatgtcagctagagttatactggcacgtccatggtcctggaaaggccttggaaaggctgaggcaggcaaatgcttctccacagatgccctaccccacctcgttcattctcttggatgtcagtgctcttctgctaacagaacctatacttcatgccccatttccccgaatcacttctttcctctactcatacagtatccttgatgaagctgagcaccttcgagtgtccgcagtttttgaaagccgtggctgtcttataataacccatcctgacgttcctaggagtatttatattctgagggtgagttaagttagtggataattgtggtaaagaaaggccttgtcagtgcctcctgtagagtcacaccatcaaaccctggggtatgctggggcctgagttctctccagcaaaccccaaaaccagaacttgggttggcactccactttattttccaagttatggatctcagggctggcaaacacaatcctagacaattgattctcaaaggtctcaaatcatctggtgtctaaagggctaatctaggggctcccctgaaagtctcttggtaaatctctccttaaagatttcaaataaaacctgaagcaaacagagcacctgtctagatgataagaggcctgattcatattccattctattgctgacttgtgacacctagaaattcagtcgtagcttttctgtggcatattctatgaagtgagggtataataaccgagattagtttcaggtctaggtctttctattttttttttatttatatatttagagacaggttctcactctgttgcacagactggtgtgcagtggtgtgatcatagctcactgcagccttgaattcctgggctcaaggaatcctcttgcctcagccacctgagttgctagaactacaggtgtgcataaccatgtgcagctaatttttgtgtttttcgtagagacagggtctcactatattgcccaggctggtcttgaactcctggcctcaagcaatcctcctgccttggtatcccttgggcctaagccttcatgctgccatggcatgtcatcagacatggtatttcacgcttgtttcaaccaggaaccagggcaaaggaaaggtctttggtgtcaatgcaatacaaaactttatgttaatttgccattgtggcagttcctaggaaagatcctaagaacttctgggcaaaaggctgaagaaatataatggtttcttgggaattgagggttgaggtaaacatttctaaaatgtgcaaaaaagttaattttgaaaatctgctgctcatttgttataacttcagagtttcaattttaattattttaaaaattccctctaacaagcacactttctgaatgactactgcctcatcatttggcagccaactcttgaaaccttggcactctgagcaataattatgagtatgtcttaatgtgtatccattgagttactgcttgcctgggaagaagctgaaggatgtaagttaaatttttggctctaacactcactagctctttagatttgtaacagctcttgttgaccttcagatactttttctgtaaaaaggggtaaacagaacccaacttgcagggttctagtgaggattgtgttaatgtaagcaaaatggggaactcaaaagttccttttgttgttatacagagaatccagagtaagcaaaaaatagctagttgcagctatgaggccatctgatgagaaatgatgaaaaaccaactccatatgcaccatctcaatctgatccaatcattccataaacttttattgagtgctcagatgccaagttattattttaagttttgtagacagttactatattgaacaggacagacaaagtccctacattcttaggtcttatattctagctgggaaaaacagacaataaatgtatgtaagtaaacaataaactactaagtagtgataagtgttataaaaacaaaatagggtgctatgataggaagtcactgggtgactacggatgacagacctctctgaggtcatgacatttaaactgagatctcaatgacgcgaagaagagagccacaggagggtctctggcaatgaatctctgtgtggtctgtggaacccctgggaatcccgagaccctttcagaatgccagtgaagtcaattttattttcatggtcatactaagatgctgtatgtctttttcacagtgttgacatgagcactgctggtgcaaacgtaatggtgggtaaaactgctggcatctcagcatgaaacaaagcagtggcaccaaactatcagttcttcactaccatatactcaccatagaacagggtgacagtttcacttataaagggacttgatcaagcagtaaaaattattatttgtactaaatctcaacacataacattttaacactctgtgtgacaaaatgagatgtgctcataaagtacttttgctgcaaaccaaagtaagattgtcatcccaaggaaaagcatttgtgggattcagcggcaagctgcacaagtaactgttttcagagaacaccatttttacttgaaagaatgactgacaaactaaggttactcagacttgggcatttgggagacattttcttgaaattgaacaaggtgagtgagctgtcacttcaaggaaaacaactgacagtatttgttgccactgataaaatctaagctttcaaataaaaacgtgatttttggaaaatgtgtatttcctactgtaagcttggcagcttccccaaatttgagaggcttttctgttaagaatgataataacattaataggtgattttttttgaacattaaaatagtgtcatcattttgaagatctgtgtaagctgataaagcaacatgttccaatcatacaaaatcatacttggtaaaagatttgatgtgcaaggcagagtaatgaattttaatataatggagtttgaaaagttcattgatatggctttagattccatattgcaactaacttttaagaagttaccacttgtcaaattttaacgtaatatcgaagaagaacacccacaatatttgaaaaacctattaactctatccttgtccaaatacacatctgtgaggctgaattttttcatataatgaaacaaaaatgacatatcacaagattgaacactaaaagagatattagaatctaaatgtcttctagtatgctggacattaaaggtattggggaaaatacaaaacaatgcaattcttttcacttttatcttgaaaaatatagttttttcataaagatatgttattcatgttaacatgtagtgagcttattactgtgattttaaaattaactaatagatactttaaatgttcagttttaatttctaataaggtaaatatagataaaacccaaataaacgaaagctctttggggttctcggtaatttttttttttttgagatggaatcttgctctgtcgcccagcctggagtgcaatggcgcgatctcggttcactgcaacctccatctcctgggttcaagcgattctctcctgcttcagcctcccaagtagttgggattacaggtgcctactaccatgcccagctaatttttgtagttttagtagagatggggtttcaccatgttggccaggctggtcttgaactcctgacctcaggtgatccatccacctcagcctcccaaagtgctgggattacaggcttttacaggctggtaatttttaagagtataaagggattctgaaaccaaaattttgagaacaattgacctgagcatattaaacaatacaattttagtttatttaggtcttgcataagttctgttagatttgttctgaggtacttaaatttttgttattatcattaataactttttaaacattacttttctgtgttactggtatataaggcaattaatttttattgatatatattgtatattgatcttatatccagtcactgtgctaaactttctcactggacttactcttttacatcagtcttactgttagtacaggactggcaaattatgatcctgtagactagatacagtctaccatgtttttaaaacaacaatttataggaacagagctctatccacccatttacgtattatctatagctgcttttgcactacagtggcagagttgagtagtagtgagagagactatggcccacaaagtcaaaaatatttactatatgcctttttacaaaaaaagtttaccaaaccctgtattatgaactccattcacagaaccaacttttggctctgttgataccctacatagtatttacaatttcaatttaattaattctgttctcatctttattcatccttcctttctcattcgtctttttttttaccttctcaaagttagcttcttaattttcactttttccttttctagtaacaaacctgcacgttcagcacatgtatcccagaacttaaaataaaaaataaaaataagaaaaacacttgagactataaattttcctccaagtacaacttttactgtatcccacaagttgatatatcatattttcattatcattcaattctaagtattttaaattttccattattacatctttgatcaatgaattattttaaaatgttaaaaaatttccacatataaggggaattttggggagtttatgttttagttaccgaattctaattaaattgtattatgatcagataatgtggtcattatactgattcttggaaatctgttgagacttgttttaggggcatagtatgagggcaagttttgtaattcttccatatgaagaacacatatattctatttgtttgatgcaagattctatgaatcaaactattcagttgtactgcttcaatgttatatttctttactaattatttgttatgtgcttgaccaagcaatatcttggagaaacatgaaatttctctatagttttattagtttttgttttacatgttttgatgcaatatagaaatgttatacctttccagtgaattaaaaccttatcaataggtagtgctctctctatcctgatttttttttgccttaaagtcttttatctatctatctatctatttatttttgagacagggtctttctctgttacccaggctggagttcagtggcatgatcttggctcactgcaacctccgtctcctgggttcaagcgattctcatgcctcagcctcccgagcagttgggattacaggtgcaggccagcatgcctggctaatttttcatatttttagtagagacagggtttcgccatgttggccaggctggtcttgaactcctggcctcaagtgatctgcctgcctcagtctcccaaagtgctggggttacaggcatgagccaccacacccagcccttaaagtctattttgactgatatcaacaaagctacatagctcctttttgattggtatttgctcgaatacgaattgttaaatgtgtatttctctaaacactgtatagctgaattggtattatattttttaaaaaatcttaatgtttactctattttttagccagaaagtttaggcaatttacatatattgtgattgctgatatatctgcatttgtttttataatattattttctatttgtcctactttcctatgctttatgtattttttctttcttttttgatttttaaaaatcaggcttagaagttatacactagttcttttcttttagcagttacccttgaaatccaaagttagtagtttaaccccttcagaacaacaaaaggaacttataatgcaaactctgattatctccttcctcatatatagggagttttacacagtattttaaaccagcaatatttgtttagatttgcctacatgtttaccaatttctttgcttacaatttctatttttcagaccttttgctatctcttttcttctttctgaagtatacgctttttttttcttttatttagagacagggttgtactttgtcatccaagctggagtacagtggtgtgatcaaggctcactgcagtcttcaactcctgtgctctagtgattctcccgcctcagcctcctgagtagctaggactacaggtatacaccacccatttggctaatttatttatttatttttgtagagctagggtctcactgtattgtgcagactggtcttgaactggcctcaagcaatcttcctggcttgacctcccaaaatgctgggattacaggtgtgtgtcaccatacccagcctgaagtatattctttcaagttccttcagtgtaagtctgctggtggtaaactcccttaggttttgtacgtctgaagaaaatacttcactctcattttgaaggttatttttgctgaaaacacaattttaagtcgaaaatcattttctctcagaactttgaaaatatttcatcatctcctggatttagtcattgctgttgagaagtctgctgtcagtctaagtattgttcctctgtggatgtggtctgttttccctatggctccttttaagagagctgtcttcagtgattcacagttttactacggtataaaaagttgtgaaggcctttttatttgtctgtttagatacactgcttcctatatctctggatcagtatttctcattgaaaaattctggaatgccggtggggaggagccaagatggccgaataggaacagctccggtctacagctcccagcgtgagcgatgcagaagatgggtgatttctgcatttccaactgaggtaccgggttcatctcactggggagtgccagatagtaggtgcaggacagtgggtgcagcgcaccgtgcacgagccaaagcagggggaggcatcgcctcactcgggaagtgcaaggggtcagggaattcccttttgtagtcaaagaaagcggtgacagacggcacctggaaaatcaggtcacttccaccctaatactgcgcttttcaaatgggcttaaaaaatggcacaccaggagattatatcccgcacgtggctcagagggtcctacgcccatggagtctcactcaccgctagcacagcagtctgagatcaaactgcaaggcggcagcgaggctgggggaggggcgcccaccactgccaagttagttgtttgattaggtaaacaaagcggcagggaagctcgaactgggtggagcccaccacagctcaaggaggcctgcctgcctctgtaggctccacctctgggggcagggcacagacaaacaaaaagacagcagtaacctctgcagacttaaatgtccctctctgacagctttgaagagagtagtggttctcccagcacacagcttgagatctgagaacgggcatactgcctccttaagtgggtccctgacccccgaggagcctaactgggaggcaccccccagtagaggcgggctgacacctcacacagccgggtactcctctgagacaaaacttccagaggaaccatcaggcagcagcatctgtggttcaccaatatctgctgttctgcagccaccgctgctgatacccaggcaaacaaggtctggagtggacctctagcaaactccaacagacctgcagctgagggtcctgtctgttagaaggaaaactaacaaacggaaaggacatccacaccaaaaacccatctgtaagtcaccatcattaaagaccaaaggtagataaaaccacaaagatgtgaaaaaaacagagcagaaaaactggaaactctaaaaatcagagtgcctctcctccttcaaaggaacacagctcctcaccagcaatggaacaaagctggatggagaatgactttgctgagttgagagaagaaggcttcagatgatcaaactactctgagctacaggaggagctttgaaccaatggcaaagaagttaaaagctttgaaaaaaaattagacgaacggataactagaataatcaatgcagagaagtccgtaaaggacccgatggagctgaaaaccaaggcacgagagctacatgtcgaatgcagaagcctcagtagccgattcgatcaactggaagaaagggtatcagtgatggaagacaaaatgaatgaaatgaagcaagaagagaagttcagagaaaaaagaataaaaagaaacgaacaaagccttcaagaaatatgggactatgtgaaaagaccaaatgtacatctgactggtatacctgaaagtgacggggagaatggaaccaagttggaaaacactctgcaggatattatccaggagaacttccccaatgtagcaaggcaggccaacattcagattcaggaaatacagagaacgccacaaagatactcctcgagaagagcaactccaagacacgtaattgtcaagattcaccaaagttgaaatgaaggaaaaaatgttaagggcagccagagagaaaggtcaggttacccacaaagggaagcccaacagactaacagctgatctctcggcagaaactctacaagccagaagagtggggaccaatattcaacattcttaaagaaagaattttcaacccagaatctcatatccagccaaactaagcttcataagtgaaggagaaataaaatactttacagacaagcaaatgctgagagattttgtcaccaccaggcctgccctaaaagagctcctgcaggaagcactaaacatggaaaggaacaactggtaccagccactgcaaaaacataccaaattgtaaagaccatcaaggctaggaagaaactgcatcaactaaccagcaaaagaaccagctaacatcataatgacaggatcaaattcacacataacaatattaactttaaatgtaaatgggctaaatgctccaattaaaagacacagactggcaaattggataaagagtcaagacctatcagtgtgctgtattcaggaaacccatctcacgtgcagagacacacataggctccaaataaagggatggaggaagatctaccaagcaaatggaaaacaaaaaaaggcaggggttgcaatcctagtctctgataaaacagactttaaacaaacaaagatcaaaagagacaaagaaggccattacataatggtaaagggatcaattcaacaagaagagctaactatcctaaatatatatgcacccaatacagcagcacccagattcataaagcaagtcctgagtgacctacaaagagacttagactcccacacaataataatgggagactttaacatcccactgtcaacatcagacagatcaacgagacagaaagttaacaaggatacccaggaattgaactcagctctgcaccaagcggacctaatagacatctacagaactctccaccccaaatcaacagaatatacattcttttcagcaccacaccacacctactccaaaattgaccacatagttggaagtaaagcactcctcagcaaatgtagaagaacagaaattataacaaactgtctctcagaccacagtgcaatcaaactagaaatcaggattaagaaactcactcaaaactgctcaactacatggaaactgaacaacctgctcctgaatgactactgggtaaataatgaaatgaaggcagaaataaagatgttctttgaaatcaacgaggacaaagacacaacataccagaatcgctgggacacattcaaagcagtgtgtagagggaaatttatagcactaaatgcccacaagagaaagcaggagagatctaaaattgacaccctaacgtcacaattaaaagaactagaaaagcaagagcaaacacattcaaaagctagcagaaggcaagaaataaccgagatcagagcagaactgaaggaaatagagacacaaaaaacccttcaaaaaatgaatgaatccaggagctggttttttgaaaagatcaacaacattgatagactgctagcaagactaatcaagaagaaaagagagaagaatcaaatagacgcaataaaaaatcataaaggggatatcaccaccaatcccacagaaatacaaactaccatcagagaatatgataaacacctctacgcaaataaactagaaaatctagaagaaacggataaattcctcgacacatacatcctcccaagactaaaccaggaacaagttgaatctctgaatagaccaataacaggagctgaaattgaggcaataatcaatagcttacgaaccaaaaaaagtccaggaaccaggtggattcacagccgaattctaccagaggtacaaagaggagctggtaccattccttctgaaactattccaatcaacagaaaaagagggaatcctccctaactcattttatgaggccagcatcatcctgacaccaaagcctggcagagacacaacaaaaaaagagaattttagaccaatatccttgatgaacattgatgcaaaaatcctcaagaaaatactggcaaactgaatccagcagcacatcaaaaagcttatccaccatgatcaagtgggcttcatccctgggatgcaaggctggttcaacatacacaaatcagtaaacgtaatccaacatataaacagaaccaaagacaaaaatcacgattatctcaatagatgcagaaaaggcctttgacaaaattcaacaatgcttcatgctaaaaactctcaataaattagggattgatgggacgtatctcaaaataataagagctatctatgacaaacccacagccaatatcatactgaatgggcaaaaactggaagcattccctttgaaaactggcacaagacagggatgcccgttctcaccactcctattcaacatagtgttggaagttctggccagggcaattaggcaggagaaggaaataaagggtattcaattaggaaaagaggaagtcaaattgtccctctttgcagatgacatgactgtatatctagaaaaccccactgtctcagcacaaaatctccttaagctgataagcaacttcagcaaagtctcaggatacaaaatcaatgtacaaaatccacaagcattcttatacaccaataacagacaaacagagagccaaatcatgagtgaactcccattcacaattgcttcaaagagaataaaatacctgggaatccaacttacaagggatatgaaggagctcttcaaggagaactacaaaccactgctcagtgaaataaaagaggatataaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttcaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaagacagacatatagatcaatggaacagaacagagtcctcagaaataatgccgcatatctacaactatctgatctttgacaaacctgacaaaaacaagaaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctagaagaaaacttaggcattaccattcaggacacaggcatgggcaaggacttcatgtctgaaacaccaaaagcaatggcaacaaaagacaaaattgacaaatgggatctaattaaactaaagagcttctgcacagcaaaagaaactaccatcagagtgaacaggcaacctacagaacgggagaaaagttttgcaagctactcatctgacaaagggctaatatccagaatctacaatgaactccaacaaatttacaagaaaaaaacaaacaaccccatcaacaagtgggcaaaggatatgaacagacacttctcaaaagaagacatttatgcagccaaaagacacacgaaaaaatgctcatcatcactggccatcagaggaatacaaatcaaaaccacaaggagataccatctcaaaccagttagaatggcgatcattaaaaagtcaggaaacaacaggtgctggagaggatgtggagaaataggaacacttttacactgttggtaggactgtaaactagttcaaccattgtggaagtcagtgtggtgattcctcagggatctaggactagaaataccatttgacccagccatcccattactgggtatatacccaaaggattataaatcatgctgctataaagacacatgcacacgtatgtttattgcagcactattcacaatagcaaagacttggtaccaacccaaatgtccaacaatgatagactggattaagaaaatgtggcacatatacaccatggaatactatgcagccataaaaaatgatgagttcatgtcctttgtagggacatggatcaagttggaaaccattattctcagcaaactatcacaaggacaaaaaaccaaacaccgcatgttctcactcataggtgggaatggaacaatgagaacacatggacacaggaaggggaacaacacacaccagggactgttgtggggtggggggaggggggagggatagcattaggagatatacctaatgctaaatgacgagttaatgggtgcagcacaccaacatggcacatgtatacgtatgtaacgaagctgcacgtcgtgcacatgtaccctaaaacttaaagtataataacagtaaaaaaaaaaacaaagaaaacaaacaaacaaaaaacacaaaagataaaactcttcacttaaaaaaaaagaaaaattctgagccacaatctctttaaacattgtctcatctccattctgcatatttttgttgcctttcacgctctaaataggctttagttaggcttgcttattctgccctccaaacttattaacctctcttccttatagttccatctctttgtctgtgctccattgcatgaaactattttagttttattttccagttcattaattagtccattacaaaaaagcttatccactaaattttttgataatttttttttattactgaaggttttctttagctctttttcagaagtgcctggtgattgtgagagaccattgttgttcaccattcaccatttttgtagtctatatttaagttaatttttctttatataaggtagtctagtttcttcttatctgatacttcaaacatctaaagcccttggtggggaaggagtaattaatatattaacgctagttttgctgattttcactcacggtggtttgtttccttgtttgataatcttttttgaaagctcaagatcccaatctgtgaaaaaaaactagaagcctaaattacatttgctttatctggaatttagtggtactaccaacctgggctattttatctcccttctagaatcccaggcttaaactgggagttgcagtacggtccccatttgcacccccacatgaccgtcacacacaaacacaagggatggccaattctgccttttctggcttgtttactgttgacatatatgcacttagctacttgtattttttttcttagatattttcattacttcctaggagttctaaaatgcaacagagatatcctttggagtacaaagtctgttatactggcagaagaagaggtcctctttaaaagtttttagaaagtaggagagtgacatctgattgttgcttttgaagagctttttctagattctctgtaagaatgaactgcagggaggcaggaatgaaagcagagccaggtaggaggctaatgtagtagttcaggtgagaaattgaagcaacatgtctgagagaagtagcagaggagacagaaagaggtgaaatgactcgatatctgattgggcataaaacaggaggagcttttgatagtttggatgtggaaggtgaggtacaggatccctggttgatggctggtggtgtcatttcatttattgagataagaataattgggagatggacagtttccagtgtttgtgtaggttagggcgtgggtagaaattaagagttctgttttgaatatgttaagtttgaaatgattatcaaacatccaagtggacatgtcaagtaccctgttgggtatctaagtctgatatttaggggagagagctgggctgaagatataaattggggagttgctgccataaaggtttgggagcagaggagataacaagtgagagtgcagagagaaaacatagggacagactgagcctcagggcacaccaattcagaaactaacagaggaggagacagcagtggtgattgagaaggaaaaaaaaatccacgagaggagctgtcatggaggctcagagaaaagtgggttccaggaagaagggagtgattgactgtgctggaagctattgagaagctgaggaagatgcggcaacaaggtggtcattggtagctttgatctgaacagttctggtgaagcagtggtgtcagagactttaatggagtgtgtcaaggataacaggagatgagtctagataatacctatagacaagaagttcgaagtgttttgtgtgaaagggagcagtaaagtggagtagaagctaaaggagaatgtgacacaagaagttttttcctggggcagtattaaagattttatatgccaatgggaaagatttagtacaaagggagaaactgatcatgcaggaaagaaagggaatattttcagggaaaatactcttcaaagattaagcacccacaagtctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtgattaactcaatatacagctaaagaggtcttagaggacttctagtttggtctcgtatccactttaggcaactgaatcctaaaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatcatttggctaatcttgcctctttcccttctctccaactgttttttttttttccctaaagtgtagtgaccagcaattgacaaactactcaaacaaagtctgaataatcctgagagcagtgtgggtatttcaacacgtctcctttagacagatgaaaggctgacctggctctgccaagacttgaacacattccagttcctgctgatctgagaagtctcttccacttgcgtttttcttcttttacctggcaatttgaataaaatgaaaatacaaccagatgtatagggaaaagagtttttagtgtacctattctttaaaatcagcttgagctttatgtaaaagtcaaaatgtgcacataccaattccttctaaaatgtaacaaatatctgaatataccaataaaatgttttgtctctcaactgcatattccacaaagtatttcttaaaatccaaaagcaagtattcagatgaggtaattaattaagtgaagtgttgggtttggaaagccttctactattttgaggctaatgatggttgagaaactcctatgggggtgtgtgtgtgacagagattctgcctgctaattacttcccaagaaaaatctaagcatccaacaatcattctaatttttcctaagaagcatgaaatatcacatcacattacattatgttatgccaagtaacaggatgttcttggggtaaacatgacaaaacaatacagctggaaaaaacaaattgaaaggccaaatgatgtgcatataattttgggtaggtagtgctataaaaagaaagaaaaaggtgcacactgataataagacttagaggtgacttacaggttttgatacccacaggtgattttaggaaggcagctttgttttaaccataagattaatgccataagctttggctcttttacttatatttgtttcactctgaacaagcattggagcccttttgaacttcaattttttcctctgtaaaatgggaatactactacccaccctacctctttcatatggctgttgtgagattctaatgcctggcatatttaggtgttttataaatgtctaattggataccgatagatatctgaactggatttaatattctgtatgtcacagattccagtctgtacattttttcatctaatgatatttcagaaataaggatatatcttatagttggtggcttatattttaattaactctttctttcttggtggtacataatatatttaaaccaatggcctcttagaaatatggcaaatgaaagagttgggaaatggcaaaagtgctatgcaaatatcagttatttattcataaaacgaaattttaccaaaagtctcccttatgcaaggcattcagaagaaaatgaaaatgaataagattgggtccttaatctccagaagagtgcaatgcacgaagtggatgactcaggataactcaaatgctaaacagaatgtgatatgtgccatttgagtagcattcacaacttggcaccttgtgaatgcagaagaggaaataactttcagtagggtcaaccaaggaagcagcatggagggggtggcacctggcctggccttgacagatgcgtagtatctcaacaggcacatatgggaaggggagataccctacgcagaaaggacaagtgaggcatggacataggatgcacagcaaatattctgaggaatatggtccagacaagaagcggtccagacaagaaggagcatggggaccatgatgggctgcttgctctaggatattagagatctgggctcaatttggtgaatgggttaggctcctgagcaaggagcagcctgatgaaagtggggcattaggagcctgtacagggggaccagttaagaagaggctggaagcaggggcatcctaaagcaggccttgtgcaggcttgaaaagtccagctaataagtgggtagtaggggtagacaggaaataacaaatggatggtagagccatagttaaacgctaaagatccttaatgagaatcctagagagaaagcccattccacaaatggatagaaaggatgcactgaattgatgtttgactgtgtgctccttgaggatgggaactgcatgctttgtacatcattgtatcccagcacctggtacatggtacttacacaataactatttaatatactcccttcctccaaaaattccatttatatttttaattcaattcagcaagcatgtacctatcacgtgcttgatgctggacactggggtcgggaagaatgggctgatgtggtggactgtttttcaaatggctgcaagaattccttccttacagagtcttgggtggtccctccaaagctgactcggggcttagccataggacttgcttttaccaaaggcataacagaaaacgtaaggtaagcagaaacttggagaaaaaaaaaaaagcctatacattgataaactaacgagttccagtctggacaggttgaatatgaaatccttgaggcatgtccagcaggcagtttggtgtaaagcagtaggtcctgctgccaccccaccccctgccgcccccactttttttttttttttttttttttttttttacccctgagggcatcatataaagaattccaggctagcctcctggaggatgagagaacatgtggaacagagatgagtcatcccaggggaggcctccccagaccaaccatcctagaatggggggtaacaacctttttcttaaaggaccagcaggaaatactttaggcctgtgggccatatgatcatctccattccaaatactcagctctgctgttgtagtgcagaagcagccatagacgatatgggagtggctgtgttccaataaaaccctatttataaaaacaggtggcaggcctgtgggctatggttcgcctacctctatcccagattattcagccccagtcgagccagtccaaactagaagaactgcccagccaactcacagaatcgtgagaaatagtaaatgcttgttgttttaagccactaaatttggaagtgttgttacacagctaatgctaactgatgaaaatggtataaaacacataaagcatacaccctgtttcaaggcacttaaaatccacctgtggaagcacgacacgtgtgggaaacatttaaataaccatagaaggcagtatgtgactaaatgtcaaaatgaatgatgcaggagaattagaattataaggatttataaaagggaaaaatcagtttggacacacaaaaaacttgggcagcatttcataaagaatgggtagaatatgacagttccctaaagattcctgtttccttttcactgcccttctttatgctgcctacttttatgtctatgtaccccagcagactgggagcctcctgagggaaggtcttattttctattttctaggttcccagagtccagtgcagtgcttggttcacagccaggctcagtatgtacttactgaagaaaccaataagtccacaggtggagaggagaaagagcatctatgtggaaaaaccaaacctcatgatcaaagaacactgcacaggaattcacgtggtgcattcaagagaggtgaccagtggctcagggagaagaatgagattggggtaagtagaagctatagctggccatgtgactctgggtcatggggtgggggtgatgaggcaaaatgaaggacactgactttcagggatttgaagctatatgttactggaatatgtgacctagctgacatttatgaagataagtttggtggcagacggtagggtggattccaggcaaggagaatagttaggacaatttactaatccaggaacgagggagcaactagcctgggagatggtgggaatatcaaggtgtcagctcctgataaacaccaaatagagctgatcatgtgcttcagcataaactacaaaagaaaagagagacatctcaggcattccttcatgccacctttactgagtacaaggtattattaagtcatgtgttctgagcccatgaagacactaagtagatctatgttacatttggaaccaagatacataaggtcaaggccaccactatactcatggagaagcacaagacaaccaggaattgtgagtgaggcaactgctagaatgggcagggcacaaggtttgcagtgacacacacagccttagagccgggctccattcttattagctgtgcgatgttggacagaccatgaacaccactgatgatggtattcatcttgcaggctggttgagaattatagaaaggatgggtgacgtgcatagcacagtccctgaatagagcaggcactcgtatgattcacaattacaataaaagcaacatgtaatagggaacacatgaatggtataatctgagtgctgtaatagggcagagaaagaaaaatcacttttggctgggacagtcactttggatttgagagtgagaatagcatgtggtctggtggcaaaaaatgaggacgattttgacaagtaggggaaggggaaggtcgttccaggaaaagaaaacgttctgtggaagggaacagagataaaagacggagcccctcttgtggagtgtggtggaatttagtttggctgttgcaaggtggaaggtgaggctgggaagcaggttagggtcagacagcagagtggcttgaatgccaggaaggggagctgggatgttacgcagtaagtagtgaggtgctgctgaaggatcctgagtgggccagtgacacgatcaaaccccaggtggcactgtgagtggtgtggaggcaggagacactcatgcaaggagggcaggaacaaggtgaggcatgccccttccagggattggccacagcaacggcaggagagggcatgtgagagaggatgcagaggacgagctggccacattgggaaacagtgaaggtcgggaaggagagggtggaggtgaagttcactatgaaatgagaacatagactgactggttgactcattggttcattcagttaagctgccattgagctttgtttgttatgtgctcaacacttctaaatggtggtaatcggctgtgcacaagacatggttgcttctccccaggccagggagtgtcaccaaacacacacgttctttctaaaagactatgcatgcagtgtggtcacagtgtatttatcattgtagctagtccccagagtataccacaggacttgacatatactagatgctcaatgtttattaaactcattcattcactcaacaaatatttattaagcacccattccatgttgggcatagttctaggcaatggggatatatcagtgaatataacaaatatttctgaggttccttgagatctctgtgcattcagtttacacccaaagcataaacaaaatcactgcacttattctaattatgttgtagaattgaagtcagcatttctttgtattttttcctccagagttaaaagatacttattgtgaaagtatcaaacatcccattatggaattaagttcagagcttttaaaaaattgtggtattgattttgagattgaaattaaacatgacatggtacagaatatattcactcaagcaaccatttaggaagacctaatttgtaagctcatctcaggcaccactgagtacagtagtgatgaatcagaaaatccctgtcctcaaaggtctttatattttacaataaaagtccttacatagttagcaccttggttttcaaagtgcttttgcatatgtctcttctcatgtgaatgtcaggacaatgcgggggtgtacacaaggcaagcatttctcttcctgtacctcccatggagacgctgaggcccagggctgctggtgagtcataagctgacccaagagtcaagagccatgctctttccagtagtcagtggctcccagagaaacaccatgctccataaaaggtggggagaaacaggttgttgttgttttttttttttgttttcttggaagggaagaaattcagttttctgacctaaaaattagaaatgactggagcggtaaagttattctgctaagtaaaaagcaacatagctgagtgggagaaaaaccagaagaaattcaacatgttctaagggatgcacctggagagtgtgtggcttctgttctgacttttatatggacaaggataattagcatcgttttcctgtaaactgtattcaaatttccacatgcagcaatgctcccctggattcgcgccgtaatcattacatcacacttacagcatgtaccagtttacaccccggcactaagtaaaatacaatttcctttcttcctttgattattttgccttccttccttctttgcttccctctgtctttctgcttttactgttactcccacatttactgaactagatctcataaggattcctgggcatccacagatgaatgagccacagttcctgatgcttgagtagcagactaggatgggaggaagcctgaagacgggatcctatcattcacttcagtatctgccccacagtccgctgctgggtctgagacaaggacttggttcctgaacactgagtggatggatggaaggatggatgagatgcctgtatccggatggcagtgttccaatttctgactcagtaaaacagttgaaatttatcctccccttcccgttgctttttctgtttcagcaaccccctttcaatgagagaggatgtgaacaagagaatcaaattggcattctgaagctctttatttaaaggcacgtatttagcaatttgctatgtctgagttaatatatgggttaagttccctgtgaatgacactctcctaactttagcaacgtcataaagacaatcagttgctgtgtgtctggcaagttaatgactacaagcccaagggatgcaagaatgggaaaatgttaacgtagaaaaaaagactttaagcaaattcagaggaaaatggaaaaggactcaccactccctccccaaaatgctacacataacatcttgttttgaacaaggaagttatggagaatattattctaaactttgtattcattagaacaatcctttacagaatgcagacaagaaggcgattagggaaattagtaggagataaagaagaaaagagttttaggaaaagatggaagcagaggaggaaggaagaagaaaaagcagagaagaagactccatgctaaggtgacagggaagcaggagaggaatgtgagcatgaggtcaggtctgggggcaggtaaaagagaaccttcggagaacttgactggcagaggtgggtgagaaaggacactcctctcctgtcttcctcagctccagagggtggaatgaggctgacaacacgatcattgtggcagttactctgctgggggcttttatatataacattttatttaatcatccagttcaaagccacctgcaaggaaggaaattatgtccattgtactggtgacaaaactgagtttagaggttgttggtcaaggagcaggggttctggacaagcacccacctacggacagcacactgccatccacaaaggactccttcatcttccttaaacctcaggcaattctgtgaagtgaacaatatcatttccattttgcatggcaagaaatgcaggctttgagggagccactcgcacagctagcaagagaccaggaagcacatggactgggacttgatccagtgctccttctgtttcactaaacagcctccttgaggaagtagctggttcccttcttttcaccccatcctcagctttatcctgtagcctgtggccagatgagtgctgagtaccaggccaagcagacacagcatggcggttggggttgatgtcccacggtcctcctgactgtaattctgcatggagtgaggactctgattctttaaaatcttagggctatctggttcgtgctcccacacagtgcagcagtcttgtctacagcagcccccaaacatagcctaaaaagacaatgactctcattccagtagcagaggttcactgttactaaatgaagccacaggttccactgtgggctagctgtatctggaagaaaattcttgttttgagcccaaatctctttctctataatttcttttagttctgcttttgctagaataacaaatgtctttcagatatctaaatgcagcttttgtgtctccccttgtttttctcttctccaggctaacctttctctgttccttcaaccactggttacaagacagtctctgacaccctctccattcctcatgctgtgttcataaagcactcaagtttgtttgttttccttttctttcctttgttttttgtttgtttttttggggggaagtcagagtcttgctctgtcacccatgctgcagtgcaatgacatgatcatagctcactgcagcctccaactcctggtctcaagcaatcccaccgtcttggctgcccaaagcattggaattacaggcaagagccaccacgtccagtttatgttccttttcaaatgtactggtataatactcctaatgtgatctaagtactgcagagtctaatgaaatcatgactcttccttctgtgggcatgagacctcttttgtcacagttaggataatgttaactttttcagcagccactttgtggaggagaaagctaagtcaccaagctcttgcagtacagcataataagttctgcgaaggaggcagccagtgggctatggcatcacagaggagggacagcaaattttgccagaaaggaacaaagaagccttcttggagatgacacttgaagaacaactcaaagtgagagtaaaccaggtggagagagtggaaggtctttccaggcagatggaaaagattttacaaagatgagctggtgtgagagaacatggcagtacagccttttcttccccattgcttctcttttcaattcctttcttcagcctttctctgacttagcttcactttcggatgttcttttcagttaaggcttgggaagacccttgcataacacaggggttggggcgccgatccccgacgcagtcgaaaatctacatatcacttctgactcttccaaaacttaatagccggctgttggctgaaagcctcactgataacataaatagtccattaacacatattttgtatgttatatgtattatatacctgcaataaagtgagctggaaaaaacaaaatgttattaagaaaatcataagagaaaatacatttcctaagtgagagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgtgttgtttaagggttaattgtactatgttctcctgttttaagaagtatctgttgcatggagttgaaagttcttcaacttgtttactgtattaagtgagcatcaaatagccaaagcactggcaatgttactataataagtagttttggaggttgtgcctctacttgagtgaactgtttgattaggttagaaaagcaaatggtaccctaagtatcaaaaggcagccaaaggtcactcagggccacaggctggaccacagtgctccagggtctttgccccattatgagctgatctgtttttcccttcaatgcctccagccagcagtgttgaaatgagatattttaggatttccaaactatttctaaggctgttagtcacaaactcttatcaaggcagttttctcaggttggttagcagacaggctcagagcctcacctttgcaggtcaaagctcgagaaaccctccacatgataattcacgcatctgttatttttttacctgtcccttctctgcctttagcttctcagtcatccaaccccgcctctgtgaaaagtgcacaatgactcaaggcttttcttaggcctctgacaggtgaacaaagaaaaacacctttcacaaatccattctatcaagggatagaagaagagagaacagagccttcagtaaagaaccctaaacatcccaccagaaagtcccaaacaaccctgaaaagtgagaataaaactaccaaaagctgacagagggtaacaagcattatttccaacccacacttgtccttctaaaaaaaaccaacccgctactgaaaaaacccctgaaatgtatgaaatctaacatcgttaacatatttcctgtcctcacatagcttataaaaatgtttctgagcttttccctggctcatttacaacgatgagaaggagcaaaaaggaaatgcaacagatggtactgagggaggaggtactaccatcctcgctcacagtcatccatcttcgcagtaagttatccccgcttgggcgaggtttcaaacgtttttcagatgtaccaatggcgtattcttgctcgagaacaatgaagatgaggctcctttaaaaagcttcaggttagaaggcatgtttactactgtctatttttgttgtttctaaaagagatcacctcagctttccctctgaacctccccaaactgactctgcgagaatctaatctggtactgatttagagctgacaggtggtacatgcataattaaagatgacctaacacagaatgctctcattcctggcatattatcagacacttaaggaaagcaattatcagtaggcaatcttttctgtcaacagagatcgagatgaaacatttcttcaattaagagaattctgcaaggatgctgtacatatccatctgcaaatacttgaaaacctttagaggttaatactaagtcagctcaatgaaacacctttggccagttaacacatgctctcctctcctcccacttttcctgggaggtcacatttcaaacatcaaaatcggaacaattttaaggtgctgccagacaccctgacatgagcggacaaggaaatctctgcatttttctgccttgctgaggtctgaaaatataacaagttttccttaaaggttcaaagcaaaaaaggatagggttcacattaaagcaaattcaattaaaatttcccttcagagcaggattattccctctccatgctccacccatgtcagaagtatttagagaattattatcaagccttaaaacttcgtcttgaatctaagtgatttaaaggatttttttctttcattttgaagaaatcaatattactcaaagaaaaaagggacttgacaaaaacggaggaatttcccatttcaggtgaaggagggaagaggtgccgcatttcctgatagaatactgtgctttttataaattatagtgcatgcactttgtataaatgaatgcatttaagctttccttagaacagaaattgctttaatgttatagtgagacaagtgattttcttttcttttttaaaagggtagtttataagttaatggttttttgaagcccatgtaaaaactgccttccacaagacagagaacttcacaatgtttgtggtgcatattttgccacatttcacaagaggtcttattgtttaaattcttatagccttatgtcatatgtgaacaaatgactttattgttcatttgaacatgtctttataggatctctggtggtagagctagtgttgttgtttgcatttttcccctcaacaagccagaacaaaagtctcttttactgaagcgctgggaactcagggacgatggcagtgtggcagcagttgtcagttggaaacaccataatgataatgtaagtgaagtgctcacattaaggggttgacttctgacaagtcaaggtctacagaaaagtttccgctacagcagacattatggtaatgcaaaaacagaagtacttaatagaataattaagaatcatccagtacactattactgcagtagggctcaattcctttcgagatatgctttccttggaagagactccattcagaatattaggggaaaaatatcagtagcctttggggagaacataatcagatgggaggtggaagcgatggcgggatcattaatgggagattcagtaggactcaaagctcaagttcattatattccttagaactaagaatagcttctgaatgagtactcacaattctccacagacctatttctcctaaggagctccccctttctccctttccaattttaatctaagaaaaagaatagaatacagacagacatgggtaggtaagcaggaacaaaggaacctctacagaatggaagagaatctaagctagttccgttttagatgttgttaaatccctttgaccaggattcaatttagaacaactcaaaagatacagtttgacagcatgctgcatcaagaggacaggagaaagaaagaagtcacaggtgtaatgttgtggcaaacaacaaaatgttatttcccagtgcatgtcatggacgaaaagaacatataagatataaggcacatactaccattaaagtaaacagaatacaaaaaggaaagattttagtgagtttatgtagggagagaccctcatttctcacacaactcagagtccctgacttttgtaggacttcagtgaataaagcaaagtctgtaagcacagcctttctatgctgaggatgatatatggcacaaaaacattttacatgatgccttttacacttagatattattttagaatcataaactaaaagcgtttttaaggtggaggtacccggcataaaatagatgtatcttctttttaaccaaggcttctcctgtccacactcaaacctggctttccaagtgtgttggctttactattttatgattggatgaataaaataagactgttaactatggctacaaaataaattacgataccctgaccccaacagagtattattttggaaagaaaaaaagtcaaatccaagatattattatcgtaactgcaatctacttgtgaccctgtttcagaaaacctgccatttggaagccttatggagacatttttcagaatcttatgtattctctctgttaactgatcagagatacttctcaggtttctttcaccaaggacaaaatatgacatatacttaagaaaggatggatattgtttcaggatctctatccattcaggagaagacacttgctttttagttaaaaaatgactgtgactaattccagagcacctggtattggctttttcaagaatgagcatttgaagtcaaactggaaaatggtgactggcacatctgcaatgatctagatgatggtaagagacgatccagagatggtaagagacagataaacccaaaaaggctggcctcactttgctgcagagggataaaagaaaatagaagaagcgaaaaaaatgatttttctctacaagtcccactctaggaatcacctttgttaactttgagttctttcacaaaatgaaatgttatgtgacaatacaatctgtttcccttagggatggaaggtgatgaggggagaccagtgataggtgagatttaaagacacgtaaaggaagggtggaaaagaaatgcattatgttaccgagcgaatgaggattaaatcttcataatgcatgtcagattctcacaaaaagaaaataaaacaagggcaagcttttactgaacacctaatatcacccagctgtgaataaaagaaaaagaatctcactctgaccaattcatacaaattgactaatacttattcccttatggtccatggtaacccatactccaagcacacatgatgttctttcacatgtacacatttgtaactttctgtaaactaattagcgaaggagaatacaaaataggcaggtataatggaaactagtgaattccatccctgaagctagttgtactgtaatatcttctgcatggtgccaacagccccctttccctttgcttgttccgacacaatgccttcaggtctgtctaagtaatgtaatttactagagtggaattccctcggtaccctgtgcagtacttggtgacagtatcatttatactccaccgtgtcgtggcctgacactgatccatccgccttcatccctcattcagaggagagcatgcaatttcaccttcctccgtgcccttctctggtgtgcacgtacacattcactccactcagccctaattacaaacctgggttaaaatactctcattagatttatatttcacactccaaatgtcaatcttgttgaaaattcccgttttccggaggattcatccattagcaataaactttaaagcattctgtgactgagtgcattaaaccagcaatgcggacatgcacttaaaatacatcattagagaaaatctccattgcaaatactttacactattcaaccaaaggaataatgagccccgcctggccagtaccctcaaactgcacatgaaggataagttaaaactggcagttttgcaggaaggagcacacagtgtatccacaggatgcatttcagaatctgtcattccttatgaaagcgtgggagggaatcacagccagagtctaatttatcaccttctctcacctattatttttacagaaacttcggtctatggcaaagggcaagagggacggcgaagataatggggaatatatgagtgtgtacagggaacagaagctgtatctgcaatgccaggaactttgaaagtcacctagaatgatttgctcggcctgaaaagcattcttccatttcgttaacagagaaaagtggagaaagcagcattgtctggagacactggagaagcgggtatcattttaatacaagacagatttccctggcagagttgacctgagaaatgtctttattccagactgatggttcctaacacaaaaaccaaaaatctgatgagaatactaatatataaattataagtcacaagttgtatctgggacagggatggtaggacagactaagaaaaggaaaatttgaagaggattgaaaaacaacccagcaaaatacaacaattaagaaaactaagccaccactgttttatatctgtcctgtattttaattccttagcttataggtttaattcatcacttcttgtcaggtctcaggtgaggcaaagttaagatacagtcataacttctctttaactttgataaatgaagaaacagcattctaggaaagtcctggaggaggttaaagggagactgatttgaagtctcagcatctaatcctgaaggctaacaaaaaagttatgtccacaattatgactttgtactgtgaaatacacaatacactttataatgcaaaactttggtgggtggaaaaggactctagaaggacaggtatacattgtattaaacagaaaataacttgcaaagcataaaaaataaaaataaaagcaacagcaattgttttctacctgtcagcatctggtcaatctgtcagattgttcagtaaccagaattataacagatgcaatattttctgtggggaattacaccaccatggaagctattgctcctgaagttttgcccatttccacctgaaatatttttttagccttacttgattacaacattagcactctctttcataacgtacaccagcaggtactacaattaacatgcacagatgttagaactgaacatccatgtttaaataaaaaacagggagaaggtaaaaattactgaatatgctcaacacagcactaatcttaaaaggaaagagaggcttacattgtgctaacttaacagcaaaataaaaaaaacaacaatcccccagttggcattagtaacctaagaagaagcaaaccactctataaatgcctgtattcttctgaaacactgaaccagaggctgatcttttgtccatttaattccaaaatttgtactccaagaatagaggagaactcccaaatgctctcaaattctccaacacattttatgatgcaactgcacaaatgacgataacaccaacatcattttgtggagtgctggctttgtgctttatgtacgtcatctcactgaatccccacaaccaccctctcattcaggcaggcagtactacttctgttcccattttcaaataaagacacccaggcctaggagaggttaacagatcaaggtcaacaagtagctaagctaagatttgatccggagtctttttttcctcctaaagctctcaactcattgtaaccactgtgccacactgtctgccacagttggggatgccaaagaaaaatgtgatttgcagtcttcatttttcagaatcttctggaactgccctcttgactcatccattttacaaagctcatcagactgaaaggctcagaacacttgcagacattctcattctttggaaatgccacaaccactcagtcagtggaatgggacagcaccatcaatgggattgcgaaggcacaaatttccctgtgaatgctggcgccgcctctctttggtgtttcttctagccacaaacggacacgttatcacttactgtggttgcattcgactcagcagccagatgcaggggagtttttacttggttaactgtccctccaacatctgtgtctacagaagatactacagggcaggcgtgtgctcatccttgtcccttctccctcctccaaccaaacacacaaaaagttttccaatctctagggcaacaccattaagatatcctttccttgctgtgctatgagtttacaagaaataactttctaacaataagccaagaagatggatgttgtaaaactgcatttcaaataaggcaattcctttttaaaaaagattcaagggtttcacgcttctttcttccttccatcaacacaatttgtttatgtatgagttggatctttcttccttcggaagagaaaagtgctgataaactatcatgtgtagacacacaacgcaaaaacttggttgccttttgctatttaaacagagacaaattatttcccaatataccacttaccagacagatgcaaagatgtgggcaaaccagtcatcagaattaacagagtgattttgcttgcactacatattctgatttgtatgactcttatttttagccatgcacaaagggcaataaatggaaaatcttattctaaccgctactttttctgggccacccacactgccccacctaccacacaacttcaaaatgtaaaaaaacccagaccagggtttgtcctaacaagggatgcaaagtggctaaaatgtgtgacattttttccagttagtgtttgtactttcattttttttttttttctgtctcaggactttcagggaaaacaatgttgacttaccaatgggcattttcaaagactctaagttggtatgtcagtcagtgtacagacaacgtgatccgcaaggcacgggcaccaccctgccgtgaaccacatctcagccaatcttccgcaaagaaatgtacccaaaaacttttctgtaaattcaggaaggtgatccacaccttccacattttgttttgaaacaatgatggtattttaaaagttcttcaaattaacaaaagtgatatcagaaatataaacatttctaaaacagagcgggctgtgaggagtgattttgccaaacttaagtcagtagcacttgacttatatctgcttttagtctgcggtggcaccacgcttaccaaggcacagtatccccttgctatccctttccttctgtgcattttttctttctgtatgccttaaccacacttctccacctgataacctgaagcttatcaagcattaattcacacatggttatcactgtggattgaagcatctgatatttagagataaccatcttgacggcaaataataaaaacaaaattgatgaagaggatatttgccaggggcacagagaagatagagatgagagtctatttttgattactatctttccagacttttaataaaaagttattacagtcccaggataccaattaaaatgcttgttcctctgagccctctgcaaaccacaacagcaaacatatgcaggtaacaattaatatttaaaagtctagttcaacaaaatcatcagaatcattaggaaacaaaaggcgtcaaccctgagaaaggcatctttacctgtgtgcctgctcattatccagaaactagaggaaatgttctttcatcgtctggtagttagcacatgccctgcagagctaacaccgtcttcatgcgcggtactcgagcagctctgatgagatgtctcagaaaatcttttttgggtgatagtccactatcgccagaacttctgacttgtgttgtaaaaacacaggcaattaagtattacacaaagtgggtcatacgccactgagacaaccacaccgcccccaaatcagactccaaatgactgtgctgtgacaaggtaggaggggtctgaacgcagcgaaagcaaaacttttatgtggtgaggagcattttagttttcactggtttaggttagagaaagttaatctcaatgtcaactacaaagccaacaaacttttagtgtgttcttgaatttatatgacaaatgctggctgttcatctaatgggaaattcagatccaatgtcataaacagtctgagggacagtctcaggcttaaatgacatgcccatcactaaacaagtgagcactgtgactcagtgaaggaaggcggccaaatcgaaactaaagataaagaaccaaattctcattatccacattagcatctccttctccaaaggaggatcaaagtactgtataccacttccccacacccgtaaccaaccagggcattcaacacaatcgcagatgctacccaaacacccttcaattgctgtaggaaaaaggtcaaatgtagttacctgaattgagcacattcattcatctgtcactgaagagccacagaaatattaatccaatatacactgagttcctattacatacaaggacacagaggacatgaagggatgctctcaaagtcactgctttcaaggaacttaagaatcctttacacgggatgataaaacctagatataaccaatgtcaaagacagactttttcttttttttttaaacaaacaaaatcccttctagcagctagctgcttactaaatacttcctattctacggacataaagtttgtggattacaattctacatttctcagatgaatcttctaacaattccttaaattttaccttggttttctttcagtgctcaaagcccttcctaaccttggccaagtgttaggattcatcctaacctgaaggcctagtactctccaaagggaagcacagagataccagcacaactcaaggagctataaaatcacaccacagcaatcggaagagatgcatctttaaagggggataaaggatgcaaagttaaaggaaaactctgttcacagcacaagaaggcatatatttgaatgaaattttgttaccaaaattataaaatcagaatttgattggagttcatattgtttggattgtgaatgcggaatgggaagatctggctaactcaacctttcccatttctgccaaattgccttatagtacagtgattactaatttctaaataatcagaacacaatcagttgacctaacaccaaagccatcttgtacataactgaatcttcctttatgattccagaggcccactaggatcttacagggccactcactatcattttgactgacagaaggtagaaatgaaaatactggttgacaggaatttccacctgataaagatactagtgagtccacacagctatctgttcttataagagctgattaatataattagaaggaagaaaaaaaaagtaacaaggagatcactgtcctataagatgacacttaaaggcatcattcctaagtgccaccagcttgtaggatgtaatcagtctagagcactgcttgtaaatttggaattagttaattagtttcttgaaaaaagtctggaaaaatacataaaagtatgagttaacaggtaggttatatttgggcagccagattataggtaatttatctctacctttattcaattttctgctattttataaattatgtagaatacatgtatcactttgataataaggaaaacaaagctacttctgttcagataaaaggaaacaattattttctgattgtggttctgtctagaaatcaagaacacttcatcaataagtttctgacactttctgtcaagaaatcaaggacccagcatactaatctgaactgaactgatgacaagtaaggcacagaatacaggaaaaacatgctagaaataacagattatagcttctaattaagcaccgcaaggactctaaaaatcttgctatcctgcaaagctttgtaaatactgttctggggcagaagagcagaagtgcttttcctcctcatgacgcacagtctgtgcaacttccagctgccacaaggctgcaggcacacactcttacaagatctagctaatgggacatccttggaaaaacatgctgcaatgccctgggttaaatctgggctcacagagaggcatcatttcactagtgacaggtgcatccaaaaaagagcacacaaaccatttcttaaaaatcaacagattggaaactattagaataaattgataaacaatttgtactacaactgatgtcactgggcaggcagctttataataaaacatagattatttggagactcacgactcagagaattatcttttgaaatttttgatttatatattaatgtttacaaccatgctggtaacatcactcctctctgtaccattagcagagaatgaaaattaattttgatgatctcttgagcagaacataatctgaatctgaaatggaatattacaaataatcatatcataggttctttttattttttaaaaagaaacagaattggcttcaaaagtatgccgttggttcccaatgactataggagctaaatacataggttcataaaatgatttcatatattagttttaaaaccagtaatatcacaacttttagagtgcttaacataaacagaacattcaacatttaacctctggcactggaaaggtggtaaaagccaaaacttgcagtttctcgagaaggataaaaatgaatggtatattgttctgtcctcagtcaaaatttttagattattattaaagcatggaaataggtatactaaaacctcagttaattagactatttgaggacaagaatattttttattattttgattttctggttaattgacaactacaaaatgctttttgttgaagtttttccaaagcagtttcttttcctctttataaaacatctaaccattctcaatgattcagcaggtcaatgtcatcagctacaagtatcctccagggtttacaccccacctttactcaaaaccaaagctatcttgttttcttcatcgctgaaaaagggaagtgtggtgtgtgcggtagggtggggtgtgtgggagggaaggggagggggtggggaagtatgaaggttagctaattcagggttctggctagttgggttccaggtagcaaaaccgtcagtaaacacaaattcaatgtctggaaccaggcacatctgattcctgcgaatgatgagacaaggacacaaggagatcccactagggtctgtctttgttggtcttctctactttatgtcattttgtctcggtgactgctggtttgatgctcttctctgtggaaaatgtgtcagtgtgtctatctaaaaattctggtctatgaactcatggggggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcagtttgtgaactttttgaaaccatggatccttatagatgactcttcaggaattctaacccctggtcagccctaggggtagagggtaaaggtagtgaagacgacctgaataaagtatggctactgggccccataaaactgttgattgttcttcaaagccaaatttctagaaatgtagaataaaacacaaaagccaaaaaaagtagggtacaatggactaacctagtgagttccatcctgtgtgttcctcacaggactaccggccactcactaacctgtctgtgacttacgggtacaataatacccataagtacagagatttggtgatgggggataaatcttgcttcacttggagaatgtaaaacaggcatcataataatcataggccctacagcgggagaactatctgctgtggatttcctctcacagctttcattttctactgcgctggaatctacgggaagtctgcattccctggttcctgcctccatgtccacctccgctgattaagacctttcagaagccacagtgaggcacacagctctgggactctctctgtgctctgtgcatggactggtttacaaacacccatctggaggaactggagcagccccactgctggagcatgggtggctcacgctttccttcgccccagtgaagcaggtcttctagatgtgtaaatggcattttagtagagaccacagttgtttaaggcaaattcccttgatggcttctgacaactgtgtctttactctgataggaaactcattcctgggactgaagtatataccattcagtggatcccttacctttgttggcttctaaaggctgcccaaagggtaacaggaatgagggaggtgtgagagacataatgatctgttcttcctgcaccctcacaaactgcagcatccctatcaagcactagctagtgattctgcacagcactcttaggaggaaagctttaaaaaattatgtaaaatatatacaacataaaatttaccattttacccattttaagtgtgcatttcggtggcattaaatacattcacattgttgtgcaactgtcatcatcattcatctccggaactctccaatcttcccaaactgatacttaatatccattgaacaacaactttcaatttttccatcctcccatcccctggcaaccaccattctactttctgactctgtaaatctgacagttctaggtatctcatataaatgagatatttaatatttgcctttttgtgtctggattatttcacttagcatcttcagggttcctccatgtcgttagcatgtgtcagaatttcatctttttaaaggctgaataatattccattgtatgtattaatatacaccacattttgtttatccattcacctgtagatggacacctgggttgcatccacctctggctactgtgaataatgctgctatgaacatggttgtacacacatctatctgctcaattccctactttcactttttttggtatatacccagaagtggaattgctggatcacttggtaatcctgtttaattttttttgaggaactgtcgtactgtttagtatttaattttttaaatatatgcactttatcataaagagcagttttaggttcacagtaaaactgaccagaaagtacagaagtttcccacatgccccctgtcgccctctgccccacaagattcagttttataggcaccctactcactcggtgactgaacgctcgtccaaagacatggggagtgatccaggcaggtcctgccagatccagcaggagcctgaagccatgattcacctaaggagtcatgacaacttctttccttcctgacctgtagacaggaaactgactgacagcaaaggtcatcccacaggaacactggatgtgtaaacgtggagatctgcggagtggcagagcaggagagggcgctaaggggcatttgatccaacctccttctttcactttatggtgaagatgtctcataaactgataaccttccttccaggaatgcagtgcagaataaactagtgcttgttggagatggtatatttttgagggtggagtaataataattacatcactcacaactctatcagccctaatcccagccctgttaccctttgggcagcccccagaaggcacctctgggttaattccattatagatcacttttaacacttactggtttttgtcttatttttctgatattgggggttttattttaaacattttaacatatacctactgtacatttaagtctatctccaggatttttgactctattaatgttgaggcaatacatatgttctttctttgcttggcaattgctttattaacagtgattattctcaactccagagagttataataagagaactgtaaatcctaagtgctactctgaatgataacatctaccatatccaagtaaaatgttataaatcacagtgcttatccacagatttaaaatgcccagaaatttctcaaatgtttcctggacagtatcactcatactatttttacactcacatcgactcaatgaaacaaaagaaaaaatgctgtttcaaattcctacagtcaaagctcagaaatatacaatgcatatatctattcacaggtacacatgtacatttgtatgtatgcttacatgtgtccaaatgtacatttgtttagtcaaactcttctacttttttctattaacgtggaataaattgttcttgtcctcagcagttaggcaacgggcctgttcgaaagctaacaccacaacatgatgattcacaaagtttttcagtcttgagaacttagaatctcacaaaacctggacttgctggcttgagttactcattggaggtgtgcttcccttcccatgtgtgtgttttttttttatttttaacttttgtgggtatacagtaggtgtgtatatttgtggagtacatgagatgttttgatacaggcatgcaatatgaaatgagcacgtcatggagaatggggtatccaccccctcaagcatttatcctttgagttacaaacaatccaattacacattttactataaaatgtaagttattattgactatagtcactctactgtactatcaaatagtgggccatattcattctttctatttttttttttttgtacctattaactatcccacctccatgccctgcccccaacccccactacccttcctggcctatggtagctatccctcctactctctatgtccaggagttcaagtgttttgacttttagatcccatgagtaagtgagaacatgtgatgtttgcctttctgtcccacatgtgttttgtaaatcaaatcacatttaagtgtgtgaggggagggataatgctatgatgactcactctgaaagggaacaatgtatttcccaactcaggggaaaaaagattttctcttttgagtgtgtctaaaagcatgatgagcacacctgcaaaaggactgtagctgttgttttagcctaataacagcactattagtcacacttgttgaaaaccaggggcaaagaatggctggtactagcagctctggggtaaagctggcacagaataatggcatcaactgggctggacttccaaatgtgaaggtgctaagtgaaccttaaaactcttttctgagacataagtcagtgtattaagcaaagcattaaatttcttaatttaatgctatttattactcaagtatatacagttttctacctttttcattatttcaagcacatgagttaaagcagtgattctcaaattggggtccctggaccagctgcatcagcctcacttggaaacttcttagaaaagcaaattcctagcctgtaccaaatctactgaatcagaaatctgagcttgaggcccagcaagctgtacttcaacaagccctccaggtgattctgattcaagctgaaatttaagagccactgagttaaggaaccaccaatatacagattccaacctttgctcaatgataactctccagctcctttgttaaaaaaaaaaagtaattcatgtgtgcttgggctatttgttactatcacctaagaaaatatttatcattgtttaattaaggaaaataaaccctggtcaaaacttacatgtaatttttccaggtcctgtgctgccttcgagtcttaggatgcagggaactgggcgaagggagagatgagaaggctctggcaatccattcagacatggaccccaaagttttgtggggcaaccttgtgacaggtcagtgagtgtccacctaattgggaaggaaaagttgtccattagcagatgaaagtatgcatgtgaatgtttccccctctctcctgctatctcgccatactccgttctgcttgttatgatctcacacaactgtctgtgtctctggctgtcggcctcttgaccaatcctcatgaacagaataagacaccatagcccgtggtagaaacgcctgggctctgcctactagaagccctattccttgaggtatctcctttaggtgagcagccctcacgaggggctctcctgaatccaaatgcagcctaggagataggtccatgtccagtaagttatcaccttctatatttcatctcacgttttctgtcagcaaatcagaacaccttggtttaaaagacacatgtggccattgtaaatagaagagatttgggaagcaaatgatttaagaattctgaccgaaatgagatgattccctgatgcctcaaatgtgtttcgttttaaaattaatatttattttttcagataacttaatacatgcttattgtagaacatttgaaacatacagaaaaataaagaaaaaaataaagatcaatggtaaccttgacaccgataaatcactaatgatgttttgttgtatgggtctgaaactccttcaccgaaactcttggggccagatatatttcagaattcagaatttttggattttagagatgcagctaccatttattacattagtatcttgtgagagtatggagcagcaccctataatattaaatattaaacattaaatatttgtgcacaaaaatagatgcatattcttattaagtgggggtaaaatagagcctcacatttgttcaggccaggttttcctaccaaagaagttactaaaaatagaacaaaacaaaaccccttttgatttctgaaaacttttagatttagaattagagataagggattgtgggccagtattcttttcagatacatgcacatactcaaagtattgcttctactttttcattcaattctgaaataaaatgtgagttatatgaatatgagtatttccccaagttattaaaaattattcaaaacatgcttttgaatgttcatgtgtattataccccatagaaatacatcttatgtatttatttccctcatttttggagttgcagattgtttttttctttgttattgtaaataacactttaggggatatttctgaatatcagattgtcttgaatttctgaacattttcttacgcaggttcccagaaaaggaattattgcatgaaagggcataaactttgagagtcttgattttctagaaagattgcaccaatttatattttttttcagcagcatgaatgcctggttaattatgaaccttatcacagacagagaaaaatacacttgctcctcacgcaacttaacaaaattctaatcaatgatgatcaaatgtaagatattttatttttgttttccttacacagaagatagtgaacagcttgctgtttttgacatagcaagagagaaatggagttaattttagtttaccatcaaatgaccctcattaggccagactgagttagatgtggacagtgggggagctgtgacttgtccatggggtctccacatggaaaagcatgtgagagaattcagaaataattcccataatatcgtgagaagaaaaaccactgattatttgtgggttgataattcatcttctagagtagtgaggccttgtattttccttccttctggggttttcctatttcttggacattttgctcttcctcaggatggcatcaaaaagcagaaaaagatgcaaagacaaaatcaaatcagaatagctaataataatggctaacccttatgcatgattacagtgtgtccactccaatgccaggtccttgtatgtattatctcatttaacgccaagtgcattggtaacaaaactggtggctggcaagtttgaaagtatgtgcccactcattggtcctccttattccccaataagtttgtaggaatttgggcttcagaattccaaagatgtattcaagcctagtgtctcattactatgttgactcattgcctagctatatatcacaagcttgatctttccactctttggtcagtaccatctatagcatctaaacgaagcagagaaagtctaagaaaattctagacaatagtaaaccctttgaaagtcctatattgacacggggaaggctatagctctttgagcacaatagagaagtgtgaggtaagagtgttatataacacaaaacaggttatacatggagaaagacatgaagacacagataaaatacacacttgaaaaaagaaacatacaaacacattcttcccaaatgtggctacgaattaggaatgctaaagcaggtcttacagccccaggttcttttagatttatagctttttctaataatctctctttctctttcccctttatgtatatttaaccttacaggataactggtatagagaatgccacaattttcatatgctaataaaagcaaactgaagtgacgtttgtttgttatattaaatgaaataacctcactctttcacttatgtataaactcaaatttctgcacccactaatactataagatggttatggtttgaggagtggggggtgcaaaaaatttcaatcctattttgggagtgatttaaattgatctttcccaacaatcttatctaaaaataaggattgtttctatcaaaatgatcaaaagaccaaagagaagtggaccatttccttcactgtggctttacttcataatttaagcatcattttcctgataattaggtgtcaacgcagatagaatagcttataaatgatttttctttgccacattcaggtatatgcctaagtttctaagcagaccagagctacagggagtgaaaaataaaatggtaatagaagaaataaaccctcaaagagtatactttgttttttccaaagggcctaactgcttcaggggaaatacaaaaaacaaaccaccattaataacgcaaacgattaccagacactccttggatactcaaactgtacaactatcattgcaaagctaattacaaatttggattctctcattttaaaaatatacttcgaagcaacccacttctgtttcaatgctgaaccaaagtctgtgcaattggcacactgtcaaagtaaaaaaaaaaaatatatatatatatatatatatatacacacacacacattgcatcacttgcacttgaacaaagttattactttcaatgtcactaaatcctgaactgcaaaacaccgcaagctaaaagcaagtaatgccacatggtatattatcttacatttacaaaagagtttatagttttccaagccacagagatacagactttcccactcacagtagctttgttatgctgggcaccccactcactgcctcggagcctactacctctcacaggttcttgtggggatcacatgagaatgtatacagaattttttttgcagattataagacatacataaaatattaggtatcttttttttaaactaaacaactttgtgaggcataaagatattaatcgccatttcatagtttggaaaagaacacaagaagatgtaacaaaaaaagtactaagttagaagatctgagttttatttctaaattggctacgaactagctgcctgactctctgggacttgatttcttcagtaaaacaagggggttggatgaaatgactgtaaggtcttttggaagccaatggatctgtgatgtaggacgtggccatggtagtgatgggagtgccttaggaagtaatccctcctggaggccaaggaaccatgaggccaaaggtagcatccatcaatctgaggcctgcagtgctggcgcagagtccttgagcagcccccaactcccagagatgagacagacattaactaactcattttgctggactgaggggaggttggtggaatcctaaaggaatggccagggtgtcttgggcattggaaagaaataccgaagaaacttaggacagcaggtctttattaactggtacaggtattttataactttaacaactggtatagccaagtaagtatataccagctgtcagtcttgctaacagttttactgttgtttgtctatcagtctcaaagagacggccaccactgagggccaaccaccttgcttggctaagttcctacagcatggggggagatgtgtaagagggctctttttggtattatgagtgcacatcagggtcacatgggaatttgactttaaaaagacactaacttaggcctctactaatgctattctactaacactgtttaacacaactttctgtaatgatggaaatattcaatatctctgctgtccaatatggcagccacatgaggatactgagcacttgaaaagtacctagtgagagtgaggaactgaatttttaactttagtcaatttaaatcaactgaaatttaaatagccacatattgttagtggttagctgattggacagtgcagccctaggtggcttcacatattagttttcttggacctatttcagactccagaagcccacaggacaatacccaatatagtccttcaataggtattcactgcccttctcctaggtgctgggccatgtttaggtgtctcagaacaatggtgaataagagtaccatggacacttcctgccttgtggcattttgcggctagattgatttccgaagacctcacaaaatcttgaagtagctcaccagactgctcttaggaaaaggtgggtgaggagatatggtaatgctacactaagcatgaaagcactgctttttcatttcttcgtatttactgttagagaagttgggggaaagtttaaaaagaggtatctgaatggttactattcattctcttacaagtaaagtaacatatcccagatatgggaaattatctgtaggtaactacctcttgcataatcttaaccttacttaaaaagaaaagtccgaggaaccgcattctgaagctaagaaaagtaaatggtattcaattacagcaacagccgtagaaaaagtacaagtgggtctccagctgcaaatggtgggcaagggagtgttcttaccaattagttgtgaaatgatcaggttttctagaaggtactttttgtataagtaaggctgattgaattctttatcccaactcaactcttagctaggattttcttagtggctttaatgggatttgatgaggaaagccccatttgcctgtccccaggaaactacaggtgaaaatatttctatttacattacaaatctaataccaagaacataatttctaagaaacacaaaagtggtttaatgatctgatttccagtgttgctctcaatgtcctcctgttgtcaattctctcctatcctaatcacctcttcctaccttattgggatctggagtgacagaaaaaacacaaaacatgatattcaggtttgaactgaatccaggtttgcctaaacttcaaggacgggacactgcatgttgggatacagaatttttaagctaattctctccattgtattaatattatcactggaggtaaaaaatttaccaaataaaacaatctgattttgctcagcatcccaaggggatcatgttcagcatctcaatgggaatgacaccagtcagccaatctttcgagcttcaccatgccacttctggttcccctgccctaagtcagacttttgatttttagggctaataagtgactcttccacaactatacacacacacacacacacttttttcccctctggattgagtagaaagacaatttaatacaatggttagaaaacaaaataagacttcaaaacttagttctaaaaatacaaattgcatttagataccattatcttctttttaaaaaggtcaaatctcaaacgttcagctggttccaggctatataaaaatattactgaaaatctgatgacagctttggtaacaaacatcttgagagtggccctgaaatccttatttatattcagaaacactaagtggagtagtcgcacgccattttatggctgaaggggttcaaaaggaaagaggtcaattgatgttaattgttaattttttggaaattcagagatgaagttttttttttttttaaactcttatctttcaaacagaatttaaacagacacttgtataaggcagaacccctttgaaccacagatcttgtggcttttgtgttttattctactggcatggaaaggtgatgaaagaaagtgggcttttttgctgcaacagagaaagaagtggggagggagatgcagttatttcagacaggatggcgaacattaattgagattaaacagctctgaaagtttccacttcaacatttcaggttctgggactctagctgaagaaccaaagctagaaaattcacttatttgacattcaaggtgtttaagttcccaaatacaacaaagaggttatcagattttcacttctatcataaaaggatggtgcaggcagaactacttgccactaacaagccagaaaaataaaaagtgtgatagaaatgtgttgaaagtacataatttgaaataattcttggatttctgcagactttatacataaaaattggaatactagcctgtattgatacatcatcaccatcaccatcatcatcatcatcatctccaccaccaccaccactgccgccttcatcatctccatttactgaaaatatctatttgctaggaactgtgctagaaattttacaggaattattagcctctctggtacatgagagaaccctgactcagagaggcaacgtgttttgcttaaggtcatactgctggagacaggacaacatgcaatctgaatccaagctggcctgtcaaggctacctcctttcctgtacaacactgccttcctctacaatgtggggagactacatccttcttctgcgaaggaaacatgaccactttcccatgtgccaccagtaaaacatgaaagtaaactgacaaggctgcaggtcccacagcaatttaactatttgtatgaagagttttagtgctaaaatggttatagttcatgaagcataatttcttacttgttatatatttcagtgtcgtttctgtcccttgactatgcaaagcccttgcctggccttgccacctgcttctctctctgcctagaattccctcccacaacccttagccatgctggttacttctccttcactaggtctagttcaaatatgtcacttgcagagacactgtccttaatgtgctctgtcctctcccaaacagctaggcattgccctgcttgtttccatcaagggataaccaaaatccacatgtttatttactgtataattacctatcttctctcttggtccatgtaagacccacagcagcagggacctagcttctcttgctaaccattgatacctgacacttggaatagtgcctggcacaaacttgaatgaatggctacaccaatacatgaatgaagatcagtgtttgcagagtacagtgacaggtacacatagaggaaccagaggagagacattgccctggggatctgcctttgccagccctcgagtcctaggccagagttcatctgctctcagcttgaaccctgcctggagactgagcatacacctgcacttggcccttggccctcttctcctgctgcacctcctgacatagcctcttcttccccaacagaggctcttcctcacacgatgagctcagcttctctccctggatctaatctctacattcccaccaccatccacctcgtataaaaatcaatcgtgcttacttctcctgtggtcacatacccttcagataatctggggccacggccttgggttccatcacacccataaccatgtggcactgtcagggctgactcctggcttgttgcatgcatccctagtccagcctgacatccagcaccaggctctttcccagccttctgtcctgagccacctcacttctttctcctgtctgccctctcttcccaggtccaagctcatggatgactcttggcaggctggggaagagaaagaatgtggaacagaggagagagaaagtcagaagcagcaaaagctgctgtgtgtccacatgggaagcccgtggactacatctgtccacgagaattttcatagtgttctatagattttttttaaaaatagtgagtttaaactatggatcagcagagctgaaagggaccttggagatcactgagtcccactgtctcactgtactgttgaaaaaccaacatgtgagtaatggaccgaggaggaagaaggcagcatttgtggagggcttaacatctgctttgggatatagggtcccaggtcccatagccagtgagtggcagagtggggaccatgcaatgcttaaatgagcacttctaccccatacacactttgccctacgacttacatattcataccacgtgtgggaaagggtgtggcatttaccacataaagatacttggaattcttgcctcaaagggtaagtgggttttccttctgtattagccgatatactttttaaaaattatggtaaaatatccaaaacgtacaatttaccactttaatcatttttaagtatacggttcagtggcaccaagtacatttgtttcgttgtacagccttcaccactatccatccaatacatttttaaagtgagtattttctaaaactatacatccaaaacaagagtgaaggaaacaaaaaagaagtagaaagaaaagacaggtagaaaataaacttttgggcatgcatttcagctgacaaaaacctttcatacgaattagcttctctgtgacatattcattattttcctagtaatgaaacgggaactgtgagacaccatgtgaaaaggcggcttttattgtttctctaggttctatactagctgtatccgcttacaaaaatgttatacaacccagtacatcacagccttccacgcctcctccataaaaggacaagtaaaatagtatttcttggaaagacaggcatttaccaatgcactgcatctagatggagctgtctccatcattctagtctgtttctaaacagggttttaaagtcttggcacagaacacaaagaatgtcccttagctattcagcatttagttcagctccacaatatatttagcaagatttctttgccccccccgcaacccccacccttcccttcttggtttaatgacctcaaatgtaccaacatcctgtcttacctaatcccctaacaagttctatcaaatgccaggacagaatcagacagcactgcaggctgtgagatcattcactaagaattcatttttattccaaaaattaggagtgccagaccatttaacacaatctatcacacagccagaaaattagcctagcgctttaagagaaacatttaaataacttttaaatatcttcttcctgacatagattctttaaaaacctgaagactctctccccagaaccagacgcatagacacaaaacatttccacatgatagcaagagctcaaggaccctttgaagacgatgtaggccccctaagaatccataaacctcaggttaaaatctcttgtaaaagaactccagtacttctctttgtctacaagcccctgtactggatcctgatccatggagcatccagggtaacttcttctggggccacttttgtctctggatgagaaacgacttgtttcagcttccggaacacccctacgtggcttctggtccaactgactgtcaacacggctaggcctctccccaattcagctggctactctgggaacgttcatttctcttactggtccatgacatgctggctctaccccagtgttaggttttgcttttcaattggcaatcttggatcctgtggtcccttctgtcttcctgtcactttccttgtggtccttgtggaacttttgttttaaaaattaaacctgttttttttttctttatcataaaagcaacggcctcccgtttgcacttaattcctttgttttttctccaaaagcatacttcagccttcatacctttgttcttgggaagactttgcccacctctctaagtggcaggtcgtgccactctctgttcagttcgggacagggtttctcctccaggagaagtgtggggcagtgaattaggaataagcctaaagtcagagagacccaggtctagtcccaacatagctgactttggccaagcaatttgaacaaaggctcagtttcctgatgtgaacaaacaaggaagattaaagccaacatatgcttttgttttattttttttagacagggtcttgctctgtcacccaggctggagtacagtggcgtgatcatagctcactgcatcctcgaactcttgggctcaagcgatcctccggcctcagcctcctgagtagctgggactacaggtgtgtgcccttaaaactggctatgttttttgtttttgttttttaaggaagactaagagagctgatatgttcacagcttctgaaacacagaaggtatctagtaaatggtgatgatcatttcattcccttctaactcttcacatatgggattcagcatacattctatattttagaagcaactcctgctgctttctattaggtggccaggaccacttacgtttggaggcttaggcattttttaacaggtttattgagatataatcagcatatcatacaattcacacctttaaaatatacaattcaatgttttttagtatattcacagagttgtgcgaccatcaccactatctaatatcagaacatttccatcatccaaaaaagaaaacctacacccatagtagttactcttcatttcctttccccttcaacccttggcaaccaccaatctactttctgtctctgtggattttcctattctacacattttgtataaatggaatcatctattatgaggccttttgtgtctagcttctttcactttaccatattttcagggttcacacttgatgtagcaaatgtcaatatttcatccctttttatggctgcataataatcaattatattcatctaccacatcctgtttatccatttatatcagttgatggatatttggattgtttccacattttagctattatgaataatgctgccaagaacatttttgtatggttagacatatttggacatgttttcaatttacttggatatatacctggaagtgaaatcgctaggtaggatggttaattttatgtgttaatttggctaagtcaccataccaagacttgtggtcaaacatgtttgggtgtcgttacaaaggtgttttttagatgagattaacatttacatcagtagtctttgaataaagcagattactcttcatgaggtgggcctcatccaatcagttgaaggccttaagaaaaaaggctgacctctcccaggaagaaggaatactgacagcagactccctttggactctaactgcaacatcgatgcttctctgggtctacagcctgctggcctaccctgcaaattttgaacttgctagtctcctcaatcatgtaagccaattctttaaaataaatctgtccctttcctctctctctctacacacacacacacagacacacacacacacacacacacacagacacacacacacacacacacaccctctattggttctattctctgcagaaccctaactaatatactgggacaaatggtaactctgtatttaacattttgaggaactgttttccaaaatggctgtagcaggacaatcccaccagcaatgtataagggttccaatttctccacatcctcaccaacacttattactgtcttttagactttaaccatcctagtgggggtaaagtggtaactcactataattttgatttgcatttccctaatgaccaatgatgctgaacatcttttcattcacttactggccatttgtatatctttttctgagaaatgcatattttagttgtccattacttgtctgggttgtcttttgagcattgagctgtaagaattctttatatattctggatacacatcctttgtcagatacatgatttgtaagtattttctcccatctgtggaccatcttttcactttcttaatggtttcctttaagcatgaagtttttaattttatgaagtcccatttatctaatttttcttttgtcttttgtacttgtggtgttatatctaagaatccactgcctaacgcaaggtcacaaaaatgtatccctatattttcttctaagagttttagaatttttgcttgcatttatttttgtgatccattttgagttaatttttgtatatggtgtaaggtataagtccaagttcattcttctgtgtgtgaatatcctgttgtcctggcactatatgttgaaaagactgttctttcctcatcaaattgttctggaacccttgttgaaaactttgagcatacgtgtactgtattcaagactacactatcttataggatgttttgaaaaaaggaagtgtgagtcctccaattttgttcctcttttgcaagattgttttagctattctgggtcccttgcatttccatatgaattttaaaatcagcctgtcaatttctgcaaaaatgctgcaattttgatagggattgtgttgactatataggtttggatagttttgccatcttaacaagtcttctgatctatgaacattggatgtctttccatttatttatgtttccttaatttctttctatagtattctgtaattttcagtgttcaagtcttgcacttcttttcttaaatttattcctgaatatttaattatttttgatgctatgtaaatggaattgtttttgtaatttcatttttcttgctagggtacagaaattgatttttgtagactgaactttcatcctgcaaaactgatgatcttattattcattctaataggttttttcgtgtgtggtttattttttcttctaatgaattgcagtcaagtatttttaagtattctgaatcacaggaatatcctggcacaaaaacccatgacttaaaacttcactataaatataaggagctcatactattatttgtccccttcctgtggcattgggtaatgatcctgcttttgggttatggtcttggtggcattcctactgctgctgacagcccatataatgatttgaaaagttcctgggactccaggatacatggtgagacacgaatctattttccatagaagtggtattataaaaagaggtcaggtttccagcctatccctaaagtctgtttaaaggggtatcattcattgaggatgccacagggtctggcctcgccattctcaaagggaatctaaagggtttgtttcaatgaaaaaccacattctaaaggagttttgaatgaacctttcaaaaagtgccctcctgggctgggcgtggtgactcatgcctgtaatcccagcactttgggaggccaaggctggtggatcacttgaggtcaggagttcaagaccagcctggccaacatggtgaaaccctgtctctactaaaaatacaaacaattagctgggcatgatggcgggtgcctgtaatcccagctactcgggaggacgaggcaggagaatcacttgaaccgaggaggcagaggttacagtgagccgagattgcgccattgcactctggcctgggcaacaagagcgaaactccatttcaaataataataataataataataataataataataataataataataataaaaataaaaggaccttccattcagttaggacttcttatgggcttttatgtagacacctctgctaacctacttcttctttccaactcagggctgactcctaatatacaatactttgaggggcagtggtagttaccttgcacaaaaactgctaaatttgacacaatacatatatatatatatatatatatattttttttttttttttttttttaccagactatattttgcttcaggttcaaaaactgatttctagccagcattcagagacctactttgcatcttgatccatgagtcactgatttgagcatgcatttgcccagaatacccaggcatgtgaaaggatcaaaatatcacactttgattgatttagaaagttattttctaccaccatgcagtctgagagtttctatgctgcatctgactaattggggaggtgtgggagcagagagagccaggagctgctgtgtggaagaccttgtccctcctcccaggcaccaagatcccagggagtagcaaccctgctctccatggcgaagtgtgtccgtgtgatgctcatctcagcattatctggttatcggagtcatcttttgaagagatcctggtatttcggtttgacaaaaatcgagaaacaatttagaaagaaaatcggatttgtgtgtaaatgaagaatattcctgaaaagaaactctgttacgaaactgaaatctggagaccgcggtggtgctaagttgagtcatcagttccctttacgccctaataattgacggcactttgatcacgatgactgctctgggtgatgcttttttgtttgctttttaaagtacttccttgtgtaaacaggttgtctcactatcatcttgaaaacatgtttacgtttgggggatcatggggaacatctgttagaaacagatttcatgcttttctgtcaacttagggaagtctgaatcctatttcttggtaatatacaaaagctcttggagagttaaatgaagttctactggaaaaaggactgactggatattttgattgttcttcatatatgtatttacaaatttgtcctgaaaacatccatttgaaatagaaacaggcatgaattattgttcactttttgtagatgcagacaatgaagtgtagagaagtgaagtggcctggtcagtgaccgacaaagtggcaaagagggggccaaatgcatcacagggacatactgacccttaatcagcaccaaataaaatccgcaggtatcaagggtcccctgatattatttccaaaaagatgttacaatccttcacaattttattgagatcactgattctggagaaggcaaatattagggctgagtgatgtatcccccaaaagagcagtttctttgtccaggtctcaagttagagatctaggtgtgtgtggagaggtggggtgttcagagggaacaggaacaaagcttgaaggagaggctgaaccaacaagaggacttcaggcaaaatactttactgaaacctcaacagtgaggctgctcctgctgtgcccagaagcgaggtgctcctcttggagggtgtgccaactcgctctggcccttggagttgaggcaggagcggtttctgtgtgaagagaaagaactgctgtcatgaaaaaatgggagatgctgcagattttatttaaatgcccacagacagcacagcccctagacccaggcaaggaaggactctgttctccttcagttaggccagggaggcattgttccccatcttgccttatgatctctcccttaaactcttccagaatttcccacccaaatggttccaagtgagctcccagggtcagtgtatgccctttccctcggtccttcctccctttggtgggctacaccacctgaagggtgagagaatggccaagggcagctatttacagagatatgcatgtatcttggacatgtgggctggggtgtccatgtgcatgtttcaagacccctgtaggatgggggactgggggagtgggaggagaaggagcaggaaagaaggaagcaggtaggtgtatgctggtttcccccatactaccatgttcccatttggaactctaaggagaccgataattctaaatttaaatctggccttccgaaaggtcattacatcaaggcagaaggacagaatgtattttatacaaccagtttgttagcctgattcataaattttaatatttaagcatacagcatatgagcttcaattgtgcctttgtctggagccctacaaatattacagccagacctgtccagagccatgtggatcagggctgggaaggcttcagattgcagatgtgcagttatgcattacacaagccccatgttgcattcactgaccctctggatgataaagtggaggtggctgcaaggcatttccagaatatcaaggtgctcacacaacaaaggtttccttcacttgttttgggaacactgtgctgaagacagcttagccaaatatttctctgtttggctgcagccaaatacatcagggtcttgctacaggccaactaagcaaaccataatttttacaaaaaataattacctaacactttcatctcttgtggtttctttattccatacatactttgtaatgtgtttatcagcagctagttgaacaacttggtgtaccagtgggagacaaaccagcagtagttatacacggcaagtaaggaccaaaacataggcaggaaaataaaaataccaatgaacattaggctgaactgtaagacataattaagtagctgtatatcaaatgcataaatatgattcttttttaaaggcccacacatattacacccactttcaggagtttcccaaagtaatttaaaactatttgatgttgcttcctgtttttcagtacttttatctgtttatgggggtggcaattctactgctaaccaaatgaacaagaagaaaagtgaaggatggggccattttcctggttttagtcaccaaaatctgctttaaaagactgaatttttagaccttaaattttaaaatttggggttctaagcttcaaagtaattatttaagacttatcccacattacaactacagattgcaccaacagttttcttagagttagtgagcctcttgcatcaactttgtttcctgttctctccaaagctcctttctaaagcaactgagcttcagaagagggaagaaggaaacagggcagaggggtttgctgacctcagtctgcattcaatacatttttctttttctctttgagacaaggactgctaagaaagggccttttcatattttaaagctgaagtttcaaaaaagctagaacaattcaaagatatttattccataaaattatcctcaggtaccaaaagtagctctggaaaagtggccacctctttttatttggccttcatagctcattattttaatcaagtagatggttaatgaaaagcaaacttacactttccatgaagtaaataaagtaatgtgctgaataatgacatttcagttgataatagactgcatatataatggtggtcccatagattctaacatcatatttttactgtaccttttctatgtttagatacacaaatacctcccactgtattacaactgcttatagtattttgtagagtaatatgctgtacaggtttgtggcctaggagcagtagactataccatacagcctagctgtgcagtaggctataccatctaggtttgcattaggtacactctatgatgtttgcacaatgatgagactgcctaatgacgtacttctcagaatgcatcctatcgttaagcaatgaatgactgtgctattatgaggtgacaggcattttggggatcagctagttcaatgtgtcatcaaagtcttgaccaccaagtgggtggcgctgattaaatacctctaatgagaagaaaggtactgccaagtcaattttggaaaattattatgtaccacatcactgcatacatcattacacagttctctctcaggccaatctgcctccttgtagcctaaaaacactggtttgccctacagggcaaccagaggaaggataacacctacatacatggtagggagtaagtggtggctccgcctcctctctttcctcaagtcttctcgctggatagttgtttctagttccttcaaatgttatttgacatggtttcaggttctctatcactgtcttgggccactgtcctttaaaaatatttaagttctaaatttaaaaatcatcatttcaatttaaaatcacattataggccgggtgtggtggctcactcccataatcccagcactttgggaggccgaggcgggtggatcacgaggtcaagagatcaagaccatcctggccaacatcatgaaaccccgtctctactaaaaatacaaaaattagctgggtgtggtggcgtgcgcctgtagtcccagctacttgggggactgaggcaggagaattgcttgaatccaggaagcggaggttgcagtgagctgagatcgtgccactacattccagcctggagacagagcaagactctgtctcaaaaaaaaacaaaaaaacaaaacaaaacaaaaaaaacaccccatgttatagccaacaatacatttgccaatatatctatcaaatgtgatctcaaataaagcacaattttattactgaagagtacatagaactatctttcaccttcttagtcctacaatgcagaccatgatttcattaatgctttgggcagctacatcacatctctggctaggattgagcttacagaaatgaaacccccaaggagtcttcacatattgctattgtgttttatttcccacattctctatttgtgatttttttttttttttttttagtgggggtgtgggatacaactgcaggtcttggcacttattcctattactaaatgtcaactcacttgggtctcgtcccttgttttcttcttctttcttctgtctattcactcggtggcaaaggagcacatgaaagagaactgtgctcaagggaatttctttttatcatggaactgtacaaggcttacaaagcagtgggcagtcagggtgaaaactaactcagtaaacaataccctttaggaattggctcagtgtgtatgctgtgtcaaatcctgcttggtaaattccaagaggaaactctgaataaatatttaccatatctatttatttctcctactgagaactatataagacaagaggatgttaaatgatgaaacagatttcaggatttttgctctccgctgagtcttgcccatggggcgtgaggactgatacaagtcccagtctcataatgaaaccagacacagttcacttccttttgtttcttaaaccaccccctcacctgggagatgtcttgaaatgacacagacttagttatgtatcactaacctgagatctcaagggaatgattggtattaattatcattagtaataataatatttaatataccctcctgggaaggtggacagcatgtgcttgggatggaatacagccctgactaagcttacctgctcaagctgtcaatccctattgtctcaaaaggcgaaaagagacattttaactccagagccatctcctcttccaattgacataataaggagaggtcaagaagaatctagttagagattagtggacgctgcattacacttccatggcttcctactgaaagtgaactaccaaagaaatcacaaagcactttctgtctaattcttcccttcttccttcccagcttgggaaacagcctgagatcagcctgagatcagacagaggatgctacctcacaagctggttatcaggtgggctctttgcttactgcagcccagaggaagagaaccaaatggttggggcagtggagaatgtctatcattgctctagacttaagatagtgaaaaccaaccaacaacccaaatacagaatctacgcccttcttgtcttacatcctctggaactttcttcaattttagctattccccagttaacctttttattgaggacagagggatgacctgccccattcttgggctttctgtttgctctttcccctcctcaggaatcaatcactattcttgagctctggatcccatcccctctctctcacttagagaatctgtttctgaatttaccttcactgtccctgggacatcaatttctctctcctggaccatttccactggcatatcttaaatcccttcttgatgccatcgcttcctccagaaccaatccctttctctgcccctgttctgaaggaagaccctcaaaatagttgtctttacttgctgccattatttcctcatttctctttctttccttaacctgttgtagatttttttttgtcactccagagaaactgcttttatgaaggttagtgatgatctccgtcttgccaagtccatgctcaactctctattctcatcttacaagacttctcaccatcacttgactcagtcgtcaacttcctccatgaaaccacttcttcttgtggcttcaggggcaccacactgtcctggcttctcatcagcttcacctgtggctccctcctctgcagagtcctcctctgctcctcctcctctgctccccatctaaatgctggcgttatcttggagctccatccacggactttctctttcctctaactatactcactcccaggcctgtggtttttgtcacctatatgctgaagtctctcaaatttattatatgttgcccctgacctcttcctgaatttccatatccaatttcctactcagcacctgaacttgtatattcaacatgcatctcaagtataacatggccaaaaaaacaattattgtttccatcctccctccaaacctgcttctttccagtctttttcatcacagctgcttgggacaaatatctgaagatgaatcaaagagaatatatagacttccatctgccctgcctccataatacatcttgaaatgaaccactttcattagctcagtgtttagacatgttggtctgaggactcctttacaaccttaaaaattaataaaatctccaaagagttcttgattatgtgggttatagctattgatatgtgccatattagaaattaaaacaaaactttaaaaaaatagaattcattgtatttgaaatacaataaaacattgtatattaacacaaatcacatattttatgaaaattaatacattttacaaaacataagtgagagaattaacacttttacatttttgcaaatctctctagtatctggcttaacagaggactgctggattctcatatctggtactaccttcaatatgttgctctatggtgttttgatggaaggacatgaagaaaatctagctcacacagatacatagttggaaatgggtgaagtattttcatcatcttttgataactgtggatattctctgattctacaccagaaatcaacaagtggtagcttttaaatgtggagtctgaaatgtggtacctgaaaatctgtcaataaactttttttactttgttaatattaaaatctattggtctatcttgcgctttgaatggatttttcacctgtgcataattttataacattacccatttggtcatttggaaatacttgttcactaagttcggagatctttgagatcttttgaatgtttcacatttcatgatccaataccaaattctccacattcattaatatcaccatcaatctcgtcagaaaaagtccttaatgtattgggaagttatcaagctctacagtagcagctatgtgttttccaaaatcctaatttttgtctcaagctcaaattttgtcattggcaacaaatactgtcagttgtttttcttgaagtatcagggcacttcattcatttttgataaaagatctgtcaaacaaatacccaaattggagtaactagagtttgtctgttagttgttcttttaagtcatattggcattccatgaaaaaagcagccagttcagcttgcgactcaaacaactgcacacgggtttttcctggagataaccagtacactctggtatacggtagaagggcttatgtgtccttcccattttgtcacacagaatattaaaaagacatcactcaagagttgagatttaataaaaacagtaattgttactgcttcatacaggatattctgaagtgaaattggcattctgttctattgtaagcatgtgctggtgaagaactagcagtttggtaccactatcttgtttcgtgctgaggtgccagcagttttccccaccattacatttcactagcagtgcacgtcaatactgcgaaaaagacagacagcatcttggtattactgtgaaaatagttttaaccttgcattccctgataagatcttgcgggcccccaggaacccacagaccacactttgagaactgtggcactagcttgccatcttctgtccaggccaccaccatctctctcccgggcttgcaaaaaagcctccttgatggtctctatgcttttacttttgcctctgtagaagcccttctccacagagcagccagataatcttttaaaaatgtatgtcagatcacatcgctctcctgcttaaaactcccacttcagatgtcccattgctcatagaatagcatctgaggtgcaggcccaagcctgcaaggccctggctgcccctattttctcattcatgcctgtactccttttctttccccttctccagtcacttgacctgtggatctctttaaacctatcctgtgtgctccagcctggaaggctcctcccccaggttttagcaggtagggttctcctcatttaggtctcatctcctgtgttaggcattactcaacctgcccatacacatcttcctatacactgccctcctctggattacatagctccatttattaccctgattgctctcatcgttctctgaaatgatattgttcactaatttgacagctggtttgttgtctgtatttctaaaacagaaagtgagtttccacaagggtaggaatcttgaatcttgtgctatgccatatccttaccatctaagacaatacttggaacacatcaggtgattaattagtatttgctgaatggatgcttctgtgagtgacaatgggtggtaggataccatgcaggaaagctctctgcatactgcaaaatatacacatgtaaggtaagggaaatgatgtgttacaacttgtaattctccgtcactagtacatactttgccatgtcaaatttaagtcatagataacattatcaggctattagtgttaccttcttgactatttttctgcagatcaaacaagataagagtccaagatctctttgtctctccccaaactggtctccctgttgttaatccttttcttctccaggccatcttctgcaatgtatgtcatttatttatttatttttttgagagaatcatatagtggctcctgcaagattgtacacaaaaagatcatccccaagacacataattgtcagattttccaaggttgaaatgaaagaaagaatgttaaaggcaactagagagaaagggcaggtcaactacaaagggatccccatcaggctaacagtgaacctctaaggctgaaaccctataagccagaagagattcacggcctatattcaacattcttacagaaaaaagtcttcaaccaagaatttcataactagccaaactaagcttcctaagtgaaggagaaattagatccttttcagataaacaaaggttgaggaacttcattatcaccagacctgccttacaagagatcttgaaaggtgcacaaaatatagaaaggaaagactgctatcagctaatacaaaaacacacttaaacacacagaccagtgttacttgcaaagcaaccacacaaacaagacaacaaaataatcagctaacagcacaatgacataaccaaattcatacatacaatactaaccttgaatgtaaacgagctaaatgccccacttaaaaggcacagagtggcaagctggatagaaaagcaagacccaatggtatgtggtcttcaagagacccatctcacacttaatgacactcataggctcaaaataaaaggatggagaaaaatctaccaagcaaatggaaaacagaaaaaaagcaggggttacaatcctaatttcagacaaagctgatttcaaaccaacaaagatcaaaaaagacaaggaagggcattacataatggtaaaatgttcaattcaacaagaacatcctaatatcctaaatataaatgcactcaacacaggagcactcagatttataaagcaagttcttagagacctacaaagagatacagattcccacacaatagttgtgggagacttcaacactccactgacagtattagacagatcattgaggtgaaaaattaacaaagatattcaggacctaaacttagcactggaccaaacagatctgataaacctttacaaacatctccaccccgaaacaacagaatatacattcttctcatctccacaaggcacatactctaaaatagaccacataattggacataaaacaatcctcaacaaatgttaaataaccacatactctcagaccacagcacaataaaaatagaagtcaacacaatgaaaactgctcaaaaccatacaatcacatggaaatgaaacaacatgttcctgaatgacttttgggtaaataatgaaatgaaggcagaaatcaagaagtttattgaaaataatgagaacaaagatataccagaatctctgggacacagctaaggcagtgttaagagggaaattcatagcactaaatgttcacatcaaaaagttagaaagaacaaccccaaagctagcaggagatgagaaataacaaaaatcagagctgaactgaagaatattgagacatgaaaattcaaaatatcaatgaatccaggattttttttttaaattaatcaaatggataggccatcagctagactaagaataaaagaaagaagatccaaataaacgcaattagaaatgatgaagagaatgttactactgaccacacagaaataaaacaaccatcagaaacgattacaaacacgtctacacacacaaactagaaaacctagacaagatggataaattcctggacacatacaccctcctaagactgagtcaggaagaaattgattccctgaacagaccaacagtgagctctgaaattgaatcagcaataaatagcttagcaaccgaaaaagcgcaagacctgatggattcacagctgaatcccaccagatgtacaaagtagagctggtaccattcctacagaaattattccaaaaaattaggagaggaaatgtctccccaactcactctatgagtccagcatcatcttgataccaaaacctggcagagatacactaaaaaagaaaacgtcaggccaatatccttgatgaatatccatgcaaaaatcctcaacaaaatacttgcaaaccaaatccagcagcacatcaaaaaatgaatccaccataaccaagtaggcttcatccctcggatgcagggttggttcaacatacaaaaatcaatacatgtgattcatcccataaacaaaactaaagacaaaaaccacatgattatctcagtagatgcagaacaggcttttgataaaattcaacatctcttcatgttaaaaactctgaataaactaggtagtgaaggaacatacctcaaaagaataagagccatctatgataaacccacagccaacatattactgaatgggcaaatgctggaagcatttcccttgaaaactggcacaagacaagggtgccctctctcaccactttattcaacatagcactggaattcctagccagctcaatcaggcaagagaaagaaataaagcgtatccaaataggaagagaggaagtcaaacgatctctgtttgcaaacaacatgattctacacctagaaaaccctatagtctcggcccaaaagctccttcagctcataaacaacttcaacgaagttgcaggatacaaaatcaaggtacaaaaatcactagcattcctatacaccaacaataaccaaactgagggccaaatcagaaaggcaatcccattcataattgctacacacacacacaccaaaaatacccaggaatacagctaatcagtgaggtgaaagatctctacaataagaattacaaaacactactcaaagaaattagagaagacacaaacaaatggaaaaacatcccatgcgcgtggataggaataatcaatatcattaaaatggctatactgcccgaagcaatttacagattcagtgctattcctatcaagctaccaatgatattcttcacagaactagaaaaaattattttaaaatttatgtggaacgaaaaaagagcccaaatagccaatgcaatcctaaacaaaaagaacaaagcctgaggaatcacgttacctgacttcaaactacaatataaggctatagtgaccaaaacagcatggtactggtacaaaaacaaacacataaaccaatggaacagaatagagagctcagaaataaggccacacatctatgaccatctgatctttgacaaagctgacaaaaacaagcaacgggaaaaagactctattcaataaatggtgctgggataactggctagctatatgcagaagattgaagctggaccccttttttacaccacgtacaaaaatcaattcaagatggattaaacacttaaatgtaaaactccaaactataaaaaccctggaagacaacctgggcaataccatcctggacataggaacgggcaaagatttcatgaaaaagacaccaagagcaattgcaacaaaagcaaatattgacaaattggatctaattaaacttaagagcttctgcacagcaaaataaattatcaatagagtaaacagataacttacagaatggaagacaatatttgcaaactacccatccaaccaaggtctaatatccagtatctgtaaggaacttaaacaaatttacaagagaaaaataaacaaccctgttcaaaagggggcaaaggacacgaacaaacacttctcaaaagacatacatgcagtcaacaagcatgtgaaaaaaaggtcaatatcactgattatagaaatgcaaatcaaaaccacaagagaccatctcacaccagtcagaatggttgttattaaaaagtcaataacattctggcaaagttgcagagaaaagggaacccttacacactgttggtggtattgtaaatgagttcaaccattgtggaaagctgtatggcaattcctcaaagagcaaaaagcagaattaccatttgatccagcaatcccattaataggattatagagcattctcccataaagacacacgcatgcaaatgttcactgcagcactgttcacaatagcaaagacatggaatcaacctaaatgcccgtcaatgacagactggataaagaaaatgtggtacatatacatcatggaatattatgcagccataaaaaagaacaagatcatgtctttggcaggaacatggatggagctggaggctatcacccttagcaaacttatgcaggaacagaaaaccaaatatggcatgttctcacttataagtgggagctacgtgataagaacttatgaacacaaagaaggaaacaatgaacactggggtctacttgaggaaggagggtgggagagaaagtagcataactgggtgatgcaataatatgtacaacaaatccctgtgacacatgtttatctatataacaaaccttcacatttacccccaaacctaaaataaaaattaaaaaaagagaatcatacagtggtgttattcttgctacttaaaaaaaggtgatgtgatggcagtgatggtcaataccatatggggaagaccaggtccacactttgtctacaatcaactgctaccacataagtcttcttggttaagtaatttgcgcctacagtgacagaataggtccctggatacacttctatgtagaggtgttctcactaggctgggatgcctctggagcacgctttgatatttgatagatgcctccaggaccaagggatgtcttttttctgtcttttctctgaccattccctatgtccaagtacatgtgcagcttcaacttccctctgtgaaaatgatagacatgggttgctccttctttctctggcacagatgaataatatttcccacactaacttgaagtactgtctatgaattcagccattgttcagaagaaagcactaagggttgggtgtttctcgtctctctggccaacttctcaaggtgcatgcgcccagcactctcaataatctttcaacatggaaatctgatcatgtcacttcccttcatcccactgatcttgggatgaagctcaaatatggcttccaaggctgtttatgagtaggacgctgctccctctacagcttcatctttcaccactcctcctaccctgctctctgctccagccatcttgaatttcaattcttttctcatctgggattgacaggctcattccttcttccctcttccctctctctggctaacgcaacctttaggtgtaagattagagagcacttctcctcagaacctttctgactcttcctgtctcatttacttctttactgttagcttgacttttttttttttttgtaattctatagcatcctatacttctgcaatcacagcatttgtcattcctatgatgaatgctcatttatagcctcctccactcaactgtaagctccttaagggcaagaactctgctcccctgtgcatcactgagccctagcacctagactgctacctaagacacaacaggtgctcaaaaataattatggaattatgaacaaaggaactaatccatgaatcccatcaaagacaaaacaggtaattctagagagtgtatatgtggttagcttttcctttttctttaatgtctttgcttcttcctagttcctgtgcttgattttcagcattcttgtttagcttttacttatgttttggatcaatatacatttctccattattttgtgtttttcgtaccaagcgagaataaactttaccttacctaagtttaggcccttttcctctaaagtctttttcaccttctctgctttcactattttctacttcatcccatattaacaagcatctaacttataaagtattctgcagtgtttattgactataatatttttcatttatgactcattatagtttcatttatgtggctatgttaaagacacttaagtctaatagagaatgtaagggtccttaaagttgaagttccaaaagcaattaaaatttaagataataagctttaaagcaaagccgtctcctatggacatccttcaggaatgtcatactaaccaagaaatctgaaggggaaccatctattattcatactaagggaacagggacaatggcttcacacagctgacttctctttgctactgactagctttttctgctctgtggataatacaaacaggatgaaaggatcttgatactccacaagtaaatatcctttttaagcagatggcttgcaagttaggaaaaaaagttgctctccagtgattaaaacagctctctggaagcccactttattgcatctaagtacattgctagtctcactgggagagtttattcctttcaaagatccagcctctcagctggtaagagttttgataaataattttgttctatctatatgtacctcttgttaatacaggcatatcaatgatcagtactcatgagctagaattgacttgttcatgttcatattgtctcagtaattcaagagacatgcatttgatgaatgaaaatgccttagtcatggaaagaccaagatgcgctcttaagaaaagttgaccatattaagccaacagggtcattgtaagtatctgatgtcaaagtggaataaacaaaggaacatctgttatttgcagttatccaagaaggtggcagcacagtacagtacagtacagtcattaaggcgtgggagctggggtctaaccagacctgggtttggttctaagctctgccattcactacctatatctagaaaatgttcctgacctcctttaaacccaataccataaaatggagataatagtacttaccaagtaagatttttatgatgattaaaggagacaatacatataaagtaaaatttgagcccagtctcaactatctatcaaatgttcagaatattttacctaaattaaatatatgttatcatccaccttcctttgcacaaacatgtgacatgatatcatataaaatgaagactttatttatatgcaagtctttaggtggcacttgcaagcttccatgtgcctatgacatttgggaacttctatctgcatgttgtaggaactgttcatatttatacctctcatgcccatgtggctacattttaaaatgattcagtcatgattcttccagggtctcctgtgggcccagctctgtctttacctaattatgttagtttcaatcgacaactataatacgaagacttaatgaggaacacaaatgagagtaattcacatataccaaaaatcaacttaaacacacactaatataatgttgagaaatgcattatttaaaataccctgtacattatagagaaatgcttatcttcaatcttccacttgctttgtggtgtcagtttactgagctattaatttaaacttaaaagcctgaaatttgaatatacagaatagctgaacagctgcagaaacaaacttataaaaatatatactgttacccagcacataaaaaagcaattatttattgaaaaaaatcagaatttaatattacccagtaactgcaaaagttgttgaaaggatataattaacatttactgaagattcttagggggtaaaaatattttaaataaaacaaatatttagaagttcttagttactagtaaaaacaatctctttaaacataacgttcatccaccttgaaaaaaaatctgctgactgggacatttctagataattttgaagctcaaaaacgccaaatctatcaaaatcagagagttgctcttggtttgtgttgtcacaatctgtgacgagacaatgggtcttgctcaggtcaggggaccattaaggacccaggaaagccagcaaaggactaggagattttgatgtactagaaagacacaggatcaagagtcagaagacctggctctcaccccaactttagctcttgctagcagtgtgactggtctcattcattcattcatctattcatgccagctgctggggacatcaatgaacaagacagacatatcacatatcacatatcacaaagcttattcattaaggcctcaccagcaccctaaaaatggggagaggaccgtagagttgagaagaagtttaaatcaaacatcataggaagaggtccatgatggtcaccactctcatgggatgaaatgtctttggcttcgtttctttattcatagaacatgagtacaacacctgctttctctatttcagcaggtaccaaactctgtgggcatttaacaatgtgttaaacaaatttgaaataaaaaaccctactttattaaaataaaccattaggaaaatcaaataagtacaaggttatcagagcaaagcttgcctagttcacaaacatcttcatggatatgtttaatggcccttcagaggaagccaaatatttgcataaccataagcctccttcaaatatcttgagacttgtcatgatcttaatttgccaaagtgggtccctatctatgtttggcagaaccgttcaaatcatctgaaagctacctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccataaaatatgagtgtgaaaatagttatttgtatgaaaatttagtaaaattaaagaaatgaaagtaagtcactagaggaaatctgccattgaattagatatgattgagacaactgtgaaagattggggaaataataaaaatttaaaatgactttgcagtcagactgtgttgcaagtgtcttaaaaaattcctcacttaaagagactgaaaatggaaatcatgcaataatgtgcatgaaagattacatgaagttccaatcagcagacccaaactcgaagaaaaggcctcgagcccacatcaaaagattggcaaataactgttcatttgcaactttaggttaaatacatgatttaggctatgtagtatctttttaaaaaatgattcactgtttaattgatttttcaactaatgagaaaacacccagtcaggttagctaagagggctctgactctgtaaccagcctggaaccctgggaagctctaggtagatagggttccttcttgttgttttttctgatttttaaaattttctaacttttcttaacggttattatttgcttatttaaataaaaactattttaataaaaagatatatatctaaatttcagctatcttggagcaaaaagcctttgcattttattaattaattaattaatttattttgagacgagtcttactctgttgtgcccaggctggagtgcagtggcacaatcttggctcactgcaacctccaccttccgggctcaagcaattctcctgcctcagcctcccgagtagctgggatcttacaggcgtccaccaccatacccagctaattttttgtatttttagtagagatggggtttcaccatgttggtcaggctggtctcgaactcctgacctcaggtaattcgcccacctcggcctcccaaagtgctgggattacatgtgtgagccaccgtgcccggccacctttgcatattttaaacaaagaaaaaaagaggccaaatatttttactcatgtgttgcttaaatgtttagtgattctgccttttgccccccatttctggtgtgaggctacctatctattggtaagactgttttaactgcagttcaatgaatatgacccttccaagtaagaaaggctgaacctttccagctgtaaaggttgattctggggcagcagaaccctaccatgtgtgacaaggtttccttttactaatctggttctcctcctgtatattttgggaaatgacacacgtccaggcaaagcacaccatgggccaaatgcacatcctctctgcccttaaggggccatgactcaaagcacttcactggggatgcccaggggttgtgcatgaccagacatcggcaaagtatttttgagaaacctcctcctcaactaaaaatacccactgtgagaaatctgtagcgtgaagcaaggatcgagtcagtacaacacaaaaaaagagacaggcttgtggcagtctcagaatcaaacccagttcgccctcccttaccagaacaacaagaacaatcaaaaaaaaggtttacaggaaaggacttcttgaaggcagtaagatgggatacatggccacactcattttagtcttgtcttttctctttctccttgagggctgggatggggaaagtggccccaaatctgctcaaagtccaactgaacacaatcaataatagacttactatgacattttaaaaaaatttctactgagacattagttttattcctcagtaaacacctccctgatttctgcatcccaggagagcctgggcaaagaagagcacaggcaagaagtgtgaatgtgttcagagaaagtgttggcgaggcctggctctcccagcccctctgatggctgagaaaactgcttgacaagagggagacccaccaggacagaagcctgagcttcacagggcagacacattgctagtgtagctactgactgcccatggcaatggttctatttttttcatgggagaccttcctatagttacacataaaaaagagacataaaaccggagaacttaacggcagagaaaagtaaaatggtaaatctagaatgttttgcttaacttcaaaactgttgttgaatagtttagaaggagtagggggttgaattgaggtccccaacaatacaggtgtcctaacttctagaacctggaaatgaaactttatgttggaaaaggaccttcgcagatgtaattaagttgagaatctcgagatgaaatcatcctggattacctgagtaggccctaaatccaaggggaggtgtccttagaagacacagaagagaagacagaggagaaggccaagagaagagaagaagacagaagtggaggcagagattggagtcatttagccatgagctgaggaacacctggagcctccccagaagctgggacaggcaagggatgattctgccctgaagcctttggaggaagtgtggccctgaaacaccttgattttggacttcaggccaccagaactgtgagagaataaacattgttttaaattgtccagtttgtgataatttgttaagcagacctaggacactaacactgaaggctaggacagcttataagaagaccggtgggggccgggcgcggtggctcacgcctgtaatcccagcactttgggaggccgaggcgggcggatcacgaggtcaggagatcgagaccatcccagctaaaacggtgaaaccccgtctctactaaaaatacataaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaccggtgggaaaacataaagaaatttctattagaaatagaaatcttatgtgagaacaccaaaatcgcctcctgatgccccaaagcacaatgattctgaggggagcaggagggagggtgcgactctcctccgaatgcaggcctgggccccaaagctgatgaagaaacccgatggctgcatggggccagacctagtgtgagtcagagtcgccaggggaacttttgtcaaaaactgatatctccacttaagggtggctgagtcagaatttctagaggtcaggttggagaatccatgtttttcaaagtctcccatgtgattctaatgatcttccatccttaaaaatgatgggcccaggtggtctgctccctcccgctttcagtgtttgagaagcagatctgcagctgcagccaacttttaaaaaaacgtgtccaacaggctatttattatttaaaacccagctttattgtttatgtaaagcttgatacagatgcattatgaagtattaaacaatacagaaaagcacaaagacaaaagtaaatatccagattcaccatctcaggaaactttccacgtgtatttccaagtgtttattcacacagagatgtctgtgtacactttaacctgctactcagagtgtggtccacagaccagcagcattgacaacactaaggaaattgttaacaattcagaatttcgggccctgacacagcaggatgtactaaaactgcaaatatgttatatcccttgttttgtaacttgctttttccacactgtaatgtattgtaacctctgtccttggtaataaatacaaaccttatgatctttcttaatatatgtacggtattcttttatgtaccagaatttacttaatgagctctcatttgatgatcatttctagtttcccatttttcccaccattgtaaacaatgctcacctaaaaatccttgagaaagtatctttctgttttgtcattattatttttgggtaaatccctagaagtcaaccagtgtgcaattttacgcacactgatcattctgatacctaatgccagaacaccagcaagaatgcccagtgaccttgcacacgaatgcttgttccctcacactcttgccaacactggaatttttctaataattttaacctttgtctatctgatacttaaaaatgacacttcattgatttttttccttgcatttttccaaaagcaataaaaaagcttctcatacatttatcggccatctgtatttctcattttgtgaactgtccaaagttattttggttgtttaaaataacagttataaaagaatctgtggaattacagagtttagaaatatggtttagtcacaatgaaaagacacggagaagaaaaaaaaggaagagagaagaaaatgtgccataaaaaaagataatcaaaagattagtttgtgtgtttatttatagacaccagttacagcaatccagtgattaggcaaattaatgcagctgtgtatgatcacagctctgggatcagcccctacatccttttcaaatgatgccacctgtcatttaagtattttgcatttgcctttcatgttacatatatttcatgatgatttccattttaaaaaccttcttggttaaccctttgaaggttctcatgatatggattatcctctgccgtcaggaatggggtgagctaaccaccctcccaggtaggcaagagaaacagcacgtttgcctctgaaaaagaccaatcctctccaaacgttcacatcttaggaaagagaacagttgcatccttttcactgggtgtaaaactgcttctctgctcagaaccaatggaaaaaaatgggggacgggtcagatgctgtgtactggttgacttcagtggcatgtgcagaccatgcccattccaccgggcacatgcatccctcacacccccagggtgacctcaggcctgctttgtcacacaggcacccaccttgggctccatacccagcacacgcaacttctctactgaacaagtggcaggggtcttctcacagggcccctggaactctttcaacccataagacaacgccaaatgggtgaaaacccacctcatccacccctgccaccctctagttgctgctttatttgtgaattgagacaaatcagtcatcctcatttgctgaccattctctgcatacagtacagcaagagcactatgccaggtggccaggagggccggctgcagggaaacagaggaaagcgtggagagagaaagtctctaggctccactttgcgatctgtgggatatgaacaggtggaataaggtctttaataaacatattttaggatgttagaacaagcaggtcccattacaaaacctgaaggaaggaatttgaggacaaaaggagaagcatgactttatagaacaggttctatgtaaacacacaaagcacatataccttaaggattgtgcatgctaaaacgtatttcagtagctgctagaatgggaacaatagattattaacatgtttgaaagggatagggactcgggaacacatctcaaaaatgtgggtcagagtcaaggaagcttgctgctacagtgtcaacaatgctctcagtgctactggcagatacggcacgggcagaagagaaagctttgggtctgccacagttacaaagagttgtagacttcaatatttagttacgggatgaagaggggagaaggaacaaagacctttaaataaaaagaaacaaaagagtgaacatgaacatagagctacatgaagtgtcaaccctagtgaagtgattatgttttaactgtgtaaataaagttcaattaaatattcaacataacagcaataaaatgtaaaacactgagaagcatctctctctagtcagtgtttggcagatgtgttgtgtttttgcatcttgctctttatggtggtatctctaacaaatttaagggcaaaagtgatgtagaccatacattctagaaccaattctaaaacagcaagaagtggccagatgcccagtggcttaatcagattcttaattctacacactacatttatcctccagtctcactgaaaatctaacagccgagtggtcaaaagaaaagataaaactgcaaaatgggagtgccacaaatttctgctcctcctactccagccaacttaacttgacagggaggaggcagcctctgtttccttcctccctttaaaggggggatggcaagctgttgacaactcctactgtacaaaagagttgttcacactgcaaaagtgtttactgctcacaagtgacgctcaaaattaattcacagcagcaacaccagcagaaagctttgacagactgtcttatgtgttgacacagttatacgttgttgcataaaaaaaagtaacacacttaccctcttttccagcccatacacactgaagttgctccaaagagagactgtgaaatgcgtctgagattgtaaatgccaccctccaggtaaggatttcccgctccgctccggggttgatggctgcaggcatgagaagacgtggaccccctttttgaggtgaagcaaggctgcgagcctctcccccggcctctgttacaactggccttgctggtggtttttccttcaaaggcatttccctctagggcaagcctcaggcaccagggtgggaagtggggtagagctgtttattataccgccttggcagaaaaggagacgccaggataacagctttctgagacacaaataattcatcttcctcttcctttaaaaaacaataaccctgcacttaaaatggctttgggaggctgggaagatgtgactttcttgctcagaaatgatttacattaaaaaatcagaaagaatgtagtgtgatttaattatctcaagttacctgagatgtttagagttaaaaaagaagccaggtgggacagctagtatttggcctcatgtggaagatgttgtacagactctttggctcagctcggcgatctgctgtggtgtgaggctcttgcgtttgaacagttcctgctgagcagcgtcctctctgagaagtcacgggacttgaaaaatgaagaccgttgacactttaaaggtgcttctggcaattggaagtagccacatgtgtaaaaactacgcagtgcaaggactttctttagatggtgatatgtaagtatctattgaaagtaaggtttgcatggagctaaccccaaggaaaactgtggaccaggattcacagccttcccatgcacttttcccttatgcccccccatctccatttccccagccatggtccacaggtgcccaaagagctcttctggctttgccccttaccccatcctggcctatgcttctccttccctcttattcctcctcagcaccaaactctcctttcttttggtcttgggaaggaagtggaggaaagaatccatatcaagatgcaaatgactgacaatttaaggtattcatcctactaggctttggggattttttttccctcagttttaatttgtttggtggtaagagtctataggccaggcgccgtggctcatgcctgtaatcccagcactttgggaggccgaggcgggtggatcacgaggtaaagagatccagaccattctggccaacatggtgaaaccctgtttctactaaaaatataaaaattagctgggtgtgatggcgggcgcctgtagtcccagctactcaggaggctgaggcaggagaattgcttgaacctggggggcggaggttgcagtgagccaagatcgtgccactgcactccagcctggtggcagggcgagactctgtctcaacaacaacaacaaaaaattttacactgttggtgggactgtaaactagttcaaccattgtggaagtcagtgtggtgattgctcagggatctagaactagaaataccatttgacccagcaatcccattactgggtatatacccaaagtattataaaccatgctgctataaagacacatgcacacatatgtttattgcagtactactcacaatagcaaagactttgaaccaacccaaatgtccaacaatggtagactggattaagaaaatgtggcacatatacaccatggaatactatgcagccataaaaaatgatgagttcatgtcctttgtggggacatgaatgaagctggaaaccatcattctcagcaaactatcgcaagggcaaaaaaccaaacaccgcatgttctcactcataggtgggaattgaacaatgagaacacttggacacaggaaggggaacatcacacactggggcctgttgtggggtggggatgggggaagggtgaagggatagcattaggagatatacctaatgctaaatgacgagttaatgggtgcagcacaccaatatggcacatgtatacatatgtaacaaacctgcacgttgcgcacatgtaccctaaaacttaaagtataataacaaaaaatctataaagggttctggatatcaaatagttttagaaccactgtcccagactactggagccctaaaaacttcattaagtggtttcctacttctctgtcacatatttctttttcttctaaaaaaacggggtacatgtgcagaatgtgcaggtttgttacacaggtgtacacgtgccatggcggtttgctgcacctactgacatgtcctctaagttccctcccctcacctcccaacaggccatggtgtgtgttgttcccctctctgtgtccatgtggtttctttctttttttttattattatactttaagttctagggtacatgtgcagaatgtgtggccattttcacaatactgattcttcctatccatgaggatggaatgtttttccatttgtttgtgtcctctcttacttcctggagcagtggtttgtagttatccttgaagaggtccttcacatcccttgttagctgtattcctaggtattttattctctttgtagcaattgtgaatgggagttcattcatgatttggctctctgcttgcctactgttggtgtaaaggaatgcttgtgatttttgcacattgattttgtatcctgagactttgctgaagttgcttatcagttcaagaagttttttttttgttgttgttgtttgttttttgagacagagtctcgttctgtcacccagtctggaatgcagtggcgcgatctcagctcactgcaacctccacctccagggttcaagcaattcccctgcctcagcctcccgagtagctgggattacaggtgctcaccactgtgcctggctaatttttatattttttagtagagacggggtttcaccatgttggtcaggctggtctcaaacccctgacctcatgtgatctgcctgctttgccctctccaagtgttgggattacaggagtaagccacggtgcctggccagcttttgggatttgttagagtacaccgttgactggtggaattcctgctggtgtgatgagatgcagtgagaagtcgtaagacatcctccaagatagaggaggtctccttgatcagtataggcccatgcccaggatacaggtgacctaggatacaggtgttaatgcagccaccagctaggatgcactggtcctacctgattagggtgatgctgacacaggagctaacaccgaaggagcattttctcttttgcctggcactgtaacatatgtaccacatgcttttacaaatgtggttatcattcagtagagtatgaccctgagcgtgagtacttttagcattctcatttaccaaggtggaaattgaggcttgaagaggttagataacttgcttatggttatcatgctaacagaatagcagaactggaattgaaagccagctgtctggagctcatggacttctatctacctccagtggtttcatcccaataggaaccatcaattgtgaacagctggtacaggccagcaccccctgcttcaccatgggacaatactaagacagctagaggccatactgcagatgcagaggctttgcttacgcgaaggtggtgaagttagaagagcatgaaatctgaaggcaaacaatctggttaaaatcctggccctgtttgttgctttgctttaagacctgcggttaatctgtgaactttagttttttccatctataaaattcatctgatactacctgctttacagagttgtttgtgagaactgaataaggtaatacacatgcaaaatgttttgggaagcataaactcttagatgttattagtgttaatatggtcttttagtgggaagagtcactcctgagagcggaagattgactttcacatcagtatcacctaccccacctgacaaatccaggagtgggctctctggaggaccactggggaaaagggagtagaagcatgtaccagttatcagaggcatttactagtaatagtgaagtttgaccctaaaaaacaacacaagatgaattctgtgacatgtggatgagaaacatgaactttcaatgaattcagaaattccacactcacagcctgcttcaagtcctgtgtcagctgctgaatcagagtaggaggcatcattttcttgttggtgattacacttatgcctttgtacactgccggctggcttcaaaagaaagggtcacctttgtgtagttgactcctcattttgtaataattccaaaatgcagtagcttctcccaaagtagttcaaagacaccaacctgctgagaaccaggggaggccatcaggataccaaacttcctgcttctaatggcccaaatctcagcgaaagcctctgaatagataggcaagctccagaaggacagactgtggtcattaacgtaaccctttattatggcgaatctcaattctttttctacacatgagctcacccttcaaataccacatttatgtccatttttgggcgggctgaactaaagtttaaagcattatgtcattgtaaacaaacaatcacatgtagcgtgactctgtggaaaatacagcatttcaattttgtggtattggttccaccataagaaagggaacccaaatgatgaggtcagtgggccagctgccacggcaaagagaatgccaagctgagcaagctgctttcactcacaactaaaaaattaagctcaccattgttatgccagccaatgaaagtgattgcattcctaaattaagtggaaacagagcttcagagactgctcctccttagtattacatgttcatgccaggaggtcaagaggctgttacttttgctgatgatggacataaccacatccaggcttatcccatttagaagccactgctggctaataaaaagtaaatgaaaacacacactactgtgaatcaggtagcagtaaaaatggatacaacaatgtggtagatgttaagagaggaagctatctaagtcctagagactcatccaaagagtgtaaaccacgctcttctgccaagtggctacgacttctacttgcaagcaatgtagcattacgtaagtcaacctgacttggtcttcgtctattttttcctaaggcagaacattatccttccagcatgcaacagggctggtcataccccctaaacagctttgatcaaatctgggttatataccaagcatcagaaccagcctgggttacataccagccacccctcccaccttcctatgtctaccaatcatacttccaggctcctagacttggagcctcagggtcttctctgattttatctttctggttcctctgttgtcctggccccaccaatattcatattcagttttcaccaacatctcacagattactcctttgatatgtgcccagagtccatctctgtctctttactcttacagtcatcatttttgtgcaggttcctcctcccacccctaccgtggctacaccattacaagaacctctcactggtcttccatctctggtttgtgccccagcaacctgtcagggacaccaccattaagccactgtaatggttttcctgggcttacaaaagggcagtccacaactcagcttgtattcatggcccccaacaacttggtgccagcctgtctttccaatcctatttcccctttctgcctggctgaaccacttcttgagccctgcactgtacccactccctgtatttgcatatcatcttttcccacccaaagtgcccacttctgtccagttacgctccaagacccagttaaaccacatctcctccaggaagacagctctggtcattcctgagaacgtgcagcccagatctggatcactcacttggtgataagtagagtacttccttttgatctcttttatagcacttactgctttgatggctattcaaatgcaaattagttaatttcttgtctcttcaactagatttatcatagctcccagaagattatattttctacttttttatattttctctgcccacctcatcctttgtccttctcctcctccttcaaaacccatgtagcaatcataatattaaataaggacttatttttatctgtgtcctaaggagaaaccaggaaggaaattgaagtgaaatgcaagagtaaactcagcagagatgtaactggcccctctgggtggaagacacagcagaattgaataaacccagaattgagtacatctgctgccagcacatcttcaatgctgccaaatgccctcacctacgttaaatcaggtaatcttaaactcaggctttgagatataattcagtatgtaaggaagggagaagaagaaagaaaataattcctctttagaaaagcattttctttttattttattttatttatttatttatttattttttattgtactttaagttttagggtacatgtgcacaacgtgcaggtttgttacatatgtatacatgtgccatgttggtgtgctgcactgattaagtcgtcatttaacattaggtatatctcctaatgctatccctccaccctccccacaccccacaacaggccccagtgtgtgatgttccccttcctgtgtccaagtgttctcattgttcaattcccacctatgagtgagaacatgcggtgtttggttttttgcccttgcgatagtttgctgagaatgatggtttccagcttcattcatgtccctacaaaggacatgaactcatcattttttatggctgcatagtattccatggtgtatatgtgccacgttttcttaattcagtctatcactgttggacatttgggttggttcaaagtctttgctattgtgaatagtgctgcaataaacatgtgtgcatgtgtctttatagcagcatgatttataatcctttgggtatatacccagtaatgggatggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcattagaaatgcatttttgcccaaacacttcaaacacatgacttcgcttttaatccattttaatttagaaatatttctgtaatacagtatagaaatattttgatgatgtacatcagtgccctgtttgtagtatcaacctaggcatgaagagtgatgaaggctgacattttacaagaggatggatgagaagagtccttcctggtcggatggggttagtgaggcaggagtagcctggagcacctggtagagctggaatcatgggatgtatagttcaggtggtcaggggcctatgggcaagtttcactgggatggtaataattatgcagcagaaacaggcagtgcatagaataatctgaatggtgaccatctccagaatggcagcctccagagtgaggcttttcacagtgcccagtcttcttgaccaaaagtcagggtatttgctagaggagctggtatttatgtctaaatggagagctgtatggtctggttgaattgaagccttgtgcaaataactggcatgtgctttggtcagggcaggtagcctctgtgggagagggtctgacagggctggggcaattccttcccatcaacttaggagggtcatgcctccctgtctctggggccttgagtctttaacagttattgagatctacatggcagatacaggcagagcagatggcaggaaacatgggatgaacagatccagccttagcagtggccctgagatttatactcctggaataattttcagttgcctccttgagtaatttttctcctgccccaatggagtgatgaccgtgcaacagtatcacctccctggcagcatgctaaagccattttcttccgaatggagaatgaaactgaggcagccttgtcctccttcttcaaagtagttttcacatcctacaaacattttctgtacttgttgctaccattgtcctccctcctgacacagccaactaaaaccttatctctagcttcatcataacatgttccctccttgttacctacaccttgccatctatcgctcacattttgagaatctgcaccaagactttagattatgatgcttctgcaccagtaaccctcggctacacttctcgcctaagttttactgaatgcttgacattgatcagaattctgttcacaaacaacctttaaagtaaagcattaggctgggcacagtagctcgcacctgtaatcccggcactttgggaagctgaggtggatggatcgcttgagaccagcctaggcaacagggcaaaaccctgtctctaccccaaaacacaaaaaattagccaggcatggtggtacacgcctgtggtctcagatactcgagagctgagtaggaggactgctggagcccaggaggttgaggctacagtgagctgtgatcatgccactgcactccagcctgggcaacagagcaagactccgtctaataagagcagaccctactatgatcaagattactaggagccttgtattctctttgcattagccctcctcccacttatttcctcactcaccagacattcactgggcacacatcatatgctgactcaggtctcatggctggcggaatgtggatgatacactgagcctctatcatcgtctctgaccctttccactgccgccaggtctgtggccacctccactgctgtttctcaactctgccacggccagctcatcatccctacttcttatcttggctgcttcttgttttctactgctctgcctctttccttctttctcttttgtcacttcacccaagcttcctgaatttctccaaggccagttacccttcctcagacatcacctagccaccagggttctccttcctgtgatcagtcagtcccacgagcacaatcctgtgctgtgactctgcgctgttttgttgttgctcactgctacggctgagtttctttatctccagagatacctacataattgactttcttcttctttttataaacttcagggtcagttctattatggataaataggactattaacactggtggctgctttgtgaatgtaacattatggaaagagcctggttttggagtcagagagatctgatttcaaatccttgccaactgcagcagtagctgcggaatctctgacaaatcatttaagttcttctcagcctcagctgccacactggcaaaatgggactgataattattacctcatatgtttattttgataaggattcaatatataaaatgccttacacatagaaggcaccctagaaacacccctcccctggcccactatttaccttctccttataaatgtgatgcagaaaatggctatagtgaactgttaggaaggagaggggatatcaccggcaaaattaagcaaagctaataataatgaacagattaactacaaatgctacttaatattaccagggctggtgtatcataaaattgcacagattaagatgaaaaaaaggcaaaaattaattccacaggagcagcaaaaagcagtggtcaccaaatgtgaacataacagccaggccctacaataatgagcactaaaccatgctatttttcttttctttctttttttttttttaaatcctacaaagaaataggatacaaggaaattagcatgtgagaaagacttggacttatgtgaagaagctaacagatgtgcaaaaatctagaccagattcccatttcaaaaaggaacttgtagagtcactggacccatcctgacagtgaggcagtcctggtagcatgtcatgtcatcctgtgacactagcactgtgcacatacataaaaaaaaatgtctgttccagtgaagccaggaagagaacagacggcaaagcctgacacagacagaaagagggacaggcttgtcttgactccatctgccatttttaaacccaagacacaataacacctaaggaatactcacactaacatttcattcaacaatccctccactgcatgtcacatgaaataagttagacaagagcagttctgcctaaagtatatgctatctgagaggcatactagttctttgcaaatacctaaacagaactttcagatgtttctgctggagtgagaaaaaacatgtgcatttgagtgtaatgtgatggttttcaactgcttaaagaggccataaatctattagcttgaacttcaaagaaacaaattctgagaacatcaaaaattagggtggggcaaggagaattggatctaactagtttctccgttctttcccagaaaaacaatgagaaccaaaccaggctccagtctctttcttctcccaatttttactacttgccacacttttgaaaacatcttctacatacttctagctctggacaaacacattcttattcaagtttgtggttaactccatgagctcatttttctatgatttgttggacatttttatgtggcttttacggagaacagtttaaagtgaattatctttgagaagcctgtgggattctataattctctggtgctctccccaaccaggatgatttattccaagacaattctaaaccaagaaggaggactcgatgcccagacttctaataagattcggctgctgtcttgcaaagccaggcagtgtgggacagctggatgaagtgagtgggactaggcttagattgactctgtgtgatcagagcaagtgatttcacctctttgggactctgggtttgcaacaataaaacataagaagtggtgacagcgatgacttcgcagattctcccagccctaatactctatgagatcatgactattctaatcataaaacacacacacacacacacacacacacacacacacacagtctctctctctctccctctctgatatgttttctcataaccaaaggctcattctagatttaatcaaagatacaaatgggagaaacatggacacgaactggacagtgagagtccatttaaaccagcagggaggctgggcacggtggctcacgcctgtaatcccagcactttgggaggtcgaggcgggtggatcacccaaggtcaggagttcgagaccagtctggccaacatggtgaagccccgtctctactaaaaatacaaaaattagccatgcgtggtggcgtgtgcctgtagtctcacctacttggtaggctgaggcagaagaatcgcctgtgggaggcagaggctgtagtcagctgagatggtgccattgcactccagcctgggtgacagagtgagatccatctcaaaaaaataaataaaaaataaaataaaccagcagggggatacagacaaatctaatagtgggtagaaaaaggatccatgtaagtcttctccttaaaaaaaaaatcattgaaaaaaatcactataatagcttggagatgacaagccaatatgaattactgaggcgaattcattaaatccaccgaaggacacatcctaggagatagaacatattaaactgagaagacatcttccaggcccacctctccagctctaccgatttcttgccactaaataataactcccaacagctctatcaggaatggaaacaaacacaatgagctggggcatagtaaactcaataccaagaccccactttaatgtctgtatgtatgtattaattcacgtaccacatggttttgtaacaagaaagcggaatgggaaggagactggggtgaagttaaacctgcgggcctcaagtaggacacatcagaatgggagccaggttcatctttttgaaggattgtcctttccgcctcatcatcttcccgtacacatgcactttagcaagaagaataaacaggatatgcctacttgacttccttgtttgctctcagggtgacttcactaaaaaaaaaggcatcaaaggcctttatgaatccatcaccagatttttaaaaagtctgtttacagtgattctatatgcccatggctaaaatctggaatttttctctttttatcctttctccacccttttcttctttctctacgtcttctagtcatcctctgccatgttcctcatgattatgttttataatatttaatgttccatgtaaaaagtggtgtgccttgagctgtttgctggaagagccagacagacctaacacgtgatcataatttagtaagaaaagtgagggagaaggtggggaaaggtcccctgcaggctgtgtgcatgcacagtgactggctccctgaagacactcaagctgactacgtggagctgtcttcgcttatagaccagctgctgcctcatcacctctaggttgccacgccccacttactttctgatagagcagagttcatttgttagttctttatgcaataatctccctcccttttttttctggggaggaggggtaggggttggggatattcaacaaaccaacagtccttcaacagtatttgtgaatgaacacggtaagcgtgattgtgtaacagtgttcggatgtgtccttatcttccatttgaacactaccagttgtacttccacacaggtgggggtggaggtcctctaattcaactaagaaatcccttttagctaatgagactagagaagtaaaatgtaggaaagggaacaggaagataagtggccataaaatctacaagatcattgtttcagacggttaagccagactccagctaatagacaccctccccaaatcagggcttaaataacatggaagtttatttttctcatgtaaaataagtcaggggcaagcagtccaggatgatacggagcttcctcattcatcaggacccaagctcctgccagttttccttcctaccagttctaggatacagtcctcctcctcttccaagtctaaaatgatgctggtgctccagccatcacactcatgttccaaggaaccccatggaaaagggctgaagaagggtgcagtccatccctttaagacttcctagaactctgacgcacacttcttacatctcattggccataacttagtcgcatggccagtgaggctgggaaacacaattttggttagcagctcaactatacaagggattctgctaattggtagacaaagagaagaaagctacttggtgtcaaactagcagtgtctcccataatgaaggctttgcaagcttccttatcttctgaggctgtataatgggaagattagcaacatatgcaacaaatgggaataaaaagaacacaattacagtaaactatagtaatagtattccattgaattgaaggaaaatgatagatttttccacctcaaaagacacagggatactttctaatgatttaatgtcattcacaggaaaagggtaatataccacatggtactacagaaacactttggctgagcccaggtggtagcaaatattttcaatcaataggtttggacagtgaaatagacatgaaatcctctaacttgtatttaatactaattcagacatatgaggtggaggaagaagggagataaaacaaacatattctacagcaataaaatgatcatgctaaagagttactttgaattaattaagacactgtcacaagggaatgataattgaataattccctaagatacaatgaaagtattcctggttggtgcgacctggcaacttatattaaatactttaaaattctgcaagttcctgactcagcaattctatttctagaaatttaacttaagaaaaatagccatagatacacttagagacttatctatgcagatattcatcaaggttacttatcatagtaaggaaatgaaaaaaccttcaatatctaacaagaaaggactggctaaatagatgctagtccacaaattctagtgcagccattacaaatgataaggatgataaggttaagaaacttaaggcatggaaaatagtcataattttataaaatgtacaaagtaggttataaaataaaatgtattgcgtgatacatttttttttccaactgctcccccacccagggatggagtcttgctctgtcctccaggctggagtgcaggggcgtgatctcggctcactgcaacctccacctcctgggttcaggcgattctcctgcctcagcctcctgagtagctgggattacaggcgcatgccaccatatccagctaatttttgtattttcagtagagacggggtttcaccatgttgaccgggctagtcacgaactcctgacctcaagtgatccgcctgcctcggcatcccaaagtgctgggattacaggtgtaagccaccataccccgccccgatcccgtttttttttttttttttaaaccaatgaatctatattaccatatatacctgaatataaggtagcctcaataaatgatctcccattttaccaatgagaatacaaaataacaaaacaaaacaacaataacaaagacaaacagctttgctaacttgagtatataaactctgaggaatgtgataaaataatcatcttcttatgatacctaatttatttagttgtatatacatacttcaaattagattttacacatgataataggttgatttgtaagtgttttctgaaatcatattttattaaaaattctattcaggctgtgtgcagtggctcacgcctgtaatcccagcactttgggaggccaaggagggcagaccacttaaggccaggagttcgagaccaacctggccaacatggcaaaaccctgtctctattaaaaatacaaaaactagctgggtgtggtggcttatgcctataatcccagctatttggtggctgaggtacgagaatcacttgaacccatgaggtcgaggttataagtgagctgagattgcaccactgcacttcatcctgggtgacagaactagactctgtctcaaaaaaaatttttttttaattcaaatgtttcacattcatcttcaatgtcttcatcattgttagaacgtctttcgagtcatctaacacctctcattgtctgagatagaatctttgacttagtatgtgatgctgtcactggatatttgatcctgagtgggaaacatccatttccatcatattaagaaagctggtgttatcatttgggctgtatgtgatctctgccattgcatcacttattgtgttgttcttaaaagtgctctatataaaaaagacttgctcagcatggcatccaatcctaggctatggggtcacatctttagctataatggccaagtttctgttgaatttcaacacttatttttacagcaattctatcaagtgacctctataagcacccaaaactcaagctgattgaggtgatttcaggataatttcaggactatttgcccaaacagtactttgttattcaaaataaaataatagaggagtgtccataatctgagacttacagggagttgattataagatgatgcccactttaaggataatgtttggccaaacaaaacccccttcttgccttatattcagacatatttcatgtatacacaatgaaaaaaagattatagacataaaatctctataaagtctacagtggttactgctgggtaggaagatcattataaaagatttaaattttcttctgtttgcttctattttctaaagtttcaatgagtaagagtgactgtgataattagggaaatagtattaagaataataaaaaaaaggaagagacattatacaaataatacattggacatgattagaggcaggctaagctagccttgggtgtgatttaaggtattccagctaaaaagaattccctattggcatgaaatttgtcactcttctgggtgacagccagttgcaagttagttaaaatgtagatgtgtttcttagaaggctaactcatttatccactatcctccattcactgcagattcctttatcaaattcgtttccagcctcagacagggtctggagggaacgagacagtgacagggataggtctgctttatgtgaagagagatgatcagaaaggtcaggcaccagacacccctttccttctactccccataaagtcttggcagctagagagctggggaataggactgagatggtacaatgaaggaaaaattaatagtaacatcgatgacaatatgaaggtagtgtggcttgcagttaagaatgcagtctctagaacctgcctgcctgcttggttcaaattcacctctgcccattatcggttgtgcaacgctgggcaagttacttcccttctctgtgccttggtttcctcatctgtggaataaggaaaacagtttccactccacaaggttacctgaaccacacctccccaccctggtaggagcagtatgaaaaaggccaaagccttcaaacctttcatactctgaccccagtttgcctttctgaaagcatctcttcaacacttccttctgaggtaccctgaggccattccatgaacccctgtgcacctccacatcctccacttttgctggcattctatctatctagaatgtgcttctcctctttggcaatgttttcctcatccttcatgaaacagctgaaacgtcagctccttgaataagccctgactgagggctgcccccattggttggtcaacaaatactaatattaagagcctactatgtgtcaggcactgtctcaggcactttaaatacagcagtgaatgaaactcctgccccgaccctgctcaacactcataatcatgaactcttcagcatccctgtggagatctgctatgacattactatatatgttatagaactctttcccctgttagaaggaaagtctttggagaaaggggcctgatcttacctgtctttatgtttctagtgtccagcacagaacttgtcacaccaagcacttaataagtattcgttggatgaatgtcatcctgaaaaattttcatgctagaaaatgctcacctacaactactttgatggcaactctaaataggaatatagagatgattcatctagagatattttttcctttatttaaaaaactgattccaatggcttgccttttgggaaaaccacatctgttaattgtgtacaacacaaagaaaagtctatttatttagctctggatccctagaactttatacagtgctgtgtcatcagtaggcactcaataaatgttttttgaaggattgggaaggacagagggaaggagggagggaaaaacagagggaaggagggagggagggaggaaggagagaaggagaaaagtttgggagccaagagaagagctggaagagacagagcattatccctgaggccagtaaggcactggcagagctgccatgggtctggccccagaggaggaaagcaggggttgagccaaaaaagggagatcctggctgggcctgcccgcatctgaggcaggtttcactcctcaggttcgggaaagcaccttcaggaacaccactgtttcagaatgacagtcctgagatatttaaacaatgactgggtgagtaagccccactgaagagagtaataaaaccaatttcttacaaatattctagaagcaaacataaataaattcgtaatccttcctgacacactccatttggggagttaggcttcctattcacctacaatgcaggtgagtaaacacaagtttttcaaaagaaacagaaacatgcttatgttgaaagatcccagagagcgatcatccgtgattgtaaaacacttctcttccattaaccaacttctcttccatttatttgtctggattttaccaaggagacaaataaagatgggagcagcaacatccttgtagacgaaatcactaataaaaaaggatatagttcccagagatcgtgacctttctgtaccactctctcaaacactccctcccaccccccaaataaaccacatataaactgagattatggtggtgattgcagatgcagtttcagggtaagaagagactaaatcagacactgtatgtgggagagacaagcgcatactgcctgacacatagtgggtcctctttaaatgtttaaagtagaaaaaagcaacaaaggaaagaatagctcatctaatctgtacttggaatttctcaaattactcataagagcacttaaaaaaatccagaaagacagaaagtatgcaacccctgtcaaaatagtattaagtgctgaaacacagacaaagataggtaattaactgctactagcttagatgaaaatgtctgcaatcttgttcaagtgcttgggtaatataaagcatttggagataaacttaggaagatgtgggggttgcaagtgaatagaaaaagtgtttacaaaactagtacatagtcagctttttagaaactagttcacacacatataaacttttcagtgaagagtttaaaataggatcaaagctctcccagaatgatggaaaaatgcttgacaaggcttcttgaagctccctcgagggtctctttctgcagatatatcctttaaaattgtgtgaagtgacattctcccaaatatgactggtgtgccaggtctttaaatcaaatcattcatattataatatgtgaacgcattaagtctccctctgacgaatttggacatcttgacccactccactacaaagagtaggatatcatcttccgaaagtacatgattggatttgcacagagaggtaaaacacatgggtttaagtaagagaagacagtgtagaaggcagctggggagaaaccggtagaggaagacaatgtccttgtgtgtctggcagtgtcattttgtgactttttctctttgacttccaaccacactttatattttcaactgtgtaaccaataacacattaaacttcaataagagtttgaagctagaatttttgctttaaaatttttacattaaattctatgtatagacttatgtgcatgtgcacagaaagagaattctgaagatgtgaaagatgaataatttatttttaagattaaatttaggggtagtgaggtttggggttaaatctaagctagaatcaatagtctttcatcaccacgtgtgaccaaagatgacccgcagaagtgatgttacctgactctgttgaactctatgacataatgtactgaccaaggtcatgactctgattcctatggcttgccttttggacaaaccacatctgttaattgagcacaacacaaagcaaagtatatttatttagcactctctctcttgcgtgcgtgtgctctgtgtattcatccttgttttccagtggtgtctgtcctcaaggaccaaagttgattattctatacgattctgaggcacagattctgtcactggcatatatgaaagttttctaaaatgaaatataaaatcagaagtgtctgaaatggctgtaactactccatgacccataactgatggtcaactcttccaagaccttgttctaaaccagatgatcacacatacttaaatagatgactggtctcaacacacacacaaaatagaaaattgaaaaattagtaggtgaattgtttcaatgtgaataatcaaatacattaatacttctaggtaaactctttttgatctctttgttgtttcttaagcactcagatattaggattaagatttactaaaagataggataatgttaaattaacaattgtcctgtaaggaaactctgggagtaaactataagaaataacttctaaaactaactttacaagtggtttgtgaatgacgattaaaactattcatttcagatattagagccaatgacagtgaagaaataaaaaatcttgcagtagcctccaggagacgtaggataagtcaaagtgaacatatcatagctcgatcctactctttcatttctactgctacttaaataaaaaagaaaaaaatttttcccgaaagggtagaatatggcagaaacagtaagtaccaaacccagcaaaaagaggaagttggtttcttacatagaaatgggtaacttgctatatgcaatatttaaaaaaaagccactgcaagaaggggcagtaataaaaataaattattttccttattgcaaagtatctgagggtaggaaattgacccaaactgccagagaatgaggaagcacccttttcaccctgtcctcagaatgttatttcataatttatcccttcctcagatggcctttttctgccacgtccctgctctctgctcttcagctgtcctctctccaaactcctcaattaaattatctcacgtttttctctgatctgctgttcgcagcttgtcacatcactataccataagccttcccacatgctgccgtaacagtacacttggagagccgttccgcggcagccactcgctggtatcctggatcccgggtgcacgagggtaccctacaacagtagtttcattgtctagaaggagcaaggccaacccacctagtcttcttctaaggagcatatgggttcacatccctaaaaattaggaaatgtgctatgatcaacctgtttaagcaacaacccatgtgccagatagtcaattagaaaaaaaaattgtgcttgtcttcttcctgttgtataaaagaacaggcagttttctcctgagcaccgtaattgaaaaaataaagttatctggttatcacaagtgcacagcttttcatcttgtttttgtttctgcaaataaataatttgggtctgtaagacatctttcacaaaatgatgtttcaaaaaatttttacagaatactctatctagaatggcatgaattacccaaaacagtaatacaaagaacctacatgccaaattaaaacattaaatcaaaaggccaataacagaggaaatagaaaatcttgttgcaaaatgagatgagattacagaaagacacacagatgaaatcctctagtttgatgagacagaggtacagagaggctcttcccaaacagtccaactttaaaggaacacctcattgacttaaaggtggcaatttacaggaggcagaggagctaatggctgacaaatagtgaagcatcgtgcactagccaggaagattttccattcaaggagtttaaaaacataggagacttggagccacatccacccaagtgaggaaaaatgttatttttttctctcccgtacccaagtaggacttactgatctaatcagaaaccaggtggtcaaagcctcagatgcccagaggggaggaaatgaacaggtccatcctttcagctgggaaatatgacaatattgtaccaaacacattaaaaatatgcatgcctttcgatctggtaattccatttcaaggatatctgaaaagatagatacacagaagatgctatttgctgcacttttcataatgctctgccttgtttccaacagtggaaaaactagacaacggtggaaaaatgtccagtaataagccatgaagcattcatacatggattctagacagatacttgaaatgatgctctagaggaatattcaagtgacatggtaaaaattgaagagattacaacatttaaaaggatgtgaccaaaaagtgggaatgtaatggttaagtgtctgttttacacacacacacacacgcatacacgcacacctacagtcaggactgtaagacacattcaggaatggtaaaattataagtgttttgattctttccttacttgcctttttttgaaaacatcttttataaaaacatgttgttttttgataaagagaaaaatcagtaataggttttgaaaaaggaacacaatcaggtggtggtctcgtgtacagggacctatgaaacaccagggctggaagggccttgtggctccctgagctgcttctctcatttgagagacgaagaaccaaatgcttccagagtgggaaggttctgacctcagaaaagctaggcaaggcatcccagcaggcagaacaagagagggacacaggctgctaagggttgccccagcagggctgagtaagtaggtggagtggaagtgatgcggatgtatgatttgagagtgtgagttcaacagaggtgtgagtccaaggtgatgctgggcttgggaacaagaacaaataagaacgtaagaaaattaggacaacagagatatgataaggggcaagtaacctacatttttttccagcgcttctatgtaaaaggctcatgtttactcatgtaatgctcaaaagaactcagaaaataccagtactcccaactcactgttaaggacactgaagttaaaataactagcattggtctcagggctagcaagtaacagagctatcatttgctctcaggataaattccaaagtccatcttcttcctaccgtgctacacattgtctcctctgtttgatctcctgagagaaatatctcgattcatacaggttacttatcagctgaggcatctggagtttctattgcatcaaacatctcagttggtgagtcaataacatgggggatgcccattgtaaaatccagcataaacgaaacattcaaaaggatatattcatggaactggaaaggccagctccccctgtgcatgatggagagaagggaagagtggtattacaaaaatccaattgctggatatataggcagatgaaaatcttttcatcctgctctaaaggtatcaagaaatgtggggtcctttccttctaaaacacagcctgcatctttcactgggttccaattagtctgtccttgaactgccagaagtccttagcattaacagtgagctgctgctatcctggctatcatttagggaggagcataagagcaggcactgcaatatcacctctctttggtctgggaaatgggcagcagacagtccagatgccattaaatgggaggtcttaatcacctattagctacttgcagaaaccaagacatgattactctccttcaagcccccagtacttttctcactgcagggttaatgaaaacattaggtctcctcctcttccctttcttattgttctgatcatctccgaggggtttgattagcaccagagccttctctgtagttatccctgtctacagtgataagcaaccaagcccacccctgcagcgtctctcatgcccgtgccagtgtttataatcacatgcactactctagtttggacttttattggacaattgctgtaccctcccaactggtctccttgtttcaattacccttctacatcatcagcaagaccaaataataattattttacaatggataaaccctcctcaatggagcctcagagtctactgagttaaaggtagttttaattcttccatgcagttttcaaagttgcttgcaatatagtctcaattttactttctagtcttattcacatctactatctaacacttatcaattactacggccacttcattacttcaaatgtcctgagaagcagacactaacatgggattcgatgtgctagagatttcttggggtagggtgcaggaggaggcaagaaaagccttcagatcgagatgcaggtctggcccctgggaaggagaggaggaaggaaggaggataggctgtgaagtgtcttggagtgcagcatagttccgagaagggtttagccatgtcaatggggagtgcttgagcccaagcttctcagtggaggaccccttgtgttgctggaatgggcatgccttacttagcacccccaccatgcatggtcaatggctgggagtagcccttgggaagcatagccttggtgccaaaacagtggtgggttcagaggggcagcagttgggatgtcagtcagtcagtcagtcagcggtgttgcctaaagcaagagagctgagcggtgcattttcatggccaccacagtcactgtataattcaccattaaactgggacacttttaagagtagaagagggacctatcaataattacacgaggcagacaggtagaaccagggtccatctaggcaaactagaatttattgtcactctatggcaacagatgcatcaaagggcctactcagtgttgactagcatagatctttccactttttggcattctatcagtttggaacagttttataacccacaccatggctacagaaatcctatgcgttttaaaactgacaaatgtcatcttctgaatgttgtcttttcctccttggaatcatttcgtgtgtccctttcctgaaatactgaccctttcctgctatatattttatttttttgagacagagtcttgctctgttgcccaggctggaatacagtggtacaatcacaccttactgtagcctcgacctcccaggctcaactgaccctcctgcctcagtctcctgagtagcttgtactgcaggcatataccactatggctggctaattaaaaactaaattttttttgtagacacagggtctcactacattgcccaggctggtcttgaactcctgggatcaaacgatgttcccaccttggtctcccaaagtgctgggattacagatatgagccaccacatctagcctctgctatatattttaattaattttatattatctgctcctgccataagacagtaagatctgtaagggtaggaactatgtgattttcagtttttctctggttgactaccacatcttgcagacacagtggacaccaacagaaggcatactcctaaatctgtagtgtcccaactccaacttccttatggcttttcagttttaaacaaatacttgagtcatcttgtatttcttaagtgcaaattttccctatgtctttatagttcagacagagaattcaactatcagccaatcttggtgaatgaattcttttacgatttgttaattactttgtccttttttctgctaaaagcctacattgaattacttcaactttgcctcaaaagaggactaacaaattgctgaatataatttgcactttaaacaataaagctattaatggcattttagcaagaacacccattattttctctgcagcaataaatcagcatttcatctgttataaattgcttggtcagcttcaaatggctttagaataaatctctttctcctttctgcctctgctgtccatgacaaagaaaggaggcagaaggtaaccctgtgttctgcattcccgggcatataattttcatgctgcacgactctataatttatttctagcgataagcatcttgtagtgctacactggctgcatgctcacacatgttcaaatgcacacagaaagacacaggtaactcttcagcagtaatgctgaaataaagaggcttccaggtgaagggctcagtgactgtgtatggtaaaattttgatgccaactgcatattttagtaatagggcagctgtaaatataaacacaaatgttctaataatcagactatttttcagccccacctccaaaatatgggtaaattccacaggatgattagataaggcacagggttatcttgttaatattaggctattgtacattcacatttctgagaaatatacttaataagttttactttttaaaaatcattttcattgaaagtcttgaatgtagcatagcatcacaaagtaggtgcctaataaatatttaagtgaatgagttaacagaagaatgcctttcatttagtctgcttaatgcttaagtcacgttatttagtgttattcattcatcacaactaaatactaatatgtcatctatatttactacaagctagtccctcttctctagtttataatttgctgatacttgggggttatgtttactgtcagttatagcgctaacatttcaaacataaggaggactttgtgaatattactatggataatggtgattagctgcttttggcatcctaggcagagtgagagaaaacagacttaagctacagcatgagggattcaagttagataagaaagaaagcgttctcgtatcaaatctaattaagcaccagagtagatgaatgaagggagctatgaaacattctttcttggaagtttttaaaaataagacgaaatctcatcagtacatatatcattaagtatgctcctccatgaagataaggaggaattggttctaatattctgtgaaaggcaagtatatttattaaggttatatctaaaaatataattttcagagtatggccatttcatgtaaagtactggtatcaattcatagtcaagatcatgaatcacacgcccaagtggtgacttatagttctttcatttactaggtgactctgggcaagtcactgtatatctaagatccagattcttttcctaaataagagtaatcctgcttctaaatactactcctcaaaataaattaaatcagaccttgttgggtaagttatattctgaataaataagcagtagaaaatctgattccttcaatttcaagtcatttcaatactatattctcagttaatgtcctgaaacaaataatctatatataaataagagtttttctttttatcacactagtaacaattagaaaagaaacactaacagataaattttagattgtggcaattaagtgaatagcaatctgatagctataggatttaccttcaaaatccaggcacattcatgtatttataccaatctctctccatgctaatattcttacagaggaattttattaaaacatggctgaatctatcatttcagtattcccaggcacaaggcagtgaggaaataaaacactccttctatgttatggaacctagagaaaataattctttcctaaccagtggggtacattttcctccttgaggttcgtaagacaaattttgaaaaaatcatggtgcagactatgtaatttacgcttaaagtattgtaactgcttttgtgttaggattcatattatgagaaaattcacatatattacccttttacggcttggttatagatctattttgattatggtcattggagcctaaaacatccacaccctaaaaagaacatatcattccaatctctatctcttttaaaatagggactttgggctatagcatgtttttctcaatagcccaactccctactcagagatactactataaaagctgtattttggctgggagtgagggaggaaacaaccctagctatttgcagagtagaattgcaggttccattggcaaaaaagtgccagaagtagaggaaatgcaggttacaaagcatacagaggaagagtgacagatgagatgaacaaaattgattcatggagagaatcagatcaggacaaagggtaaaaaagtctcaagagcccaatcacgtcaaaaagatcaatttttaggagaagtgtagtcaatagtgtcttaaaacaaaattagaagtggaagcaattttgaaggtcatttgaagagtaatctactccttttatagatgagaaactgagacctagaaggagtaggtgactttctcaaggccactctatactaggaggtgacagacatgtgctgcacaattcagaataatgagtggtaggttcagaacccaaaaagttcataatgagccagggtagcccccttcctctttaagggaccctctctctaagcgccccagccttgctcccaaggagcactgcaccttctgaatctggtgagtgatggggaacaacaggccaggaagggaggaagtatatctgccaatgctcaaaacgtgttcattctgatggccctagttctagcctgccttttgaatagcactgcgttagtcagtactggacaggaagcacaagtgttactttggcagggtcctgtccgtagaaagagacccactgagagcctcttgtgtacagccacagacaatgggataacccacatgctggcccctcccagtcagctaccaaggcagactgcggaaaaggggacaaactggcaggaagaacttgaagcaggctcaaccataagtcaggttgcacagcagacatgaggagaaggggcactgcaaagggagagctagggatcataaatccaatgctatttgaggcggagtgtctgcgatctgtaatttatatggatataataagctccatgcctaagacaccgcagccccaaacaaccaccaccaaaacacaaagcacatgtttaaaggggtgaattacccaaaacatcaggtttctccacatggctagactaagaaggctgcaaaatctatcactgttatgggctggaaagccaaccaggagagccttcttaggacttctaaagggaaacattctggatgaacctcttggtcttgtaagaagggaggctagttatgtttaactataaacacatggcagtaggtgtcagcgatatgttccattcgaagactatataataaacatcatttttggaaaaggaaactaaactaagaatagataacctgagaatgccatgcaagggctagagcaacttcccatccttttgcaagcatttagcaatcaggtttcgcctttagctgaactcctttcatttcatgcaatatttaatttatacagagatgattcatttgcaatagtaaatcatcacaacattctgtaaaaacaacaacaataacaaaagactagaaatataggaggcctacaacaagcacctaatttaaaactgcagcctcttcctatccccaaattggccctcctctttcctgctctgtttttaaatttttttcctagcaattaccaccttctaacttactataatttgcttgtttattgcttattttctgttttcctccaatagaatagaagctctaagagggcagcaatttgtgtctgttttgttcacagacacatcccatgcattgagaacaatgcctggcacaagcaggtgtgcaaaaatgctggccgactaaaaaaagtcatggatgggttgtcaatattgcataaagtcctattctcagatgacaattgaggtggcctcatcactaactacaagagattttttttccccaatggaaatcaccaaagttttaaaaaagattggaattccaaggttagtgagggagttccgctatctgatgaagcagtgactcacctgaaaagttccaggggacctaatcccaatgtgcatggggcccaacctcctgaccagccttgcatatctgaaggtggggagggaaactgaggtaggtatcgagtggtgtaaaaaaaacgcttcacaagagtttttctttatagccttacaattttaatacttttgtatagcacttcccaggcataagcaacacttccactgcatcttactctactttcataacaacccctgtaggcagtaagaattatattctgaatcttggagagtgtgctacttgcccagggtggttggccaaagtgggactgttcctattttggtttaagaatgcaagtttttgggttacaaattcagtcctttttctacatggcatggccaaaaataacattctcaaagatgggttacttagctgccccactctcatggtttacttcaggggagcattgtacaaaaatgggtgattgtctagttttcattgccaatatgctgggaaataaagaaaataatgagagaacaccaaagtttctactaccaaacaagtaggcatttcaggtggtctttacttagggccttgcatttcttaggctaagttgtgttatattgagctgaggtggaggactatgaaaaagaaaggcagcagatttcacagggaccattcaaagccctgcaggaacaacaacaacaaaaatgctatgaaacaacacggagtaactcttgcataaaaatggagaaaagtagggtctaaaatacatgcaccaaaacccaaaaaagacatggaatacatgacccaggcggccctgaaaatctcatcctcacacaaagaagaactgtgcagcatccagagagaagaagggatggtagctggggagatgagacctttggagaattaactaccaaaggggatgaatcagctcacgtctgacaacacctacagattctgtcaaacctgccgcactcttcaagagcttcaaggctcacaaacaggaaattgctgggtatgacttaacctgactctcaacctccttagagaagagcttgccccaaaaaggtatgaacaaagtgcagagccaaagggcaagaggtgaagaagaatacgagctcacattccaggtgtggggcatttagtggaaggaaacacttttcgaaacatatgagttatttgggatttagcattgggctcaatgccaatcaacatattcacttggtagaccaacacttcacagaaatgagaaaagagaaaacaattacaaaggaactctaagggcacaaaaatttgtgaagaagtgagattgggttgttaatttattcattcactcatgatattctgcatcagattattttcagaagcaaaaaactttgaattgacctaaacagtaagtaaatttattattttacacgacagagttgcctggaagtaaagccaacccaggactggtttagcccacagctcactgatatcctcgagggcctgggttctttccatctttcggtcctattttgtaggttccagggaaacccataccgctgtgcatgagccaagctgatgaccagatcttgtatatctaacaacaaattcacccactggatcaggaactggggctgggaccagctgcccgagcagatggccgcttagaggagaggaaatactccaaccaaatcagggttgcaccagctagaaaggggctaatggccattgagtgagcccctggagatatccacgatggtcatttgaaaggtattcattgagcacctactatatgtccactcctgtactgatcactagaaacacagagaccaggaactgcctgcacatagacaataatgaggaaggcagacattaatgaaataattatacaaataaagataaaattgcaactgtattaagtgcgatgttggaaaggtatgtggtgtcatgagagcgttaactgagggggaggtgatgcctctctgatgaagggatatggagctgctggggaaggggcatggagaaacatttcagacaaagggagcacaagcagtggccaagtagaaggatggggtatggcacattcaaaaactgtccccagatggaagacagtgagggtgagcttggagtaagacggagctaaagaggtaggcaggagccagtccatatgagttgtatacaacagaagataagattaacaaacatctttttaaattttaaaaatattagaccatttgttcacataaagttttacacaaacaaaagctctaaaatgccttggtgcacaatgtagtgtgactatcaaatggccattccccttccttgcaaaatgcatacttctagccatttcacttacactatctcatcgagaagaaaggcaggtgtgggaggcaaggcacaggtagacccaggagcggggttgaaagatgaagccacacagtcataactgattgggacaggaagaaaataattaaagaggccaagctaggaaagggacatcaggaagagcgtggctttgagacagggttgaacaggatcaggggcctgggcaggggcttcatgatgtgtagtaagtaacgagagacgggtggttgagctgggggatgggaaaagacccaggagcacagggcagagtccagaatttacttccctctcctattctagggaggtaacgatatggagatggcagaactcagtctccctctgtgtcttcttttggtggggggggggcacttactcacatagcaagaggttacacaaaactattcaagggaaagtgccacaaagtcctctctcagcaaatgaaaatatgcttcagaaataaacaacactgccactccctcatggggctgaaaaatatcatctcttaatttgatttcttagcactaataaactacatcataatctctcaatagctgagtataaatggtcgaattaaccatcttctgcccttcaaatacttaatttccatggtgactaattatgcatttcttttaccacatggatgggcaagtaactaaatgggctctatcttctaaagcagacatttaacgtgtgacaaagtcctctcagataaacttgtctcttttgaaatgagataactaattactgggtaagacagcagaatcgtttccctactgggaaatcaactacgtggtctagtagaatgaaaggcacggaccatggcaaatcaggtctgcaaaaacagtaaacaaaacaagccaacagaacaattaacacatgtggaaaaagccaaatacagtatccactgcacagctgatttgattttaagacaactgaatatgtgtttcagaaagaaagggaaaagagtgaaaatatatggaagtataagaaaagaaacaaaacatcctaaaagtaaaataaggcaactaaaggcaaaggaaaacttttatatacgcagacctcatagactacacaaatccctttgtctgcattctctagagaattaagaaatggtcactatacatatattttattgctcaggaaggaagtccacatctcttccagaattctaactattaaatacacaaagcattgagccatgcagataattctcttttcaaaatagggacataacctattttctctagatcagatgtagctggctaactgagagcccatagctattgtggtaaccaggagaaaaggaaatggatgattaaagtaaatctaattcaataagctagtgacattgtactgtacaaaactggggatgggaaagaggcggatacaggccaaaggaggaatagtgcttattttgttccttttgaattttatcaaattgtgtatatatttgtgacttttaccctaaggagcataaaaaactgacaataaaagattatctgaatggaacattggtttttggtaagtgtcaagcacaaaaggaatcataatttttttcaacgagctttcaaagtatgtatgctcttgacatctgctgataagctgcagtttcctcctaaaaacttaaagcttctctaaattcaacataagcttgctttcagtatctgcaaaatatatgtggataaaattgaagttttcaaaagggagttaccatagaaacacacaactccctaaaagagcagtccatcatctcttaaggggaaccgtcatcacagacatgtattcagtatctctctgtgcacgtgaggccttagacaatacacaaaggacagtcagcacttgcacactggacaaatacagaaattagataagccaagtccttactctaagtaagcaaggcggggatgaggccctttgtgtatgtgcatgtgtgggctgtaggggacaggaatcatgtgagctggatcctgtgatgcagctaaaatgcagccatcataacatttatttaaaacacaattctataacaatctggccagtgcacacagttatcactatggactgttttctgtgaattcttttaaaatgaggatctaagtactagaagcagcacgtacaaaaatagttttatttttactagcagagtagactcaagctaaaaataaactaaatgggaattttgtactgcagacttttcaaaaacagtgtctgtatacctaagacaaacaccacctcttaattagaaatttctgtaaagcattccaaaaaggccacactattttcagtcagactatatggttcttcagacttggtttctcttgagacaaaagaaccccatggagacgacatctaagttggagtcttcacttaaaccacttatggtctttatgaaaggatttttgggccaggcacggtggctcatgcctgtaatcccagcactttgggaggccgaggccggtggatcacgaggtcaggagataaagaccatcctggccaacatggtgaaaccccatctttactaaaatacaaaaattagctgggcgtggtggcgtgcgcttgtagtaccagctactctggaggctgaggcagaggaattgcttgaacccgggaggcggagcttgcagtgagccgagatcgggccactgcactccagcctggcgacagagcgagactccgtctcaaaaaaaaaaaaaaaaaaggatttttgcccttaaagaagccaaatcattacacagcccttttacaatgggacagatctaactggaaggaaaaaaaagatatacttttaggcactgtgccccaaaaaactcagcaattaaagtttgggattaaaaaaagttaaagctatctaaactgaggtttgtatagaaatgtgattatttttgcaggtgtattatctgtgattggtactaatgatttgcaaatcatattaatgaccataataatgatattttttctaatgaaacacagcactttacaaacattaagtatttaatccctgttaggtaaattacagctactcttaaccacatcttacaaatggtaatactgatatcactattcatgatttgccccaaatcacagatgactaacatcagaatttattttaaataaatataaacaataaagtacacatgtgcttatttgcatgtgtgagtatacaaagcatcatgattaggcatagttaagcaactgattagaaagtcattcaaggtctcacttaaaaaccaatcaagttaaatctaggtaatacaggcctagtaccatcagttggcattattctggggaaaaaaaatatcagaatgcttagcaactcagaatgcttaacatcctacctttccactgcaacctgtaacagacaacggccagtggcccacaatgccagtgccaaccacagacaggatggatggctctggaaccattagaaggcaccattcaaatagacaatggtaccaaccagcgtctcgatggtggttataggtctgaaaatgtgtactaaaagaagcggaacctctggccgatgaatttatttggatttcatggctattagtactctgacttccacataacctttgagattcagactgagcaggagttcctcagagaagcttctctgagccctgagccggacccaacaatgctgctccagagaatgtcttcagactccaccccagagcttcttcacgatttttggacactggctttcttgaaagcttcccaataggatcaaacttcttaagggcaggagccatactgtcttgtgcctggacaatgtttataaattgatggagctttataaatgttgaataagtcaatgagcataggactaaatttatttaaattactagtgctctcatctatcagaaaatttgttctttcggtgaatatataattaaaatggtgtgggttaaaagaaagttcctgattatcacaaaaaattcagagaccagggccaggtgtggtggcttatgcctgtaatcctagcgctttgggaggccaaggcaggaggactgcttgagctcaggagttcaagaccagtctgggcaacatagtgagaccttgctgctacaaaaaattttttaaaaattagctgggcgtggtggcacacacctgtggtcccagctacttgggagtctgaggtgggaggatcacttgagctcaggaggttggggctgccgtgagctgtgatcatgccactacattccagtctggtcacgagagcaagaaccctgtttcaaaaaataaaaaataaaataaaaacaaaaaattcagacaccagagatttgtctactaatatgcattttaattttctaaggacaagcaagcaaagaatgatcatgattttctgaatttaaaatccaggggtgaaggaactacccagacatctctgatgctgcccattcttttatcttgaaggaacactgctctgggcatgacagatgaggattaagtaattacgctacacactctggcgtgtgtctccgaaatctgcaaacacatctagtgctctgaaagcggacttgtagttggttttttaaagatgataaagagaactttgctactcaaataaaaataactgatatggccttcaaattttcctaagttcccgaaaagcttatttttcctaagtgtacccatctcagataaaggcagaaatcacccctctctcaatacagtcaacttctctaaagatgatgcatacaaacacaccagactttggcagaattctctagcggagatttaaaagaaaatatctcgtggcagtagagagtcacatgaagacttccaacagctcagacattctccttctacacaaaaggggaaaggccctctctgtagcaattgtttgataaacagaccacagtggcgtttttttacttctcctctgatataagtgaaaataagtccttggtactatgtatggaaggcaggtaaaaacaatgaagtgataagtatttacaacacagatttaatttatctacaccaaaattttaaagattttctgctttaagtagagttatcctgcttaacatcctgccccactaatttttatttgaatttggaaaaaagtcaaatgtggacccctaagagtacattcatcttttcagaagcagctaagccctgatttttcaaaaagcattaatctagactattttataaaattataaaattgatttaaaaatattttaaatcaagactaaaggtagatgatatcttcattgtaaaaagaaaaagatactatacattcccatcctgtgaaattacagccaaattttatccattcaggatactttgggaatgaggcgttctatacagcttagtttcccagagagctgaagggctccaaaattttcttaaaatagaaatatttctaaaatgtaccatatatctgtgcttccacgatcacagtctaagacacataatatactttttccttaataacttataattgaagacaccagctcatgtgtacaaattgaatgtagatcaaaatgtgctaggtaatttggtcacagataagaatttatgtactgtgatgcccacaagagaaagcaggaaagatctaaaattgacaccctaacatcacaattaaaagaactagagaagcaagagcaatcacattcaaaagctagcagaaggcaagaaataactaagatcagagcagaactgaaggaaacagagacacaaaaaaccttcaaaaaatcaatgaatccaggagctggttttttgaaaagatcaacaacattgatagactgctagcaagactaataaagaagaaaagagagaagaatcaaatagatgcaataaaaaatgataaaggggatatcaccactgatcccacagaaatacaaactaccatcagaaaatactacaaacatctctacgcaaaaaacttgaaaatctagaagaaatggataaattcctcgacacagacaccctcccaagactaaaccaggaacaagttgaatctctgaatagaccaataacaggttctgaaattgaggcaataattaatagcttaccaaccaaaaaaagtccaggaccagatggattcacagctgaattctaccagaggtacaaggaggagctggtaccattccttctgaaactattccaatcaatagaaaaagagggaatcctccctaactcattttatgaggccagcatcatcctgataccaaagcctggcagagtcacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaacatacgcaaatcaataaacataatccagcatataaacagagccaaagacaaaaaccacatgattatctcaatagatgcagaaaaggcctttgacaaaattcaacaacgcttcatgctaaaaactctcaataaattaggtattgatgggatgtatctcaaaataataagagctatttatgacaaacccacagccaacatcatactgaatgggcaaaaactggaagcattccctttgagaacagtcacaagacagggatgccctgtctcaccactcttattcaacatagtgttggaagttctggccagggcaattaggcaggagaaggaaataaagggtattcaattaggaaaagaggaagtcaaattgtccctctttgcagatgacatgattgtatatctagaaaaccccatcatctcagcacaaaatctccttaagctgataagcaacttcagcaaagtctcaggatataaaatcaatgtacaaaaatcacaagcattcttatacaccaataacagacaaacagccaaatcatgagggaactcccatttacaattgcttcaaagagaataaaatactcaggaatccaacatacaagggatgtgaaggacctcttcaagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaagacagacatatagaccaatggaacagaacagagccctcagaaataatgccgcgtatctacaaccatctgatctttgacaagcctgagaaaaacaagaaatagggaaaggattccctatttaataaatggtgctgggaaaactggctagccatttgtagaaagctgaaagtggatcccttccttacaccttatacaaaaattaattcaagatggattaaagacttaaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttgaaatctactcgtctgacaaagggctaatatccagaatctacaaagaactccaaaaaatttacaagaaaaaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggctgtggagaaatagaaacacttttacactgttcgtgggactataaactagttcaaccattgcagaagtcagtgtggcgattcctcagggatccagaactagaaataccatttgacccagcaatcccattactgggtatatacccaaaggattataaatcatgctgctataaagacacatgcacacgtatgtttattgcggcactattcacaatagcaaagatttggaaccaacccaaatgtccaacaacgatagactggattaagaaaatgtggcacatatacaccatggaatactatgcagccataaaaaatgatgagttcatgtcctttgtagggacatggatggaagctggaaaccatcattctcagcaaactattgcaaggacaaaaaaccaaacaccacatgttctcactcataggtgggaactgaacaatgagaacacatggacacaggaaggggaacatcacacaccagggcctgtcgtggggtggggggaggggggaggaatagtattaggaaatatacctaatgctaaatgacgagttactgggtgcagcgcaccaacatggcacatgtatacatatgtaactaacctgcacgttgtgcacatgtaccctaaaacttaaagtataataataataataataaatttatgtgctgtggaccatggaacaggaaggagtctgtttgaccctcacagtattctgaaatttgtcctctcaaaaaattcctgatgtcaactcctatttgtatcatttgcctcttcctcacagaggtagagtgaagctatgtggtagagcatggctttgcaaggagtaaaatgttttaaaaaactagttagtgaaccaaggctggagaagtttccttgcaaatggttttcctattccctaggtgggtgtcattttggatgttgctatcagctacctccttttttctttttctttttttttgagatggagtctcgctcttgttgcccaggctggagtgcaatggcatgatctcagctcactgcaacctttgcctcctgggttcaagcaattctcctgcttcagcctctcaaatagctggggattacaggcacctgccaccatgcccaggtaattttttatatttttagtagagacagggttttaccatgttgtccaggctggtctcaaacacctgacctcaagtgatccaaaatgccttggcttcccaaaatgctggggttataggcatgagccactgcgcctggcctgctatcagctacctctgacttcagctggagcttcatctgtaagggctcccaggcgctcctggaaagtacacatttccccagctttcattcactttattcaatgattgagaaagagaaacatgcttggccagttcacaaatctgaatttagatgtttgggagttctccaatgtttcacttctttttgctgaggtaggcttgtaaacttggttaaaagaaactggtgtaacctctttgaaaagacaattgggctctctctccctgtattttacacatggatgtaaaagtcattaaaaagtacatattctttgacctagaaaatcactttctaggaatctagcctaaggaatcactggctatataaacaaagaggatgtgcaaagaggctgaccacaccgctgattataaaagtaaagtaggcctggtgcagtgctgcacgcctgtaatctcagtactttgggaggccaaggtgggagaatcacttgagcccaggagtttgagaccagcctgggcaacatagtgagaccccatctctacaaaaatagaaaaattagtcaggtgtggtggtgcctatagtcccagctacatggaagcctgaggccagaggactgcttgagcccaggaggcagaggatgcagggagtcatgatcatgccactgtactccagcctgtgcaacagggcataaaagtgaagtttaactaaacctctaacattaaaggattggttaaaaaacatggaaattcaaacaatggaaaactattctgccattaaaattttaaaataatgatccacatattattgacatgcaaagatttccacaatatattgttaacccaaagaaaacaataggtttcaaaaatatgtgtggttgtatataggggaaggtccgaaaggatctgtattagaggttcccaaatgattctggtagcccttagagtctcagtaatttttcacaatgcctccaggcccaaacaaatacctaatagagctgtctgttaagtagttagatccaaacaacataataactatttatgtcagaatgatttagcagctgaaaaaaaaacacacataaatgaaaactactatttccttctcaagtaactttgttataacttgtttatagaatgtatacacctgttgggcactgcataactttaaatcttggaatcgctggacaccactaccttatttcctgttccacgctggttttcatgtgatacactttttatcactaaacactcagcaatcactgaaaactcggttttgtaaagatatgatgtcatcaaaaggaatgtagtgtgatctaatgctgaaactgtgaactatctccagctaatagttggcagagtgttgtacgatgtttcccttaatgatggaaagtatctgtgccaaccctagagctgcacccagaatttgctgtggtgccccagagcatcttggcacacagtttggagctgcaggtatataacaagatgttaacagttgctttctctcaggttactggtgattaaaaaaaaaaaaaagattttctgaactttttcccaataaacatctgttattttttacaattagaaaaaccactaaagtgatttatgtatttttcagagttctttatctttacaagaagatggagagtctccccaattttttactgtgaagaaaagtctaagcataaacaacagtaaaaatggagtcttggatgatgccttaatgatgaaaaactccctcatgaataacgttctgcaataactcctcctattctgaccccctccctgatacttgcacaggttggatcaatgaagtcactggtgtcaggacactaacccagacattcaccccacttcctgcgggtagccactacaattgtttaataatagactctctgtccctcagctgatgtgcttgtaatagagcatggtcatgcccttgtgggaactgagctataaatggtgctttgctcttggtctgcagagctttagtctctggattaacggtgctccttttaaaacagtgcctgctgctttgcaccctggtgtacactgctgccgtctttaaaggtctccactgctctctttgttcccttctggttacttttgccctgtttgtcagtttttgcactaaagaaatgaatgggcttttataccttcaccaattgggactttcagaaccagcctagtgagttaagtctaacagatatttagccccctttgatagtcagttgttgctggatattttgtttgtttttgcctttgtgggaattggtgggcagaaaaaaacattttccagtttcatgctatttttaaaacctgaggattttttacaagttttggcatcgtatagttgaagttctattgtgatcaatatttctattcatttactttcttactaaacaagtgtccaaggaattataaaacactttttttttctaatttagaaacttctacaaatgtatacatcaattgcaacttaacctttacaagtttaggaataatgctgtagtagaatatttaaaggaactttctgcataaacttcagttaatataggtcttacttttaaaatatcttctttaaaaaataaataatattgcttactattgggataaaattattttaaaaagaataatgagaacagctcccaattctcctttacctgccccagggttccctcagcacttatcaccttttcaacatactatacactttacctatttatcttgttaactgtccatctcctccaaccagaatgtaagctcagtaggagcaagaatttttgtctgctttaatcactgatacatcttgtctccagcacctaaaatgtaggggctcaacaagtatttgttgaaaagtcagtaaatgagtgactgattcttaaagacctttttgtaactccattttagaagaccaaagaaaaaaagacaaaatcttgaacattaatatttatacaaaccaaatactactttttgtaggtaaaatatgattctattgtgatgtaaagttacctttttgactgtagtgaaatccatgaatggcaaggatctaactaatttactattgctcctcttccaggaaatgtttcaactttcaaataaagaggacttctgattgtcaagcatggcaaattcatgtggaatgcctaaaaatgctgagtactaaaaatatttttaaagatatggctaagcagcaagaaagtaacagcaattgttaaaagttgaaaatgacaaggaaattagaacctagagaagtaagtaggtaagtcctgcataagtcaatccctgatggggatattaagagacaaagggacagcctaatgtccacacaggaaggtcaaagccaatacccttgaaagatgaaatcctcagtgggtaaattaaaaaaaaaaaaaatcttcccagaaatagaagacagaataagtcttggtgatgggagaggagaaaaaagaagaaaatttcctcaaaaaatacaaagcccaggctgggtgcagtggctcacgcctgtaatcccagcactttgggaggccgagacaggaggatcacttgaggtcagaagtttgagaccagcctggccaacatgatgaaaccccgtctctactaaaaatacaaaaaaattagccaggtgtggtagtgtgcacccgtagtctcagctagttgggaggccaagctaggagaatcgcttgaacccaggaggtggaggttgcagcgagctgaaatctcaccactgcactccagcctgggtgacaaagtgagactcttgtctcaagaagaaaaaaaaaaacaaaaccccacaaaaaaacaaaaacaaagcccagaaattacatatccatgtgccctttccaaatccaaatagggtaaaaagtcctgagttggaaatgactacaaacacatagcagaagcaaatacaaagcctctctagaataatgaatattaaatctaagtttcaagagattttcataagaattccaagtaattaagttcacaatcaaaaatcacaaaacaaagaatcaagctgtcatgaacatgaatgagaaaaaacaaaactgcagaatgaaatcatcaaaggctttagctattgaatgtattgaacacagatataaaatagatgtgtttaacatttttaaaaaagtaaacaggatcttaaaatatgaacaaggaagatttcaaaaatgactaggcagatttaagaaacagccaaaaataacttctagaaatgaaaatataataattatatttagagactcacatgagtaagtccaataccaaaatagatgcagctgaagtaggaatgagtgatttggtaaacagatataaagaaattgtacataaacttatacaaaaatgaaaaatataatcttacgtttaagaaattatatggccgggcacagtggctcacgcctgtaattccagcactttgggaggccaaggcaggtggatcacgaggtcagtagttcgagaccagcctgaccaaaatgggcaaaccccacctctactaaaaatacaaaaattagctgggcgtggtggcatgcgcctgtaatcccagctactcggaaggctggggcaggagaattgcttgaacctgggaagcaaaggttgcagtgagccgagatcatgccattgcactacagcccgggtgacagagcaagactccatctcaaaaaaaaaaaaaaaaaagacattatacataacatacagaaggaaaatataaaagaaatatttagagatgtaaagggcagaatgtgaaggaaaaaacagacaatgtgggaaaggcagcattcaaaataatttttttttctgagatttttcagaactagtaatcatcaaattcagaaagccaaatgcatcccaaggatgttaaataaaagaaatgcccacccagacaaagcctggtaaaactgtagaagaccatcataaaaaaagctctgggggaaatctggggaaaatgtctttaaaacactgaaagaaaataatactgaatatgtaagtgtatacctagcaaaactacctttcataaataaagcatgaatagaaggtattttcaatcaaacaaaaaataagaaagtttacttccaaaaacattcattaaaggtacttctaaaggacatgcttcagaaaacagcgatgatctgagaagaagaaatggtgagaaaagaaaatagtaaatacatgactatgtttaaatagagtataaaaaacagctgctactgtatacaaattgtaataatgtgtaatataaaaaataatataaaactataaaccaaataaccatggcatgttaggctgaaaaagaatgatccaaattaaagaactctaaggttactgaactgtttgagaaaagaatgaatactgtttagtgtaacactttattaagttacataggatgccaacatctctagggtaagcgtggaaaaaagagaatggtgtgtacaactgttaaattagtagaagaaaaaccatggaactatatttaaaaaaaaaaacaaaagcaaaatccaaatgaaggcaataaagaaaaaataaggctcaggaaaagcaggacaaatagcaaaaaataatatggtcaaaatgaatataaatgcattagtgcaatcaataattagtgtaatctgctaaacaacatacatcaactgaatattttacttaaaagacaatgactgattgaattaaaaaatagacaacatatgtccacacagacttgcatgtgaatgttcatagcaactttatccacaatagttgaaaaaactggaaatgacccaaatatccatcaacttgtgaatagctaaaaaacaaacaaacgaaaaacctgtggtatatccatacagtgaaattatactgaaaaaatataaaggaatgaaactctgatatgtgtaacagcataaatgaatctcaaaggcattatactaagtgaaagaagccaaacacaaaagtctacttactgtatgatttcatttgtatgactttctggaaaagacaaaataacatagtgataaaaaatagatcagtagtttcctaatgccagacgtgagggaaggaaactgatagcaaaaaagcatgaggaactttctggtgtgacggaaatatctatagctttattgtggtagtggttacatgactatacacacctgccaaaattcatcaaactgtacacttaaaatatgtgagtttgatcatatgaaaattataccttaataaagctagtaaaaagacaaattccaattatgtgatttacaaagcacaaatctaaagccttttgtgtctttgaataaaggaggctgggggaagaactgcgtaggcaaataataacccagaaatctggtgtagctaaattaaacccatacacagttaattttaggcaaagagataaaaagggccatcacatattaatagaaatatttaattccctgggaagatataatatgttcctaataatgtatcttcaaaaatatataaacccaaaaataaaagaacctcaaggagaaactaaccataagacagtctcatttatgaacataaatgcaaaaatcctgaacaaaatattagtaattcaaatctaataatttccaaagaaaaataatgtgtctaaatttgggttattccataattcaaggttgcttcaatatcaatcagtgttattcactagatgaaagaagaaaatatatgattatctcaaagaatatagaaaaagcattcaataaaatacaacattcatcattcatgattaaaacaaagaatagaaagaaacttcctgaactggataaaggatatcacaaagcaaccctataacaaataccatactttataatataaatgaaaagttaaagttttatctatcactattttaatttaacattggagattcttgccagttcagtaagacaagaaaaaagaattaacattttatgggttggaaagggaaaaaaaactatcattacttgtaaatgatataaagaatctacaaattacttttattaataaggaagccaataaggtttccatatacatgataaaatgtaggaccctttgacagtggcatggctaaataaactacagtaaaataaacacaataaaatattctatagcaatgaaaatgaatgaactaaagttacacaggtcaacctggataaaactcagaacattgtgttttgtggggagcaagtcacaaaataatcagtatgattctattacataaaagctaaaatgagatagtatattgctttgggatatatatatggtaaaattatatgtggtacatatgtagtaaaactaaaaaaaaaaaagcaaacaaacaagacagtaagtaactcaaaatccaggaaagtagttggggagaggagaaaacaataggagagaggtacataagggtttcagtagcaatgataatgttcttcagatgagtagcagaaatgtggatgttttctttatttaatcctttaaagtgtatctacatgttatatattcccttccacatgtatgatatacttcataatctaaagaagtaaatgaacctgagtgaactttgttagaaatgcattttaaagtcaatgttacttcaagttggaaaacacaggcatttaggaagttctttttctatatctaagttttgaaattaatatttattattttttcttattccttattctaggaaagttgagagttctcatttatacaatggttttcctattacactgaaatcataagaaactctcttggtaggttttaaaggtaaattatacaaccattttgttttcacaactgcctgtataagacagaagaaaaacaacaaatgaacaattaactggtaaggaaagaatattaactaataagaaatgtcaaaaaggcttgacttctcatattaaaaacaactttttggtggaaaaaacctaatcccttcttttgaaagagaatttttcaaaattctcagtgttggggcggtggggggtgagtggctgggggttgggaaatcagatctcagatcaataaacaggcaaacaggttgactaagaatagaaggtatcattatgtattttacatattttgtattttctgcatattagatgttttgacatcttaaaactacctttctggctagagagagactgtctctttcaaggctagccgattctcagagataacaaagagcccggctggtagcatgcctttgacaagaaaattcaccaatctagagacacccctcctctatctggccctcagaggcaatatttctctgcctttactataccacagccaggtaccaagcaagcagggaccacccagaaagcttggagcctaaccaaactacttcaactagcaattctaaactgttaaccctgccctgccttgcctttcccttggaaactccaataaaggctgtggctggcccaagctctcccctggctcctgccttctgcctcctgactaacacgggtgttttcccttgtggccctgcgtagcatgtggtgacacgcctctatgggacctgtgaatgtaacaaatttcttccttccaagccctgttctcatttccccttcagtggctgtactgattttatcacatatccaacatgtacattcttaaaacacatagcaaagcaggagtttcagatgttaaccaaggtctccaggaatgacaattctggagctcagggcgagcagagattagtgaaggagggagcaaatttacaggaaacaagaatatgcaaatactgagagtttgagagttcagtggtcgaaaaacaggagatagctgtggaaagtgcacactgggaaggggcagctctgaggcacctcacggcacctggacaacctcaaccagcttaaggtgcctaacagaggaatttataagcttcttgctggtatgggaacaaatccccaagtgaggtgcctgctagatagatctgcaggttgaagtagatcagggaaacgacacaccggaggagagggatgtaggggcagaaaagaggggcccatccaaaaaatgtgtgtgtatccccacctacccttacctccttccactttttctacaagcgtcagaactgctcaacatcatcacttccaaatcagttttggtgacagagtccaattgcccaaaccagatgcaatgccctcattatgtcttaccagccctcctgctcctgcctcctccagttcatgcttcacgtagccacagagtaatctttatagaacacaaatatcaccatattacttcccagcttaaaaacctttcaggattgacccatatccacccagagtagcctccaagccacttagattgtcctcctttctgccgtccttctggcttctctggctggagactttagaccacagcactgtaaactgattccaactccatgttaatatgttaatttaatatgttaatattaaaatattatttcatgggtccaggtattagcacattatgtactcttttctccttctgaaaggaagaatctttgcctgccttaacactattattcatcttcaaaaatctgtgcaacacttcattctgaagcctcctcaaacaactgcagtctgctcgctttatggaccaccttgctgctctcattacattcaatgcacactattttattcacatgtatgtctgtcttcccaactacactgcagactacttgagggcagggatggtatcttattttttctttgtatttccagtgggtagcacagcacctgacccataaaaaaactatcatctattgagcacctaccgtacagcagatcccatactaagcttttcaaatgttatgacgtgagttcccacaacaactcaatgaactatttataattacctcttttacaaacgaggaaactgagatttaggaggttaacatccccaggaccttccagttagtaagtggtagaattctgattaggacttgggtctctgacaccattgcctacgttagctccttgggcctctggtgaaacgtaatgcacgaaatgtggatcggatcgtatgaaatctcccccaacttacaccctgggttgaaggctgtgaagcttatgcagaatgctagaggaggcattaggacatggggtttctggttctgccactgattaacctcaactctgggctgtcgcaggctttctctgggcttcactttcctcatgggggaaatgccatccttaacagatcccatgtcatatcctcactcttaaggacctctaaagctgataagaaggtactgtgaatcataaacctaggtactctttctagatattggccttgaaacatctcttccttcactgaaaaactgcttctgaaaaaggatgccagaagccacttttggtcaagaaaatgtccacttttgttctcagcacagagcaggtacccggactttccctgttcccaagtgctgtagaccaaaatagcagggaaccaggatgaagtcagccagaaacacgctttctataactgctcttcacagaagagaaaatcaacaagctagtgtttaaataatgtgcagggtgtgataccaaccgaacctccgccctccttcctggggaaatgcaaagtttgctgtggccttttcacaaacctcggagagaatgaaatgtcagctctaacactgaatttcccagcttcattccacttccctcaccacctcactattacctaagatgacattctgtatattagtatactacatcttaaacatcatccctcactcagacatcagattacaaacaaacagctgaatcctacagctgttcccactagaaacaaaaagattcttaacatatttgaagggaaaaaatctgtttgttcccagatgtctcctgagcccatttctggggcgtgtctactagtaatagtgcgtaaacgctaactgtactcctcgctcctatttacacacactattagttttcagtaaccactccttcccaactcccaaaaaagacagctaagaaaacaatgttcacttggaggaagagaaactaaatttctttttgctgttcctctcaatcaaacccttgcaggaaccaaagtattcactgtggtttaaacacttgtcactcaaaaaaaaagtacccagaaatgccatgagacttcctataatttcacttttatttaaggagctgtgctgcatcaatacttgctttgggcacaaaatgcagaggagcttgatggcattttgagaatggcacagatgcaaagtatttaaaaaatacataccacccagtgtgttcctgggagacatggctggactcaacatgttactatcagcagtgttagcctggttccgcaggggaccacatatgcacatgtaggtactgagcctgtgctctgggatacatgctgtgctaaatggtttacattttttatgactcgttaaaatatacttaggaggaaggtatgttctcccctttttacagatgaggaaactgagcactacatgaactgccccgaatcacattgccagtaagtttgcaaaagtggcatttgaacagtcagtcagactccgaatatgtgaaggagttctttaagggaaccaaggaaacaatgtgcattacaacccttgggagacactctagtgtgtatttctataaattaaaaaaaaaatgggaagaaattgatcactaatgaaatgtatccatctgtcataatgaagattttaatgacgaaacaagtaacctaaaactaaaattaagacattacaaatatcaaagaaacaaagatacaacccctaaaaggggctggggtgctaatatttagaaaaataaatgtgtttcaactactgccccctcctggtggcataaccaaaggtacctttctttttcttaacttgatggatttggaaggttttcttctaactgatctaccaaaacaaaaaatgtaggtaaagaaagactgtatggagcttattgaggataaggcttagttctggactggagtgaaggtctttctaactgagtaactataagaaactatgaagcatcttgtgcctccatcttctcatcagaaaaatgggaataatatccactctatctacctcaaaggttattgtgggcatcaaagaaataatgcatgtgaatgttattttcaatgaatctaaaatctaaggtattatgattaattaaagccatttatagtatcatctattaaatttaaaattacatttactctttaatcctgcaatcccactcctgggaaccaatgccatagaactaatagcactgtatctaagaacaaatacaaagatgtttatgatttcagtgtggacaatggccaaaaaaactgagaccaaagtaaatatccatgagtagggcaattgtagaataaaaaattctaatagttaccccactggaatattatgcacccattaaaaagaatgttctagagctttatcaattgaatgaagagatttcaacacagttttctgagaagagcaaaacataaaaaaagaatgtttaacagggaattctaaaagtcttagtgcattttaaactttaataatttcagaagtataaatgctatacactttcaagaaacaatatatgaaaaataaaaatttaactttttaaaatattgatgttacttattaaaatcaatataaaaactattatgcacaaaaaaactaagagtaaaatttattattcaaaattccaaagttaaataagtataaaagaaatataaatagctaaatgtttaaatgtttctaagtttatagcaattatacctctaaaattatgaacttaaaattgcactaatacttaaaaatgttatttcaatagctttaggcatactagtgtttttggttacatgaataaactgtatagtggtaaatcctgggattttagtgtacctgtcacccaagtagtgtacactgtacccaacaggtagcttttcatgcctcaaccacctctcaacctcctcctcttgagtctccaatgtccattacaccactctgtatgcctttgtgtacccatagcttagcacctgcttataagtgagaacatggtatttagctttcaattcctgaattactgcacttagaataatggcctccagttccatccaagttgctgcaaagacattatttcattctttttcatggctgagtagtattccatactgtgtgaatggaatgtgtggtgtggaatacacaccagtccaatggaatggaatgcattctatttacacaccatggaatactactcagccataaaacagaatgaaatggaattatgtgtattacacacacacacacacacacacacacacacattcctcacatgttttatccactcatcatctgatgggcacttaggttgaacccgtatctttgcaattgtgaattgtgctgcaataaacatacacctgcaggtgtcctttttatatagtgacttcttctttgggtagatacccagtagtgggattgctgggttgaatagtagatctacttttagttctttgagaaatctccatattgttttccacagagggtgtaccaatttacattcccaccagtagtgtgtaagtgttcccttttcactatatgtacatcaatatctattgtttttttactttttcattatagccattctggctggggtaaggtggtatgttgttgtggttttaatgcattaacactttgagaacactctataacatgtttttgttttttaaaaacaaaataacagtcccctcactcccactgtgtggtgtgtgtgtgtgtgtgtgtgtgtaattgtacatttacataaacaggggaaaaatggaaggctatatgtgcagttaaaatgggagaagggaaaagaggaggagagtgatccagacaaaagaggaaaagttgttgttttttttttaaaaatggggaaccaaaaagtgtatatgctattatcacatttatgtacctatataaaatcatttgtattgtacagctatataatattacatgtttaaattttattattttagagacagagttttactctgttacctgaactacagtgcagtgaactacaattgcactggcacaatcacagctcactgcagcctcgatcacctgggctcaagcaatcctctaacctcagcctcttgagtagctgggaccagctacggcaccaccatgcctggctactgattgatggattcattgattgtagacacagtctcactttgttgctcaggcttattattattattttgttttttaagaaaggaaagaaacttgccccaagtcccatactaagctaatggcagaagaaccagaacttgtacctaggtctctctgactctgcagtctgagccctgaaggattacactgtgatttaggatggttatggattcacaggcaggactcactagccctgcaattggcctctccagcatggagttcctgaccattattcgtcaatctcaggagctgctttcaaaacaaccaatcgtcctttgaacctctcacttctggggtggagcatgatagcatggtagatgctgcagacatgaggcttttggttgatgctgatagcaaccctctgttgcacagatacataattttaatcaccactgctaagtaactcttattgatttgttcttctcagaatcaaagacacttttctctctctctctctcaagtaaattaaaaatggaaacatattgtcaatccctgaacacgtggtgtgcttttttccttcaggcccatcacatactgttccttctatctggaatgtccttcatctttttcctctgctgggaaaacccttccatattcttgaagttgcagctcaaatatcacgttctccgtcaaggatttcctacctcatccaggcagaactgcttcaccctttgcatgccctcaagaatcaggacaggcttctcttagcagtgctcactgaggctttgattatgggcttagggactgatcttccactggagacctcatgagtatggtctcactctcaccttgttccagtggccagcatggtgcttggcacattatagccttcaattaaatattggttccatgaaactgtgagattgagaacgtattaattcacaaggtaaataagtcataggtccaatactgaggcaaatgaacatgcaatcttccatgcacaaggccaagaatcccttgcttttaaataatatgaaccaaatcactaccaggaaagaggctacacctcacacagcggatcttcactctcgcctttccccaactcagcaacagcaggacaagctatgaaaagttcttttgtaagtttatgggaataataattcttttaataatttcaatttttattttagattcagggggcgcatgtgcaggtttgttacctgggtatagcaattatacctttgatattttgaacttaaaactgcactaatattttgagaacacaccacataatgttttcatttttataaaacaaagggaaaatcctctcactccctctcaaatgctggcattcagtgtgaaatcatagctggaatgtgacagatgtgtattgtgtgtgtgcacggaaggcctctttactaattcagaccaacctttacctcctcagtgtgagattatctactgaaataataatgactgatatttatatacaacttagaatgtatttgctttcagagacattacctggtttgttgtatgaagcagaaagcaaatcaatcaaccagatttatcattatgtttacactgattttgcagtagatagtaaccgagtttatgccttgaccaaatgtccatatataacatacagtcagtaaaactgttgactggctgtaggttcctgctgtgagaagtgtgatctgtgaaattctaacatgcctaataacatttattcccttatgatctagcatagatttaagccaggcaaaaagttttaacaaaaactgattatgcttgtcaataaccgtgaatagtatcccaattaagacaatggtcatttatttgttcctactgccaccagtgaaagcaggaaaagcatttggcaaatctatttctgtcaccctcagatttcaggaagagaagttcaaacagatgaagctgatgttactggaataactcattctactctaccattcttcctgatctactccccaggctctgtgagctgctggtaatcaaggatgtttgactgggttctgttagctgtcaaggtttactaagctgagttagttaatgagtgatggctggatttcattccaggacttcatatcagccatgaagcaattaggcatgtacttcatgatctcccactggaatttcaaaggtgccttagtctaccaaggaactaaattcagtgtggtctgaaaggaaacaataaacaacatttaaccatgagaggtagcaaaggacgtcttttctcagtgtctatgttagacaggtgaggaatgttgccaatttattttttgtccatataacctctatagctatttcttctcttgtctgtcgttctgaaattataaagggttcttatgagttgtttatgtgaaaccaagtaccctgacccacaggcaaggtattcctggaactgctgaaatagcaagccagataatgatatcatttaaaaaagtgccaggcaagaaagctctgattaactactgaaacatgctcagtggagatatttgtagctagaataaacgccattttaacatctcctctttatctagggtcctccttcctcatgctattattgtgaatatttcctcttcagattcctgcatacaaggaagactgatgaaagagagtaaaaatcacttttggagaaaaaaaggtaagagctggcagaggtaaaagaaagattctgaacctcatcaacagttgttgcaatctcactcacctctctggctaaccttcctccctccaccccttcactgctgctttcctgccactcacccagactggactttctactctgatgctccacaagaaacagaagtggtaagaagacaagcaggctcccgggggaagtggaggaccatatgaagtttcatgaaagaaatggcttcagggatgatgaggcaactcttcctaatacaaggggtaagccctagcccaggggcacacccatcctctaggaggccagggatggtctctgtcactcctgggaagtccctgcagactctacctgctttccaagtgcttcaggaaacatcaccttaaggttgaaggaggacaaactcaagcagttgcctatggtatggctaagggggtggcaaacagagggctggtgatttttacaagtaacctctcacaatacttgcgccattacttctcttttcatttgtgtccatgaatagaaactctcagaggatagtatgttagctccatggcctgtggcactgtagagtgagttctttagagactgaaggagttaagagtacctgtttagctaccagaagctgaatgtcagccggtatgaatggtatgtagctgggcaattttccaaaacccatgcgtggctgcgtatcaggaagactgctataaacaaatgtgcatgtatgcatagagcctgataagtcaatggggggagacagacacggaacagccaaccagcctgaggaaatatgcagagccgggtgagcttccactttaggtgaacaatagctctgtctcggaaacaggtctggatgggctggtgaacagttggaatgatcctttgactttttacacattaaatgtctgtttcaggggaccgaaagctggattctcaattttccaattatcctaatattataaaatcactaaaatggtgttttaaaaaaattcttaatatgtaaaacatgcaaagatacattaggtgaaaaaagcacagggcaaaactgcatttatagaacccaattatgtaaaatatatagatacatttaagatgatacattaaaaatgtcactaaaatataacacgatctttttgtggttgtgggattatacatgatttttgttttttctttctactttactttccaatttttctaaaattaacatatattattttcatagttaagaaataaggttacttaaattaagaagaaaattacctgtggatgaaacgacatctgatgatgggttatgagggttggggaaggccagaaaggcataaaatagaaccaaccacgtttataaaatgttaaattcaactggtcttcacgtctacacacattagtatcttctgtcttacactgtaaactcccagagagcaaaggctgtgtctaattctgtgcaatgtctggctcaattaaaaatgtagacagaatataatttttatgatgattacgcaaatgtagttggttctttttcactctggcagccagtttagtgttactgatgcttggacagtgacacagaataagaacatacattgttttccccctttaaaatcatagtgtattaataggctacttttaaaaaatttttttgcagcatatacactcatagaagagaccgatcctctaccatatttaaagtagaaagtaaaacagtactgtaattttctctgttttagcccatttccatgttatataatgaatgtaattccaaggatgagcttacagtttgatttccatattaattcaattactggactcgccactgactcagacctggaattaatataaaatacagggagacacacacaaaaaatgttccacttaagaaaccaaaacagccctaagtcaaaccactcttacaacactagagtaatatccaatgaagcggcttccatttacagtgttttccagaccccacaaagttcttttcagagttcttatattccctaaaatataaccaaggttactgtaacttttgaagtcactctcaagatgtacctatcaataaacagtagctttttgtttttttagtacggtggctgtaagaagttacaaatgactgtcagtgtggtttcaggtggtattcttattagaaatttaaaacacggtgttatcaaatttggcctaagtctgttcctttcaaggttatcgtaaaatatgcaggaaatgtgaaatcccaagtgcttattaaattaaactggagaagtcactttttgagagctcggtcctcatgcccctcccctgcccccgtgacaatggtagcatttaccaagtgctctcagcaggtgctgagtgttaagtgcttcacttgcatgatgtaacataatactcaaaagagctctggaaggtaagcatttctatcagtattttacagatgataggtttaggaaaaggttagggaccttgaccaaggtctcacaacgcctctgtgtcagagctggaatttgaacccaggtctgataactctcagagtgcaaactcttaaccactaaggacttgttcacttcagagggctaattaagtgtgaaatcaaaagcaatgaataatcgcaattatgccacttttaatttgagtctgttgcatatacataattggtcttcctctatattaagaaggatgccctataaaaaattagaaattctgccaacaaaaacctcctgagggaaactaagaacatctactaaataaataaatcaagtgtcttattgagaacacggcaatactgagaggcttgggtgtggccacctgacagatctggaggaaacctagaggcaaaatgtaccgaatattctattgcacaacagaatctatctgtggaaagcaccccctaaacggaagtatctgtcaaagtaaaaataaatcagggtaacagcatctaaaaaatatattgtgagtgagatgcatacttctctcatttactatggtacacgaatatacttagtttaattgtcttgtttaaaaaagaaacaaacaacttttcagcccaatctataaaactctgacaaggactaacatcaccgtgcagtcatgaagcagggcgagccagctgaggcttttggtagggtcttctctgcaatctgcttctactatgtgatgggtcaccaggagcgcaggctcactgaggactctgctttgcatgatgaagaaatcatctggatctgttcacagagacgggtcattccactcaaactcataaaagccaggctgacagattaactgaaatgcttatcaaccaatctgagaaccagaatttcccagaagagcagaggattaggatcagattattctgttttttaaaaaattaaaacatttcctgagcacctactatgggtcaggatctgtcgtaggcacttttacattagtggtttcatttaactctcacaaccgatctttggtgtgagtactttttaagtacattttagatagaggctgtggcctggagaggcagaggaactctgctgaggtcatgcagttagaggagcagcaaagctcccagaagagcacaagtgccccagtgctgaggctacgggtctcactatgcggaaaatcacaaagttcagaaggtgctggcaagggagcccagtggtcataggttgctgtcatcaagcctaaagacttaaaatgcactggtgacatatggctgccagttgggctgtcataatcaggaacatccctaaaactttcaggctccccaactccttttggtgactgtcatacagaccagcagccagctgtttgcttttgatataaatgtgttctaatttctaaaatgtaaagtttaattatctacatttattttattttatttttcctgatagaatgtcagtagacacaccatgaatttgtatagaatgtcagtagacacaccatgaatttgtttaagtgtgggttaacttatgggaattttatacatagctaacttcagtcatttttctgttgatctgtgatagtttcagtttcaaatgatattttctgccactgttccttgaaattcaaattttgagggtgctcattatttggtacccgggcactgatttattcatatctattaaaatacatatataaaaacaaaaataaaacacgaagaaaaaaagaaaaaaaatacatatacaagtatacacggtacaaaattgtgtgccatactgtgtactcattcatgaccaaaagacactgatcatttgtaagcttattctagtaaactgaataaaataatatagctaatattttatacttactttttctgctcctactgaaaaactggacatcttaatagttacttcatactaccaatctagtaataaggtctggtggccccaaaatgaaaaaaaaaaaaaaaaaaagcgaaaggggactgagtatttacgttttttagcattggattaaaaaaaaataaaaaacaacatcagtttccaaaggctagctctgaacattttgcctcctcttgaccttaaattgtgggctcaccctggagaataaatcttaatagtgaattatacatagcaactttgaagacaaataatattagtgcagcctacccgtaattactctctttttacaaagtttcctaagaaaacagagccaaaatgcttaaaatttaaacagaaacagagagagtaaatggctgtgaaacatacacatatagaaatttatattgtatatttacatttggtctaaaagcaacttcttaaaattcaccaacagaaaaaaacaaatacattttttggagagaagcaacaatgtaggtaaagatcacagattgtttaaaaggcatatctaaacatctaagagacagtctttgtttaaattgaactaggatttcctggagagtagtaaaatgttgtttcagtatagtgaatgtgcaagttaacacttcaagagtgggcttccggccgggcgcggtggctcacgcctgtaatcccagcactttgggaggccgaggcgggtggatcatgaggtcaggagatcgagaccatcctggctaacaaggtgaaaccccgtatctactaaaaatacaaaaaattagccgggcgcggtggcgggcgcccgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagagtgggcttcctttggcttcaaactaaacagctggacaggggatgctacttaattctttttcttccctaccagaaggaggaggtgctcaagtatttttctttattctttcatctgtttatctgctgagcaatagggatcttgcttcaggttggttaatctgctgagccatgacacatatgagaaggttctctggcaggacagtatgctctccaaacagagactatggcagtgaaagaaccaaagatatatcatctcccctctgaagcctctgcttctttggggtaggaattggtctattaactctgagcattttttttttaaagatggagtcttgcactgtcacctgggctggagtgcaacggcatgatctcggctcactgcaacctctgtcacaggggttcatgtggttctcttgcctcagcctcccgagtagctgggattacaggtgcacaccaccacactcgtctaactttttgtatttttagtacagacagggtttcactatgttggccaaactggtcttgaactcctgaccttgtgatccgccctcctgggcctcccaaagtggtgggattataggcgtgagccaccgcaagcagccaactctgagcatttttaggcactaacattccaagcgtctgagattccaaataggaaagtgctattttaaatgactctttaagctaccattacagataactgtaagaaatattcaggcctgaaaaaatgttcattcatcaccaaaatgtgaatcacttctaattgatttactatttctgctcttctgctaataacagaattttgtcactatccacaaacattccagaacacttatcttacagaacagaaaagcagttgtctatagtaaaaacactccaagtttcccttacatgtcacactgtagaaaggaaacaaaacccatttattttctcaactatcttgcctgtgatagtctgtgtacgataaaatttatagaaaactaaaatgctagagtccctacagacttcaaagataatctggcccactgatttctttgtaagctgaagccccttggcgaatctgatgggagctatgaaccattctccctccagaaaaatgtatatgcataccaaatattgtattcacttcccagcattttagagacaacccctgaagccaacctaggctaagaccccagaccaacgactctgatctaattccactgctttgtttcacatatggagacaccaagttccaaacaggggatgtggcttggccataattgctcggcagaaactatgagaaagtaaactggatgaaactgaaaatgatgcagatagcaactctgaaccatcacaaatcaggcctatcattttgctaggaaaggagaaaaggtgaagtgtttcaagaggagagctttctttcattttaggtttctggttgagcttctcactggttttcttcatcttgccttcgggccaggcccatccgtgacttaaggctaccttttcttgtgtttgcttctgtaaatcagtaagacctgcataacctggccacattcagaaaggagggcaagtgtgagagtgtgaagtagaaaccagttttaaggaactgtaagagttctaaagaactctaatttggtcacataatggatatttaagaagtattctgaatcaaacactgctcacatatttaaggaagtggcagtctactaaactgtcaccgagtaaaagtcctagagacttgctttaatgattagatggaacaaattttcaactactgcattcatccgcacatttgcaaatggctcattcttttaagaactaaaacattcattctgggattttgtatttgtgtttagttcattgcaaatttactcaatatatttcgaattcaattcaacaaatacgcttaggacattccaatgtgacggaatggaaacgtgcatggattttggagtcactaagatccaaattcaaatattggatctgctttatctagacacgtgattattgggctcattacttaagggtctctgcgtttccccatctgtaaagtgggaataataccaactactgtgcaaattgggtttgaaaattagcaataatatagtctattgtaaagaggctaatgcagtatctggcaaacagggattccataaaatggtaatacttaaaataatgattatttatcaaatatctacaaaggacaaacttcatcctagacccttctctaaaatctgaattcataatatcaaaatgaatgaggatttaattcattcttaaaatgactcgaatacttgctaagattttgacatattaaaaactataaccattataaatgaaaaggccactgttcaaatgactagctttgctacagtacaactgtcagttttttgaccaaaaggaaatttataataccattggtgggttttaagtctttaggtaaaaactgtgttttaaagtaacagaacaataagacagcaatatagtggtttcttaatgactaaaatcttacattacatattatggttcagtattaatgtgctttcacactacctactgagttttcagactgcaactacttatccttttcaaattgctatcactctctttttcatgggagatttcttacaaattccttggagaatccaaaaatttacagtggaaattttttctcgattcctttttttttttttaaagaataaacctattcaacaggtaaatctaaataatttttagcagttctaaatgtagagaattcataacttcttattgtaattgaaaaggaacatacaaagcaattagtcacttacaaaacccacgttcaaccttcaaaataatgactaacttgataggagaggcaagacttctttaattaaatactaaagtctagccatttgagataagcaaagcaggttatacaaccgtcttctgcactcacaatatccttttctccctcttggaaatatatcatttttcagcaatagtagaacatgtaacaaaaaaagttactgtactgtagaaaatcactctaaccacaagctaagtttttggctaagagttaaacttcattcatttggatttcactagtttcacaagaagaaaaagtgattaaccctagtgtaagtaaaattcccttgagaatatattagattcttaagaaaacaaaacagtaagcaaccttaggcactcacttacatataaatccttagggtgttaactgaaaagcattcctagccatgctagaataggattctcaaacttgaacactgattacctttttgagagctctctggacaggtgtgctcagaagcactggaagatacaggagagtttgatacacattctgagaaagatggggtggctcctgtgtgtgcatgtggccatctagcacaatcactattcagcacgggactacatttcccaggccacttcacctccaggtgcagccacgtgactagtgctcaacaaaggaatatgagaaaagatggtgctttacttcaaggcgactgtgattaagaagtgaggtgcagacaattgcaagatggtgttacaggatgaattatgtcccctcaaaattcacatggtgaagtcctaacccccagtacctcagaaagtgaccttatttgaaaataggaccattacagatgtaattagttaaaatgaggtcatactggaagagagtgtgcccctaatccaatatgactggtgtccttataaaaagggaaaatttggatacacacaggaaaagagggaagatgatgtgaagagactcgggaaaaggtgaccttctacaagccaaggagcaaggcctggaagagatccttgcctcacagtccgcagaagaaaccaaccctgctgacaccttgatcttcgactcctagtctgcagaactgtgtgaccacacatttctgttgtttaagccacccagtctgtggtactctgttacagcagcctgagcagacaaaatagatggtgaggccagaagacggaaggcacctgagttcaggattcctgaatcacctctcaataaaagcacttcactgatcagaaatacttccactgggctgagagctgagcaagaaaggaaactagttgtgtcaaaccattcaattttgagggcttatctgttataccagctgtcattacctactataggacctaattaatttaagtggcaagtaattttaaattattttacatgaaaacaaacatggacctatcacatatcacagggaacaatccatgtaaaattttaggattaaaaacacttcaaagaaaatttgaatttacaggaagatattttggggtaaattctctcaaatcctccatagggtataaatttactctcttctgccaatagaagtagaatttcctcaagaatattaaacaagtcacaatgtcaaagttgctggaacttcaactacgccacataatccacttaattttttttttttgaaattaagtggagcatttctatcaagtagcccaagtatgtaaaattttacttgggtactaaagatgagaacactgtgaaatgagttatcagccttttccaaagttctcaatatttttataatcaatctgaaaagaagtcactaggtacagaataccttctgtttgaatatggacaaaaaatgtaccctcttttatgacagggtaactgatacagaataaatactggataccattttccatttttgattttttttttctgacatgaagaaaaaatgaaatgataactatcttcggtaagacttagagttatagttcaaaatacctcaaaagccgagctggcagctggcttctcatgtttatagaaaagctaggatgattcagcctgagctcagagctcaatttagatcatagcatctggattcaaaacacatgtgagatgtggcagccgattttcaggtcatgactgatccaagacagagattgcagaccactcaccagcattattccaaatggagaaagtgcctgagagaaacagaagtctcaaaggtatttggaagcccactccaaactgttagggaacaggtaacatcagcattttctgcatccagcagctttaagcaggtgccgcagaagccaagggcctgaggatgacactgaacagctttgtcatgacattcagccttgccatggtcagaaaacatccctcacccatgacttctttcctgaactggctattgttcagattaaactatgggaatctggtaataaattggaaaacctctgacagcacacacttcctgctaagatctgtgtttaactttgctttgtttcgaagagaaaaactgtagtaaagaaaaaggaaaaataaatgtaaatgccctttttcttgatgagaagaaatcatagtcacagtaattctaatataaactacacaatgaaatctaaaagaagaggggaaaatccccagctcagtttcaatctctattggaattcaccttgtgccttccttgattttccttggatatgacatgtccagatgtgggtgattctgcagctatggattttatgtgcaataaaaaaatgcttctcctgctgcttttcctcacctcccccctcccccatctcttttcctctctctcctccttgtctctttgttgtgaatgtcagggctgtcagtgtcacagtctgacatgattagcgtttctgacattacaccaagaagcagacagagagcaaggagagcgagcagaggggaaggcagttatgagtagccatttaaagaagtccaaggaaaaaacaagcacaaccacctttctctgaggttccttgattacagggcagtttataaatcaccttggatttttctcatttatcctattagtctgttttcctgttcctctggagatccctaaggtgtggatctagtctgtgagatcaaagccagcggctctaataacagataagacagaattcgtgattcagcggattctaaggttgtgaagtgtaacaatcagcgcactttgggaagatagcgccagtccatttcgagtattgattcgctgcactttgtcactctaatgatgttatctcattaaaagagataaatgccccactgttcttctaagagcatctgcttcttactcttctctctttttcaacagcatggctctcagcagcagcacattaaaatcaaattgaaatccaatgcaaggcttggctacagagcagctaaggtatctttttaattgctttttcctactctcaacccccttccagctcctccactacagtccttcaaagaaacaagcaacataaagagaaagagatgtagaaagtaatcataatagaaagcatttgctgagtgtctgttacatagggactccactgtgtcaacatttaacttattcctaccttgttagataggtagaacaatcctcagtttgcaaataaagaaacggagttttgactttaggtaacttgcccaagatcatgaaggtagcgagagaatgagccacaatttgaacaagggtccattcaatgcaagtactttttttttttttaatctccatttcattcatggaacaaataagaaaatatgattgcaacttgattagaataggtgaaaaaatgtaaaagaaggtagcaattattcttcagcctgctaatagccaagaacacaatgccataggttttgtttcaacagatttcttattaaataaaaaaggtagcaatttttcataatgaatgttttatacattattcctttgtgtatcaggcctctaaagtacacattattaaagtctattaaagtctgtatttagcagcattactaatgtgcctttggggaaattattacaatgaaacagcatcagtctttcacaaaatttcaattgtttaatattccttttcttatcttcaatacacgtgtctatttttagctataatcagacctcatcccaaatgccgtaatcccagcctagagctgtcacagcaaattgtttatgggttggatttaagaaataacaagaaacacagacattgttaatttcacccaacactttttttttcatgattggttgcagttttcctacagttctcattaacaggtgctccttgatcactatgacacgcgatgatactttatctctctggttagggttggttatcttaattaattgcttatatttatatttaactgaaactagcctcaagatgccactttattaaagtttgagagtggtaagaaattacaaaactattccattaaaaaaaatagaaaagaaaaccaaataaaccagaagaacatataaactatgattagtcaaatcaaatctctgcatttaaaagtaaacatcatttactagatgtctactggactagaaatatgtgtcttctgaacagtaactgaggagtttctgcaaattattctgcaaattgtaaataggcatctctacctttttattacattaattttatcacacagtatgaagtttttttaaaaacaaagccaatgatgtacatatattcaaaagcacaagattctctgaaaatatagaaaatactgctaggcttattttacgaagacaaaggacaataggaagctgggaagaataccagcaaacagctatacgttataaggcctctgtatcacaaaaatgaagggaaaataaagccaatctaaagtattacgtacttaaattaataaactggattggaagcaatcattccattataaatttcctttcatacatagcaatcccactgagatgatacctttgtaaaatcaggcaaaaatcaattgttaatattctagagatggacaaaccacagattaagtacctaaataatcatgtttccaatcaccaattaactaagtagaattctcttaattgtatctattaaggcctactaattgacagaaaaagggcagagttgaggacttggagaaagaagacagaagcattcctctgcctgattcataaaggtcagaatcccctggccgttgttgtaggaacccagccatcaccagtcacaaagaaaaaggcagcagcacactttgagtatccaaagggcctctttactgaggctgcatggctgttgtgggcttagtccaacatgatgatgtaggacaagaacctaccagttcaatcaacatgcaattaaaactcctgatgaaggacggcccagggcagtccattggtttggggcaggggacgcagagaagcaaagcctgttttaattaagaaaatactaggcactcctctttaaatcctcaaaaaatgaggatgaacaagattccaaaaccaacaatcacaatgtgtgtgaaagtaccagcaacaagaatgaagtgggactgaatatgtgctttcctacaaatgaaacctgtttgatggtgtaaggaaaatggatgagctgtggtcaagaataggccgaggcagacatctagtccagcatgactcagcgagtttggagtgcaggcacacagctctgcctgttatgtaaccatgccatgtgaggtgcattaagtaaccactcatgtgtgctcatgcttgactcggagccactattgtctgtaaaaggtataattaccctgctaatgctgtatgtaacggcttgcacctgtggctcatcctcaggcttgtacccatggcttgcttgtgcccatggcttgcttgcacccacagctcccgtgtgtccagagaataaagccatgttgaaatgcccccatgattccttgactggtctttcagctgcctgccactcatccaccgactctcctccgacctcagttagaacccgacagatggtcagtagctgcagccatatttcaaagaagttatcatgattcacagctaggcctctcagacttgaaattatattacagtcatgtcaaaacagatcctttcttctctggggcctatagggtcttaacacaaagtccagcttttctattccgaagacttaatttacctcctacctcttcagactctccttcatcttttctgacattatcagatgttaagtcaggccacatgaccctttcactcaagacaaggcattgccatatccatatgacacggtagtgggtgcacagagtctcagggctagagctcactttgaggtgctccaacacaatcattcatcagatgctcaaactctctgtacaaaaaggttcagattttcagcataagccctggaacatgaagactgtgatatggtttggctgtgtccccacccaaatttcaaactgtagctcccataattcccacatatcataggagggacctggtaggaggtaattgttaactgaatcatgggggtgggtctttcccatgctgttcttgtgacggtgaataagtctcatgagatctgatggttttataaaggggagttcccctgcacatgctctctcttgcctgctgccatgcaagatgtgactttgacttcactcctcctcaccttccatcatgattgtgaggcctccgatgtaactgtgagtccattaaacctctttttctttataaattacccagtctcaggtatgtcttttattagcagtgtgagaacaagctaatgcagactgcttcttggagaagtagacaccagccagtgcttcaccacacactgctctgagatttggtggtgagccatgcacacaaagagagaacaacggaaatgtgtttctggttagacagaaaggaggagaagagatgggactgacgtagaagcattaccatagttccatagtcaagatgactgtgtacaaagagaagtctacgtaacttaggaagcaatcctctggaatgtatatgtttcatacatatttacacacacacgcacacattatatgcatgcacgcattttaaagacaaatgagcgttaacatattcagttaattattttaaatttatcttatctctctttcatgccaaatcgaccctctactcaattacatggtaagttgtattttaaatttgcacttccatacctctcagaagggagttatagtgctattttcttccggaaacttcacagaatttcccagtacaaggcaggtggagacagagtctggaggtctaacttgccctttaacatttccatgcacctcacattcgacaggactcaatgtacacgtaacagaggggctacagtggcctggtgccagcaatgtttctttttggcttcacaaactctataaaaatgaagttttttgaagagctaagggaaattattccttaaaaatgtagaaagtgagaatagaagtgctacaatgtccaagggcactcactgaccaggactgagggtccagattcttgttagaggaaagcctgccacatataagacataggcacagtctaactcagtcgttttcaaactcatctcacggcccttttacaggctcacaaatgatcgcagaccctaaagagcttttgtttatgtgagttgtttctatcagtgtttaccatactggaggttaaacccaagaaagttttgcaacatgaagacacaggcacacatcccagaagtgatgtcattgcatgtcacagtctctttaaacaccgttgtgtatagtcaagagagaaagggtgaaacaggtaaattgtatcttagtattattataaaaatggcttttatcttgcaggcagacagcctgaaagggtctaagggtgcccctcccaagggtccctaaaccatagtttgggaaccactggtctagttcaaacttgtacacatcggcagtgtctttgaacacgtaaatgaagaaatggcacagtaccgagtaagaggatgtactgttaatttttaaaaattgaggcactgaatcaaatgatggcatctttttctagagcatttctctactcactactgcccccaaaccattagtaaattaaaatgatccttcctggtaatatgccaagcagaatgaccctaggtccaaatctctgttttgaccactctctgttttctatctgctcactaaatatcttcatccatttgcacctcaaatgcaaaacagctaaaatagtacttattttttaaatgtttggttactaatctggttgttaatgaaatacacaaatattgtagaaaagctgaaaataccaaaaagtattttttaaaaaagaaagaaaggtgtcctatgtttccaccctctgggaaggccatggtcaacattctgggcaatagccttccggtctttttatcatgtatattttaaaaatgcaatgaagttcatattttaaagataattagtatattttatttaaaaatatttttagtatgaaagaaatgcacattgcttaagaaaatctagaacatacaagcaaaataaagataatgctcataatatgttgatgtgtataagcaatctttattctgtgtgcatactgtacctttttttaaaaaatgaaatgattagactgcacatgctgttatataacttgtcttcttcgcaatttatttagaacatctttttatgtcactcagtattcctcaatccctccttggcatttttattatatggctgtactatggttattcaaaaattactattttaagaatattgtgatgaacattttagctaaacttctgaacacatccatggcggttctctttgagttaatgttctagaaatggaaattctgggacaaaaggtatgtcaattttttaggcgttgatacaccttatttaagtccccttaagaaaggtgttctttcattaactgtgtatgacagagcctgatgttccctactcccaacttcactgggtaaatgttacaaatcttcatcaattgtataggtgaaaaatactatctcatcattttaatttgcatttctttgattgctgttgaggttgaacatttttcttctattttgttgatcatatttctttctttgttggtcttacctttctgttcttggcccattttctattagtgtaattatctttatgttataaatctatattaatttgtaagaactcttaataactctttctcatacatgggtaaatactgccccagcttgtcttttatctttcagaatagttcagaatgtcttttgattgaaagaagttctgaggtgttacatagctaagtacattctcttccttgataatttctgacactagaaattaataaggccttctttattctaagatcatttaatttttagttgtattttcttccatgtcacaagtttagaccttgcaatagctcttcaaagtctgccacaaggaggacctggccaatgccttcagaaaaatgactgttgaggcttattaaatatagattggacatttggtgaaacaaaccattgagggtgtcctggaaaggagagagatcttttatgtttattattcaccaattccttacacaacctccagtagctctgttaacttgctctttaagaagtttaaaatgaaaaaagtgttcatattaggtttatgttaaaatattaaaccagtgggcgtgatgactcttcttacctttgccagaacagcagctgtcttagatagaaaatacctttgctacgttcataatgtatttcttgcaagcacagtgcatggcatatagtatgcacttgacaaatatgtgttggagctgatgttttaccaactagagctctgtatatgccaggtttggggtgagagaggcagggataataaagtctggacttcacagcttcatatgaaggaggtgcaatgaaagaaaaactccaaatgaaggtagaaactaaatttcagttttactttttagttgactgtagagatactgatctgcgtgtaaacgtgaaactgcctcagacctgggacagtaggatgtggtgctgaatactggaaaatattcagagaaaaaaaaattctgctgggcagatcattaagcaaaacagtggcatccacccactaaaagagacaaggggcactactctacttcatttggatgctttggcatttgtccaaagcaataaaaatcagatccagcttgatctgaacataacaaggaagaaacagttctcaagaagatcctttttcatgatgggggaagagagagggtcattttgtataataatggaaaaatcaattatttttcaatcagatggagtgtcctcataaatttaaagcacagaacagcatgtgacatgccttcataaaaaacaatgaccatgagggagaagagtaaaggatcataatcccaaagttgctactaagaaggaaagatctttcaagagaagaacaacacttttcttgctagtgtgttttctgtgaatgtacacagtggtcagtatgcactgaacgtacaccatcctgcacaatttgcctctacagaatcctgttcaattggcttcccatttggctatggcttttaagtgacacactgaaatcctttctctatagcatgataatgcagcagtaacacagataaaccagaaatgttggtttttcttactggcaaatatactatatgtaatatatatttacacatattagcaagaaaataaccaagaaagtagtagaaatacttttgacagaatttaaaagttaaattttggccaggtgaggtggttcacacctgtaatcccagcattttgggaggttgagatgggaggattgcttgagtccaggggttccagaccagcctgggtaacatggcgaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcatgagggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtacactaacatattccctgtagactggcctcagggatgacagcagattcttgatgggccttatgcgcaggaatgccctctgcttctctttttagctggcactgatacaccaacatgcgagctatccaaagtcccaaagtacacccctttctggtgtttcctcagaccctggcacagataggagttcaagaatgtgaggaatgaaggccctacctgatggacagcaactcatgaggtatcagggtagtcctgttaaattagtgcggccaactgctaatccttttgtggcacgggatttgggggattctgtgttttctagagggatggtctctaatggattcaaaagagagctgtcaatgtctaactgcaatcagcatcgccctggcacttcaaaggaataacaaggaccctagaacgccagggccaccctccatccgaacacctccctaactgaagtgccccgtcagtgagctgggatttaggaagaaaggagagcattacagtgtgtgtctgaggaagaggagagtgcacaattcgaatgtctccaactttctaggaacaaatccacttagaacgtcagtcacacccacaacaatatttctagcactccaactaacaccataattgaggaggagattctctggttttattcatgctgagaagagctgtttcctccccagagagtgacctattctttgtcttatgccaagaaagccataagaaaaatgctgacctatgaaggtgacacatcatgcttaatcactactttcaattaaaacaatataaaataaagaacgtactgagccactcaggcagaacataatatcccaagcaacagacacacctactgagacttgacatttccgaggagtctggttcccagctgtgtgtggagagtgaatccatgacattagatgttgggttgccctggagaaacttagggcggagctgtcacagcaaactgcatttgctgataacagatttcccgagttgccttagcttttcaatacaccaaactccaaatactaggagccaaaaaaggtttgcagccatggatctcccctcatccccacctccagtcatgaccctggggcagaacacctgcctactttccagtattctagcagctaacttctcaaaggaggcttaacgccaagtgtttaagctggggtggggttgaagcgggaaaactcagcactggtttctttctctttggctcagctcagccaaacaaaaactcctcaaaaacaattgcttgtttttttgctggtctcttcagataggataaagcggccagagtctcccataaaacttgcatctagggaaagagggtaagtgcacagagggcttttccagctttctcccacccctgaagctgcccagggcccttcgtgcccatgagaaggctgagtaaatgaccatgagaaaagtcaccactggaagagggtcctttagtagaagaatttcaacagggaaatgggctttctaaagtctagagattccatatgctcttttcacaaccaaaccatcgaacagggctgtccaactctaccacaatccatacaacaggcccacaataacacacctgtttttgtaggctccggaaacaactctcccctgttttaaatccttcagtggctcataggatctggcccttgcctccttctctgggcttatatttgaccaccttccacttgtgcagcagtttccaaccaaggggtaattctgtccccgtatgggacattgggcaataatctggggacatttttggttgtcacaattagagtgaagggaaggggatgctacaaaaaatcctaaaattcagaagacagtctctcactgcaaagaattacctggtccaaataccaagtgtcaaggctgagaatccctgctccagccataccaaactctttgctgttctctgagcacaccaggctttctcatatgcttttgtgcctaaacacattcctttacctggaatgccttgccccaccttccctgtccaggaaattaccatttcccatctaggatcctactcaaatgtcacctcctctacactgtctttcccagattccccagagttggatgttcctttttctgtgcctccaaagcttctggtacacaccttgctagaacatactcactatgttgacccaagatagtctgcacacgctaaaggcatctcaagttgtattcttcgtttattcccatagggcccatctggtaataaatcaccactcaccaatttaatcagggaataaatcaaaatggaaaagatgcaccttacactctcttggaactatgtctaagggataacagtgtccccaacattaaaaacaacagcagtaaatatgtatcaagtgcttgtaatgtggacaggtaccatattaagcactggtatacgcagtaactcatttcatccttgcaataatcctatcaggtaggtatcattattatcagcattttacagatggggaaattggggaaccaagaagtcaggccacttgtctagggtcactgacactagcatcccaaaaaagtgatatttagtcccaggaaatctagccccagagtctcaatattccaatattcatgccaaggcagttacactaaaacccagtatttcagccactcagaggcccctggcaagtataaatgacacctccagaggactacgcagccagagtagccaccagcacctgtgaccctgcttgtgggggatcacacgactctccaactctgaaatgcttctggcaggagaagcaacctcttcacatcatggaaagacatatgtactccagaaaatcatggtaccgtaaaggaaatacaagtgctgattcctcaaagtacctcttaccttgttcatgctgcagggatgggagcaagggatcagacatgtcacagtgcgaggaagttcttgaagattctcctcattcctggagccctcactttctgaagcagacagctgcactgtgaatataaacaaagaagaaatccatcagctggtgcccaggaaggcatagagcactgccatgtccagtggcacttgctgtcatgatggcaatgatccaagtctgcactgtccaacatggtagccactagtcagatgtggctattattgagcacttgaaaagcagctagtgcaaacgggggctgccaggactcaacagctagaactttcacagatttcctagaaaggcagtgtaccataagggaattcaggaggtcagtcttccatgggccaaatgaactaaacagtccaattccccccaaacagtccaattccccccaccatgttttcattcatgctatttattctttacatggcgttttttgattcatatgaattacattttagagtaaaagggtcattgtacagtttcagggttcttctttgtcttttttgtttttgtttttgtttttttggcatagagtctcattctgttgcccaggtttgagtgcagtggcatgaccacggctcactgcagcctcaaccttctcggctacagtgatcctcccacctcagcctcccaagcagctggggctacaggcgtgcaccactatgtccagctaatttttgtattttttgaagagatagggttttgccatgttgcccaagctggtctcaaactcctaagctcaagtgatcctcctgccttagccttccaacatgctgggattatgagccaccatacctggccagtttcaaggttaatttgtcaaatattaggggaaaatattttaaaaatgacttcaattacttaaatggacttgtagccttttcctctgaaaggtgtttacaggtggaactgagaggagagcaaaatattgtaaggttcctgatactcaatttgtgtgttatttttttaagttgcatctaggagggatttatatatctgcaccttcccataatacatggaatcggaggtttaactggaactgcagtgcttttaaaaatgaaaaatatactatttttaattataatatattaagactatagaaaatgttcaacaggaaaagaaaaaggtacttataaccccacaagcccaccataaccatctttagttcttagtaatcagcctttgtctacactggagaataacatgtctgctaactaagtccaggacatggagaattccaaagctgtattccccatattaacatctttcactgctaagaaaatgattttgcaatttacattttcaaagataaactcctactccatgcacattactattctatgaacataatattactacgttccttttataaatcagatgatagagagaggaaattgcaaatcactccttggctatttgaaatacagattccaaaaaaaataccacatgcggattaaagacttaaatgtaagatctaaaaccataaaaaccctagaagaaaacctaggcaataccattcaggacataggcatgggcaaggacttcaggactaaaataccaaaagcaatggcaacaaaagccaaaattgacaaatgggatctaattaaactaaagagcttctgcacagcaaaagaaactatcagcagagtgaacaggcaacctacagatgggagaaagtttttgcaatctacccatctgacaaagggctaatacccagaatctacaaagaacttaaacaaatttacaagaaaaaaaacaaccccatcaaaaagtgggcaaaggatatagacagacacttctcaaaagaagacattaatgcagccaacaaacttatgaaaaaatgctcatcatcactggtcattagagaaatgcaaatcaaaaccacaatgagataccacctcacaccagttagaatggtgatcattaaaaagtcaggaaacaacagatgctggagaggatgtggagaaacaggaacacttctacactgttggtgggagtgtaaattagttcaaccattgtggaagacagcgtggtgattcctcaaggatctagaactagaaataccatttgactcagcaatcccattactgggtatatacccaaaggattataaatcattctaccataaaaacacatgcagatatatgtttattgcagcactgttcacaatagcaaagtcttagaaccaacccaaatgcccatcaatgatagactggataaataaaatgtggcacatatataccatggaatgctatgcagccataaaaaaggatgagttcatgtcctttgcagggatatggaggaaactggaaaccatcattctcagcaaagtaacacaagaagggaaaactaaacaccgcatgttcttactcataagtgggagttgaacaatgagaacatatggacacagggaggggaacatcatacaccagggcctgtcggggggtggggggctgggggagggatagcattaggagaaataccttacgtaaatgatgagttgatgggtgcagcaaaccaacgtggcacatgtatacctatgtaataaacctgaatgttgtgcacatgtatcccagaacttaaagtataataaaaaagaaaataccacattcagtcatagcaatagcatattttaacaataatgtacaacacagatcttggaattccaactttgtagtacgaatacatccaaacatctccacatgtacatgatgcctgggtaatcatggcttcaaagtcaagaaaattcaatatctaattgtaattgatcttaaagtgactgaaaaaaataatgcatgtaacttttactctttcaatttccagaagcatgtgctaataaatttcttagttttaaagtagaactttatacatgctgtttccttttcaatgtatgtatccatccatgtaaaaactacagcctagcacttaactggaaagcttgcccaaatgcctagcagagatgcctcatgtcacaattcaatttctatgtacacattggtatcaacacaggaaatgtgggcacaagaagataataacagacaaggattcttgaacatcatttccctgaggaaccccacccagctccaatcatgccacaatccccgtactctcagaacttggataaatagcttgcactaaactgattacggatcccttcctgcccccgccccaactgttcttatgtcattttcatgtatgttgttttacaaccgaaacaggctaaaaaccctttgagggaaacatcagacacacagaacgttttaaaataaatattacgatagttttttctttgctgtcactcacagggcctaggatgatacagactcttaagtgtggggtcttaaaaacaatgttaataattgttgcagctgcctttggagttcttttaaaaaggaaaacctcttaatgccagggttgtaaatcttttaaaaaatattaagaatgtcatacaactgtatagtaccccaaactgtacaatgcacttttatatattaatactctcatttaatactaataccaatctgggtggtagttttcctaatttggaaaccagacacagagaggtaaaagaatttttcctggttcttgctataataagcaatagaccctggactagaagtgacttcatttcaagacgctatggaaataaagcatgtgaaagaccagaaataaaaaataaacacaacacacaccccaaaacaacacacacacacacacacacacacacacacacacacacgcacatgcacacaccaagaccaccatttaacagaaaacgcctcagagaacagatgacaattttagaaactgggtcagttcacttctggacagcaaccaaaaagactggccttgttctatcaagtactttccatctcctttgaaatcgagggaacctggttgttttgcagccaattcagtttatgaagaagcttagcaaaatctacagcttaaaaaaggagactgcatcttaaatataaagcattagggaaaaagatacctgagttaccatggtggaatcaagaatgttttcttttttagtttattattcaatgtttctttttattgttttaagaagttggattcctctagtactgaacaaaaggaaaactacagacgtctttaaagggtgccttgagaaagttaatcccataagcccgtgtgacttccactcagctgatcctaacagttggttcaatggtcaatcttagacttctaaaaggttaatgaaacataatttgtctttccaggtggatagaagcatgggtaagaagaaaggtggtccagaattacagaatcccagcactttgtgaggctgagacgggtggaccacttgaagtcaggagtaccagcctggccaacatggaaaaacctcatctctactaaaaatacaaaaattagctgggcatggtggggcaggcctgtaatcccagctactcaggaggctgaggcaggagaatagcctgaaccaggaggcagaggcactgtagcctgggtgacagagggagactccatctcaaaaaaaaaaaaaaaaaaaaaaaggcagagacaaagtaagtctaagaagaagagagaaatgacaagaaaagatgaaagatataaagaatggagaaaaacaaagggcggcaagcaaacaaagacactcagagataggtttggtaacatggccaagtgcccctcaccagccaggtcctcgctatggaagagacccagagatttgggctcctggtgacaattccacatcctatggcttctctgagggttatactctgatgtcttgggtgtcagcaaatgggagttggagaaaacaccaggcgtacctgattcaccactatttatttaccatcaacctccatctaccatggagagaagcctattttacctggatcactgttaatgtggtatagaggtatgctgagaataacataagccacctttaatcctatgctctttaaagagaagcttaaaagtgtcaagggctgtgtgtgtgtgtgtgtgtgtgtgtgtgtgtgtgtgtgtgtgtgctctcctgacccttgaaaatgcaactaatactgccaaatactgaatggaatatggtgagttgggcttttctccccactccaactcccacccccttctatgatgtccattctagaagccttcagtaatatatgtcaaagctgggtagctcaggcactcctgtgggagatagataggccaacaagagcaagcaggtcactcttcgcagtgttaaaggtctcactagcttttagacataacgtaccatgaggccagtctgtgggatggactcttgttcctacccttcccaccaccacgcccagcagcttaggcagagggctggggcatgagggcctatgccaggcccaagagcttttggagaaggagtaagtgaagtaatacaaggtgaaccggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattgaaggatccaaaggcaaagaaactagactcctgcccccttcccccaatgcatacacaccttctttccaagtggctggctcattccctgcttcctaaagaagaggcaagaggaacagagtggagcttgccaaggagattcctgcaggtccctctccatcctcaaagttacagcagatgtgtggctgtggttctccatgacttcagtgtcctcgccaccccacatggaggcagcaaacacactataacatggttctgccccaagagaccagacgtttgccattctgctttgctcccctgtgcgctgccttcacagcataccatggaaaacagacattctaagccagaacaacaagagcatcttcccatcaagcatcaacaacagccttcctccccaaggataggttaggtaatttgaaaatgaatgttctgaaattttaactaatatatgagttatggttcaataggaaatggtaataaagaggaggaaacaagaggattataaattataaaagagagacacattgttggtaacacacgcacacaaatagtctgagagccagatggggagaaacagaggccaggaagggccaagagtgacaagtggtagagggtccatcactttcatacacccacttctggcacacaggctagggggttcttgcacttggtcaaatgataagtcaggatatctaatctttagattcagggctatcactgtaaaatgtaaatcgcagtctccagtgatttaggactatctcaatttaaaggcacaacacagaggagcccccaagaggttacttggcctggcccacttcccttgcctaagtgactatttaaaccaggggtcacaaattcagatgactgcaagggtcaagaaagaatgagatgagtgaaaggtcaggtctgggaagacagtgaggaatggggcatccggggagtctgctactcagctctagccccagcaaagcaggaacaagccccatgtgccaagagcttctgatactcaagaaacggagttgagagactgtgtaaaataatttgctgttttaatgttggaaactcatgctaatactttggaaattttgtaggagttgggtctggttggctagtttgcctcttctactgcacaccttccatgtcagtcaggggattctttgttcctgtaaacctccgggagagaaaactctctacctgcctcttggcccctctgggttgtactgctagggcttcactgcccacagaaagccagggagaagagtaggcaaagagagataggggccaagtcagtctgaatatcaactccacctctcggaatgtgatttttggcaagttactggctctctctcagtctctgttcctttatccctaaagctgggggaaattctttatatctctggagattcttttgaggattgttttgagcatttcacaagaagagatcttgtctattttgtactagtacccaaatacccagcacctatcccgctgccttacatacatacagtaggcactcaatatatgccaaatttaattataatgtttgggaagatctcctgtaagtctggcaccagttgaacctatttcctttcattctctcctcttctgatgctttaatgtcaatattcatatctacttctcgcttggtcagaatattttgaaattaaactttatagaagtccaaattaagaataaatactgaagttttttcttaagaagcatggcacacttttaggtcagcaaggcactatttgggtactactggtgacagctttttgcgcactttagaagaaaaaaaactaaacaaaagagatttcattgtcctattaataaattaaggaatcatgcattaagtttagcattctcaactcatgtttgccaatagtgcacgtcactgcaaagggagtacacagtggctattccaggcaactcttgatccatttgttcactttggattgagaaggctgaattatattcatctagaacaaatgtttactaaccatgtcttatttacctgggtttctttgattttatgctgaaagaatcccagacccctccaaataatttcaacttccctctcccttggcggggcggggggagggggttgctgtacaattcaggcaaacatatttcctatgatttggtgagaaactgaaataacagacagcctgatgggttacttcagagtgatccactgcaatgggagcactgttaaagaagcgttaagggggccagctatctctccaataaaaagtttctaattaaggaactaaaatattctcaagaagatcttggggacaagctataagtaggatgttaccttaattggggctagtgcttacaactgaaactgcttagcaagccagaatgggttatatgccttgttcctcttgagaagaaactttcattaatctgcagaagaaaactctagttggcctgaaggttcactgttaacctctgcttttctggggcttagattctgttccttttttttttttttttttttttttttctgagacagggtctcactctgtcgcccaggctggagtggagtggtgccatcttggctcactgaagcctcaacctcccaggctcaagtgattctcccacctcagcttcccaagtagctgggactacaggtgtgcaccacccatgcccagataattttttgtagagacagggttttgctatgttgcataggctggtttcaaactcctgggctcaagtgatcctcctgtgttggcctcccaaattgctgggattacaggcatgagccactgtatctggccatattctgtacttattatcagcatctccttagtgcagcttattctttttgagggagtaccatgtcccaggttgttaagcctctccacagggatctagtgtttgcctccactatggcctgagggcgttcaatgctctcaaaccagtttctgccaaaacagttgaagttataccatgcaggtagtagtgtaactatgaaccccagagctattcaaacagtgtaaccctgggtttccatccccctggtctgtgccccaacacacagacttaaagccccaaacagactggggaaaatcttcttgcccccctttcacaagcaattcctgtgtgagtatagacaccatagcccctagagcctagagcctacagctgggtctgaaacactctaaggccagtggcatcaatgtcttctggcacctaagaatttccctgtcctgctttaaagctcgtatgtacttgaaaatatttaaccaatataataccttaggactttttggggtgggtggtcagaagtaggccaggcttaggactttttggggtgggtggtcagaagtaggccaggctgcatgagctcagtataccattctgccagaattgggttccctaaatgcaattctgccatatttaggttccatatgtagccaattctagctgtcatttaggctacaactagaattatgttctttgtagcctaagctaattgctgtgactctttcactaactcatcctcattacagagtgccattgggggtagaaagtgcttacgggtagcccaggccttgagaaacctacccttagccagaagcagcaggtccaggcagttaccccaaggaaacaggtcaccttccttcccaaggctgcattttccacacccaagtctgccctcagttctgtggaaaggaatctgccttccattaacttttccataatttagaactggatgactgcacactgatgttttagtagaatgagagaagcaaagacagcaagaaatgcaacaagggcacaaccaccttaacacatcagggaggtctgcagggagtcactgcgttctccgacagcaagcagccaagagaacagccacagaaagcagttccagcagctgaccctggggtcctctctgatctcattacagcagttgacactagtcctcacaaaacaaacagaggaaatttatgcttgccttagctgtggaaagctccacattccttattaacgagagtttcagcttctgagaccacagccgctggaatggggaggaggtcagctgtgctcccaagaaagaactgtggctgctgccttgccctctttctggggctggatatacaggcagcgagcctggggcctaggctgtctgctcaggtgactgaggggaagttccctttctgctaatgtcgacttccctcggctcagacggtggggtcatttcctcttaaacagcactgggaaactcactgtaagggagtcctgaggggatccacctgctaaggtcgcaattccaagagagaggttgttctgcataaccatactcaaaagtactcttgcctgcaccttcaaaaactttacttaacttggaattccaacttaaaacattatttcatatcctttaattcaatcttagaagtaactgagcagccagctcatgacgtaaagcgtgagcttctaaaccagagtaagaaatgtggagcagaagttctgaaccagagtggttttgtctcccaggggacatctggcaatgctgtagacatttttggttgtcatgacccgggggagggtgctactggcatctagtgggtgagaccaatgatgctactgaagatcctaccacgtacaggacacaccccataataaagtattactggtccaaaatgtcaatagtgctgagattgggaaatcctgacggggagggaacattcaaggatatgggtagacttaaaatcatgccaactcataatcacattataataatgtggcaccatgcaacttggggtccccaaaatgtaaacaattaacaaccataaaaatttaccagttctctccttgagcgaagtaaaagctgtaacttacacagagtaagaccatcagagttgcctggaagaagtggaacagcttcagtgttggactatgttatcatcaatatcatcagtgccttgtttactccaggtcaaggtgtgatctgagtgtctactatcaaaattcagtggtagctattaacagaaggagtttatacgtgaagttctatggtcactaaaaccgtctaaataacctaagaatatctagctctggaaaaaactgcaaaatgtttcaacttttaaaataccaacaaaatatgaggaacaatgttgatgttgacctacattctatctagggtggctaaaagaaatagctgcacaatagggttctaaataaatgcagaattgaagaaatgcatcataacaaagataatcagggtgactattttgaaatgctccccatttctgtttttctttctgttttcaaatattccctctcatccacgcggcatattttcattacatttgttgtaagaatgtacatttagataatctactcactattcttttatgcattcttttactccagccaaaaagggaaaaagtccctatccaaacaaagctaatgcatgtaagcaaatttgaaggaaaaaaagaatttcatgaatgagcgggagacaattttttaatggaatgttttaaaggcttgtggtataaacagtaaacaaaattgattcactaacattaatactgtttgccatgatgtgagagttggtctttttttttaatgccccagaagctaaaggaaaataaatactgtggtagggaaaaataataccttacttggcattttgaagtcattgctcaatccttcttgagcaagaaaaccatagtaatgactttgttttacctaccgcaattatggtacacctcgcagcaatccttcacaatattttcctccctctgttcaagtcctgctaaataatctctggaaaccattaactaagagtacggttccaattttcctgttctccctcctctgctgcctcagtgtcatgttggcgtcaggacaaagcaaacttgtatgacatcacagagcaaactcattttctgtaaaccagccccttggtagtttaccgctactggaacccaacgctgtcaacagtgtggtctttgtttggtgggtgttgctctaaaaatttttttaaagtttcccaacaccttcttcttttaaacagaggcaagctgctggaggcgccgtcctcgcctggcccgccccactctgtaaactagacattaccttatacacaaatgactctaggcattcctcagtctagctgcctcactgcaaaattcctatgctcctcagcagcagggcagcgcacattcccctggcttcccctctttcctcttcccccaccctcctctttttcttttctttcttttttttttttttaatttccactgcctcactgtgtttttgtgtaaatgatctcacatgactcaacaaatccatctgcctgaagcaggccaagtctggagccctcccaggagggaggagaagaattgctttgtggaaaggacctggagctctgccctttctctggctcgaattacccgcctgtcaggcctgacggatttggctaaaaataaaaggaaacgggccgtgaaaagcagatgaatgggctcagcagttccttagataacacaggcctgctgttgcccaaagctccccaaacagaaacttcaaatgcagggcctctgagtcagtgatgtggcttccaggtgaacgaggcctgtcaaatccactggagttgggggacatggcctgggctgtgaatttcggtttcctttccgtgtgtgtgtgtgtgtgtgtgtgtgtgtgtgtgtgtgacacagagagtgagagtgcacgcaagagagattgagagagtgagagaaccagtctagtattaaaaggttctcagaaaacagtagacttcagtggagtgaaggcttgtaaaaaaaagaaaaaaaattgttgtttccactacaaaattatccttctccccacctccaacaccagacattttcagcctccctatgatgtcacttctctgtttagagccagcaaagagctaaaagtctttcttgtaagtgtatgcccagcgcctgcagtgggtattaagcacttaggttggcaatgtaatgacacactgtaacaatctgtaatatgaggcagtcagcaaagccctggctctgaaagctatttctcccgaccattaaccatatgtttggctcctcagatagccaagcgggtgttccagcttaccatctggtttctatccacacaagcaactgcaaagcacaggctatgtccctctggagctgtgtgtttctttttctctctcttttccgctcttctcttcccctttcctcctcccagctcctttggttccttctgctaaagaattctctgccattcatcacgtacaaagaaaactttacctgacatggcagcggcagagccattaagaatgcacagctgtattgtaaacacgccagagggccatttaccatccgcggaatctgtacaagtcgggctctaccccttcctcatctactgagtgctgacacttgatccagcatgttaaaaacaggtacattcttgagagatccaggggttgctgtggtgcccttcatactcacttcatattctgggagtggggctttaaaacacatacacacacacacacacacacacacacacacgctcccgaagtttgcctctgcattcaatctgcctgacgtcagtctcacacaggatgacataccaccactgcaaataaccaacttaactacaggttttgattcttttttctgcactaagggtttgatcccaagtgtgtatttttctgagtttttttttttccgcctaaacagcccacattgaaagagatgacacttcagaagaataagaacatgcagccgcttgtaacaaattgacaacctgcaaaacttatgcttatttacatctgcactttttaatagtacacagcaatgaaatggaacctactatcagaatttatagaattttttcacaatgtttccaaagtatttaccccagagtttctccgctacaggatttaaggtcctttataactctatacatttttaaatgtatgaaggaagatgtatttgatatatagaaattaggtcacttttcttcctgtccccctaagaataaggtctgcattagcagcccattttaccgaattaggaaattaaagttaattctttcccacacactgaaaaaaataagggctggtttctaacatatcaagaacaaaagaaagaatatcattaaaaagtgactaaccagaatgtcagattttatcaatgtggcagagctacagaggatttgtcaggggaggactgtttattcaggctaacaagggtgccaggaaggccactacctatgtaaacttcttaaacccacagcccttgtcagtcctcatttccatgatctgaaataggtgttgtgttagctatttctatcaataagggacattaaaattctgctgcatgtaggtttttagagagtgacagaaaaggaaatttttaatttcagaagccttaggaaaattgtccacagatgatggcgtctattaaatgctgtttgaggtctcaaaaccataatacaaactttaaattgcattagcttgactgccaagaaaaacaataacagcatagttaataaaaagaaagaaaaattagcaatttaaaacttcagtattttcatagttaactacctggttttctaagcactgcagaatcattttattacaggtatttgtgcttttcataaatactggtgcctgggcccctttcctccagctcaattatacaaggatccctgagtggggaggtatttttgaaaagcttcccaattttgtgcaactaaagttgagaagtgttgccttatgtgaactaacatgatagtagaaaccatctcatcaaaataaaaatgaaacctttggtatagaaatgtaaatgaaatttaggaatagaacagtagctttccaaacttgttctgaagtgaaatcttcaatcaaacaaaatcttatatgaaatccctataagcaagataggtaaaaagcagtaatttatactgtccttttatacttttagtctgtacaatattcatggattttttaagttcaaagttataattttttaatcataagccacccagtgagaaaaaggaggccattttattgaacacaaaacctgaaattgaggttaaggctgaaaggtccagtcctatacacctcagcatctaattttttccatggccaatggttaagatgatcaaggtctgatgtatataaaaatagcagtgtgtatagcaggatgaaaattagttcataagttaatgtaataaacatccattaagtgcttactacacacgaggtactgccctgtggtcatcagagaaataagttgcagcctttcccttgaggagtctacttaagacgacacctaatggcagaacagcaagacaaatgcaataatggaggtgctgagagacactatatgggaaggagtggctaattctgcttgaggaaatagggcgtgacatcaccagcaagggacaattaagtcaggtcctaaaagtgtgagcaggatttttgacacctaaaaaaggagggacatttcagaaagaagaaactgaatgtgaaaaaaattaaaacccgtaagtataaacagggttggtgagtctgggggttatgagaaattctgcaagggacaggaagggctgggagatgaggccaaagaggtaactgagtccaggttataagaaactctaaatgtcatgatatagcttagaccagtgctggccaacagaaacacaaggtgaactaaacctgtaatttaaaactttttaataaccacattaaacaaataaaaagagagaaatttacttaatattatagaaaaaagtattattttaacatgctatcaatataaaaagtattaatgtgctattttacaaattttgttcatactgagtctttgaaacagggtgtggattctacacttacggcacatctcaatttggacaagccacattttaagagctcaacagccacctgtggctagtgactattatatttggaaagcacaggtttagcccttattttgcaggcagtgcagaccaaaggatatgcttggttttatttcatgagacaatggcaacaatgtgaagaagcagaaacattgggtctgggagaaggcttctgaggtggcttccacagtccatgcaagggacacagagaagaacaaggctcagagcaagtaggatggcatggaagagtcagagtcagaagatacttgtaaaaggaattcagaaaactttagaagactgtatgtgagggatcaagtgaaggactcacagaaccattacatttttttcatgctgaaatttgtgcttagaatgaaagctcactgattgtgtatttaatatgaagtttcattgttccttttgagcttgcttccttctgcagtagaatgcagtgtcacttatgtaggatatagtaaattcctcttcaaagaaccaatatggtacgttcagcatgttcagctctcctgttctttgttctccattttaaagtttaaaacttcctcgttctttatgtctccttgcccctagtttcagtaaacaaccccctcttagcctctatcatctgctcttagtcatccttagtcacctgctctgtccttagtcaactgctctgtccttagtcatccttagtcacctgcactgtccttagtcatcctctgtcacctgctctcaaacagtccttcctgccgaaactactcaacccgccactctggcgcgcacccctgctctctttaaaacagccaatcggaattagcttagactgtgtggtccaaccctagccaataggggaaagacacagcagtagggactagctgcgttaaggataagacccacttccccttccttgtccagtgtgctctcgccattgctccatccatgagacgcacccttctatagaagcaaattgccttgctgagaaaacttttgcctgggtgctattttcacttggtggcaccgagcatttacttccaacacttaataaacatgtgctgagtacccaccacatgttaggcaacgctgggcactggggaagcaaagctacgacataattcttactttcaaagagctcaaatacagtgtaggagacaaaacaaattacaacagagcattaagtaaattaataaacagatatgcaaagaggcctacaaaatgttccataatgtataacttagaactgtttcatataatgtattcaatggcacttgtgagatggagtggggctttcagatagtaaggcttctatcagctgacttttttgagacagggcctcactgcagttgcccaggctggagtgcagtggcgtgatctcagctcactgcagcctcgacctcctgggctcaggtgattctctcacctcagcctcccaagtagctgggactacaggtgcacaccactacacccagctaattttttttttgtttttttaagtagagatagggttttgccatgttgcccaggatggtcttgaaaacatggactcaagcaatccacctgccctgagctcccaaaatgctgggattacaggtatgagccaccaggctcagcctcaattgatttttaaaagtgatccagaatatgatttacttctgtgtctgtatttggttgcactcactgtattaagagaatcctgatactcctaaatacagataacactatctgaatctctgctctcaaaactcaaattttcagacaaatctctcgctatttgctactcttactacttactatctgaaactgagaaacgaagctgacatgaacataacaagttcaaattcctttgcactggaatttacaatgggaaattttggcacctgaattctggaaatgagcagatttgaattgtaaggcacagttgtattggaaattataacagttctttagcatttcatttgataatctcataatatgcctcaaaactaatctaaaagcttggagaaaatgcagcagtcaagattttatttcaaattttaatcactaatgataatttgacaactatttaaggtaaaagagtatccaaaatgtagagtgggtagacatgatcctctaacagaatgtacatcactaagtgatgtgtgtggtgttcacttattgtacaactagccattaatccacacagaagcctccatcccacagaggctctgaaacgctgcctggcatgtcatcaagtgtgctgaatatgtgtgacaagaggaatttgcctgttcaatttatgatcaggctggaatatgaaaaatactgggatggaagttcctaatcaatgattcatttatttataagaagttcaaatatgtaagccaaaatagtggaaaacactatttcaaggttgacttggcagtccaattcaatgtgctggtggtcctaatgtgttaaaatttggtaggtagcacatttgtgtgcattttcttttattatagttataaaacatagtttaaaatatattaaaatgaaatgcaaattagatgtttgcagagcctctgaagtatctccagggaacttctgcagaccagagtttgaagatcactggcttagggactttgaggttaaaatgtaaatggaagaacaacaatttggtgcacctgctattttaaggctcatcaagtcattcccaaacttcagcccagggcagaaaccattcctcattatcctaagagcagtgaagctgagaaacaaaactgcagaaagtgttttcagattctctggtgagttagaatttaaaaggctgggaccaaaatttgaaatacattattcatatctcaatgttgttcatccattaattcattcaacaatttactgagcacctgccacgaggcactgttctagaggcttgaaatacatcataacaacaacaacaacaacaacaacaacaacaaacaaggttgggcatgctggctcacacctgtaatcccagcactttctgaggccgaggcgggtgggtcacttgagcccaggagttcaagaccagcttgggcaacatggcaaaactctctactaaaatacaaaaaattagctgggcatggtggtgcatgcctgtagtcccagctactcgggaggctgatgggggagaatcacccaagcccaggcccgggagttcgaggctgcagtgagctgtgatcatgccactgcactccagtctggataattggagtgataccctgttttttaaaaaaatacagacaaaattccctatctttgtgaaatttagagttagtggggagagacagacgataatcacaaataagaaacttgttgtaaggtaacaggtgacaggtgcactgaaaaaaattgggagtcaggcaaacaccacatgttcacacttatacgtgggagctgaacaatgagaacgcatggacacagggaagggaacaacgcatactggagcctgttagaggggggtggggagggagagcatcaggataaatagctaatgcatttgggacttaatacctaggtgataggttgataggtgcagcaaaccaccatgccacacatttacctatgtaacaaacctgcacatcctgcacgtgtatcctggaacttaaataaataaaaattggagtcaggaattagaactgtggtggaggagaaaggctgcaattttacataggatagtcagggtgtgccttactgagagaaagaaaaagaggatcagagatctggaggggagaggtaaaccaagaggccatcagttcaagcagtggttctccaagcggggtcctaaggccaccagcattaccctgaaacttgtcactagctcagaaatgctagagaggcacccagtggtctgtttttgcagactctccaggtgattctgatgtgctgtaaagtttgagaaccactgccctacagaaaaggccctaaaataggagtgggtctaggatgttctacagaaaaaggggtgaaaccaggcatctggaggtgagagccaggaggacggacggtggtggccacagcatgaatagctttatgatcacagcaaggctttggctcagaaaaatgtggagctatgaaggacttttcttcaggagccacacagcctacatttcaaaatgttcatgttggctgtttggttgagtggaagcactgcatgacttgcctcaagaggagactccctgactgctcaactccattttgggcagtggtatgctgctaaatgtttaaaaacagactctgagggtgaggagcaccaatttgtagtgtttgatttccatggtgtaaactctcccaccatggctgatttcaagctgccagtatgactcactgaacatggagttgtgaagagatgtgcataaacgactcacaatactgactctagtcccaacgtcactgttaccactgagaacatttaaaaataagggagaattctgtaaatctgattggaaatgtgaatgctattttataagtctatataaatgcaatgtcttctattggtctattactgtcaatcaaacacagagcccaagtccttagaattttttttttttaagaggcagggtctcactctgtcatccaggctggagggcaatggtgcaatcacagctcattgcagcctcaaactcctgaaaagttaatacaacaataatatattaacttcatttagagaaaacaccattagtattaaatttcagcttcctttattcaaaaacatttgttattgaatttctcttctcttactacaattaacatcttgcactctcaaaaagtatgcattgactaggatttgccatgcatagtatgtgagattgctgctccaaaggctcacataaatccaagacaggccatcaaggaatgtgcgtgaactgcaagaataaaagtttgaatctatctgaagatgaaatgaagtttgaataaggccttcatccatttgatttgccattaagaaacttttcttagcctaatggaatatccctacttctgtcaatgagatttcagtttgtgaataacattttcaaagtgcagcatcttctgtctacaaaaagacattctatgaactcttaatacacataaagtgtttgcaactaccaggagtctgctccacgcattctcccgtctgcatgatccctcgggcggtataccacccacactcagaccccgggcagccagatcagcaaatgtgcacaagcctgcactcctgtcaaacaatggggtctttcaggccttacaatcttgtgaagaaacaggctaaaacgtcatgggaaaaattaggaaatatcagaggaaaacagctcacaaaatgaggggtggaaccacttgctcacatgttctaatttctgaacaaagagaaacaacagtgacagccccctgcctgctctgacccctccatttcaaaagagaggcatcctaacccctttttcttttcttggagattacagcagcaagatgtagacagacagaattagaaattcttaaacctaaagaagcagagttaatttcaaaagctttatcctcaagagaagcataactaacccatcttaccagccttgtttggtgatctgaaatatcaacaaaattacagactagaaatcaactagacttcaacaaccacataaaggaaaacagaaactcctgatatatccctttaaaaaaaaaaaagctcttccaaagtattcttggtattaaatctcatgcaatagctagctctatccacctcagcaatccttcctcattaactgctacacccagtttatacttttcataccagcctagctagctggcctagtggcctgcaacactccatttgccatccccagcctttatcaagaattgttccacttgtaaattacctgtctctttttatccacaaaataacatctctgtttaaaaatctatttaagacttactgcaaaaatgatttctagattaatccagtacatttgcaaacttgccaacaaatttacacttctgctttaatatacttttataatccatctatattttccagttgattacattaatctgactttactaaaatctctgaggataaagtctgagtcaattcttctttacataatctccaactttccaccatatcactatctatctgtaagacgctatcagccgttaaacactacaggcacatcagctgctgtctcccaatagtgaggctgatggtcagccattttgggaaaagaaccataggtggattattactataatgcattatgtggaagaggtgtttattttgctcctggaagaaaaaaagcaacatgtattaaaatcataaaaatgtttttaggttgggcgtggtggctcacgcctgtaatcccagcactttttgggaggtcaaggcaggcggattgcttgagaccaggagttcaagaccagcctgggcagcacagtgaaaagaaactttgtctctactaaaattacaaaaattagccaggcttggtggcacaccaagctattctggaggctgaggcaggagaattgcttgaacccaggaggtggagggggcagtgagccgagatggcaccactgcactccagcctgggtgacagcaagacactgtctcaagaaaaaacagttttaaaaggtaaaacaacataaaaagaaatattctatagtggaaataagagagtcaaatgaggctgagaactttacaaagggatcttacagacatgtcgccaatatcactgcatgagcctaagtataagaacaacctttggggagaaaccatcatttgacagtgaggtacaattccaagtcaggtagtgaaatgggtggaattaaactcaaattaatcctgccagctgaaacgcaagagacactgtcagagagttaaaaagtgagttctatccatgaggtgattccacagtcttctcaagtcaacacatctgtgaactcacagaccaagttcttaaaccactgttcaaactctgctacacatcagaatcacctggagagctttacaaactcccattgccgaggtcacatcccatactaataaaatcagaggctgggcggtggctcacgcctgtaatcctagcactttgggaggccgaggcaggcggatgacctgaggtcgggagttcaagaccagcctggccaacatggtgaaaccccgtctatactaaaaatacaaaaaattagccgggtgcagtggccagcgcctgtaatcccagctactctggaggctgaggccagagaattgcttgaacttgggaggcggaggttgcggcgagcagagatcatgccactgcactccaacctgggctacacagcgagactttgtctcaaaaaaaaaaagaaaaaaaaaatgtctggggtggaagccaggccatctgtagctcttaaagatccccaggagattctaatgtgcatcagagttttagaaccactgtcctagactctgtcagtacaagattttgctcaatgaggaaaaagcacgataacttacatttaagttggtgacaggtaaaagcaaaggttacctctgaaacttttaagtaggaaatcactgctttggctgcaacaagaagtttgtgctctgattctcataattggtgtagcatacagtctttaaacagccctaaatgaacttgcggctttgcgatttagactaggagagagaaactaggcatggtggtagatatgagcccagataacaactgaattgttgcccattgtgccgtcgagatatttggcttgagagcctacagcctggatgcaagtcctaggtcagtcatctgctggctgtagagctacaggcaactctccaacaacataaccctggtattccatctgaggcagtggttcccagccctggctgcatattagcaaacctgggtctgggacgcaatccccgacattctgactgatccagaatggggccccaagatccttatatttctaaagttccccaggtgtggttatgtcatatgagtgaggagaaccacaggcagagaggttttgagaaaggatgctgaggccatactacgtgggttcaaatccctgctccactagttactagctatggctcagtttccttatttgtaaaaacggagataactgataacacctcctttgttgtgaggcttgactgactgaatccatttattgatctcagtggattattgtacggatttggcataacacctggtacatagcaaatgttcaattttaatcacatgcatcatacctatacatgtgtacatgtgaatatgtcctaaggattaaacagtttgatgcatataaagggcttagcactgtctccatatagaaaatactcagtaaatataagctgagctgatgctgacagtactggtcgtaggacaacttattgcaactgactgtcttctgtctggaatttcatcctttcctcactgcatggcagcctttgcttcagaaaaccacaactttaaaaggtatggggataagaataaatcattttttctctttcttttaattattaagaggtcccactaacaatgaacggtacttctactgcaaagttatgatgggaatgtgggcttaatggcaaagaaaagcgatgtggagacctggctctgcccccacatgatgataaatagcagaacttgacagccagaggaaactcagccccctcatttcctaggggaacccagagttgaaatgtgttttgctcaagatcacagtgtgagtggcagaactgggatcagacttaggaacagagctctttagtttccaggttgcttccattgatcatccctggtgagaagcatgcctgagaggtgcattatcatgtggaagatgctgtccttgtggtcaaggccaatgtgggggatgaggaatgtggtaccctgtttcccaattgcttccttcctctctctgccgaattcccttccctggtccaaattccacaccctgcaggccatttccagctgaaagggaggacacagagcactagaaagcagctgtggtttgtttgtggccaaactgttttcttaggggtgttcagttccaattttataacagaagacaattatgaaaagggtttaatttcccaaattttcattacatacaactgtttagagataggcatatataaatggatatgtgcatactttttatctatcaaggacaggaaatcctgtctttcagttgctaagtctcagactattccatctgagtatttttgctgacaaatgtgaccttgtctaggttctgcgggaatttaaaaattccctcaatgtcatttctacttgaccttagcaacatgaccaaactgcaaattcaaatgccattgagtaaaggtacaacattcacatcctgttaccaaagcgttctccaactccaatccagtgaccctgggccagagcctaatccaaaagattacaaagcaactttctgatgagttgtcatggcaacccctagatgttagatatttcatgtcatccctgggctgcaaattctcatttttagtctactcatatcctactatttcatgtataacaaccaaccaaaatgcaatttgaaatgtcagctgccaaacataataagagatgccacttgctattatagccaataataaaagatttctagttgcttgtttcagagatacagcaaatcactgtgtattctaagtccactgggctggtcctcaaagtgaggctatttagctagacttccttagtttttatttaattagtcaatatttaagagagccttggagataaaaagaattctagtgaaacctaggcattattattttccaaacaggaggaaatgtactgatcttcagactttcaatagacatgatatatttggtctgagagagagagacagagagagagagagagagagagagagagaagcccaaccgttatctaaaccttttaaggacacaattatacaagagtgccttgcaaggttttcaactctttataactggaagagaggaaaacacttattactgaaatccagataatcaaaacactttgttttaatcagcagtttctacccttttcacattctatatcaattcacaaggagtgaccttcatcttaggtataatggggtcaaaacctacctctgcaggtgtttctcccttacctgccttaatctgtggcccaggttaagcacacctgcaggcaggctcaacccaagatagccaggagttctattatgagtagactgatgtagaaagatctctcttgaaattccctttagctgacaaagcattgaaatcacctctgcaaatagctggaattgtgtatttatttttcttttctctgtttaaaatttagcagaaatgttaataagaaaagaaatgtccagtagatgaacaacaggcccagaaggaaagagaaatgaagaccaagataatacacaaaccagattatcaatcttgaaataatccagaagtagacatatgatagatcatactatgtgagtttttctaatcctaaacacaaagggaatataaagaggtgtgcagtagggctgcatgtcaaccactttaaactaatgctagccaatacctgtgtagagctgcaaactatttttctgctagaattttaagagaacttttaagttttgaaaattgattcccatgacacttctctttccgtcttcataatagctgccaaaaagttcaaaaccacatttatggcctgtctctaagaagtccttaaatggtctttcttgacatcttttattaattcctagcctcattttctcacttttttgttgtctgctttagtggggagtatctctgaggccaaattaaaactttttacaataatacaggtgtattattcaacagatagccttcattaagcctcaaatatttatgggggcttctcttccagaccatccctctttgatccatgaggcaggagatatcatgtttcaacaagaatttgtttcagttcacagagaagctgaagcaacatcaatttctcatacttgtttcaatcacatttggaattgataagctaaaatagagaagagtgctatgctaggaagctgggatcatgaggaggtgagaagccaccttttttttatttgggagcttgcactcatgactttggccagaccccagaagacacataagttccctgtggtaaagtatttattggactatcacccaatcctttcttctacatgagaatatcactttggcagatgtacaccaaagccttctctgggtataagtcttcagcctgccttggatggatcttgtctgcttccgtctgcctgtgcacacaggctgccagccccactccaccctccagtaaaacctacttgactatgtatagtgctggcttagaatgacacagatttaggttcaagttttgcatcctttaatggctatatgaccctggacaaggtatcaaactctatgagtctcaggtacctcgcctgacaattgggaataataaagagtcccttttggggtttatgtgaggattacattaatgctcatagggtcctcgacaaaatgcctggcacaccaaagtcaatgctcaataaatatcagcgattggtattacaattatgttattataattctttgaggaactgctggtggccagtgtaaatcctatggtctttatctctcctgaccccatccacaggctcatgtgacaattttcccaggatcatttcaattttctgcgatcagagagaatgccagccacggccctatggaccagggacaagatagcacacctgagcagaaagaaagaggaccactagccttgggatagaattatccctcacttcaccctcactgtcggcatgttcagagactaagtgcttatagaaccagactcagggttttcctgttagtctgaagagtgcttcatctcttctaggctttcactggcagagccacaggatgagaacactctcggccccttatcaccacccacatcagcaacactgaggccagcatcagggtcttctgggctgtgcggattggggagccgatgatgtagttaagtttcctggaaatacaggcagcaatttcctgtggcttcctctgtttttgatgtagagatgagcacaggtaaaaactaaacacatcaaggatcagcgcttcagtcggtggtgcaagtgcggaaaaatactgtcatttcctcacaaacagattcagaagtgcaaagtataagccactttccagagagcatgctccccagcaaggacctgtacagtagggctgtgagttgacagtgaatagatgggcattcccatgaacttacttgcttacccaagtgatcaagaaccagaatttccatgaaggtcaatgttttgtataaaccttagcctgaaaaagctctggtctgctcacagagcttcagtcaagccttctccagaatttgcagccaggtcagaaaaaaaggtcactttcagaagtggaaagcagtacaaattttagttaaaattttagatgaactaaactgtttatacaactatcctaaaagatagtttagaattaaataaaacaatgtgcactacatttgggaaacagccaggttcaaagaaggtggtcacagtgtattcttagaaccagaatggaataaagaaaatgatacatgttatggttatgatagcataacctgctgatgaaagaacagcagcagcaggatgtacagtttgcaaagggtccactcaaatcagagtgaacccagatggtgctagaggcagcctagggccaaatcccacctttggcactcactagctgggtgaccttgggcaagtcatttaaacttccatttcttcatgtgattttgtttctccatcattggctccccttcctttgtgaaaagttgcccctccccataccaactggggcacccatcatcatagtcagcaacctgacctaaagatagctcaggtataagacatggtaaaatcttttttgctttagtccgttgcttgtaaccaaaaaaccaagaccttttttcggctgcaagcaaaagagatttaacacctaatttgcagaagttgctaggagcattaaacgaagtcacacaaagcaaacacaagaaatgctggttgcattcatagaaaggaagattagtgtgtggttaaaagcaaaggtattgagtccatctgcatgggttcaaattccagcaccccttagaacagagataaatcacttaacatctttgctctcggtttcccagtctgtaaaaacagagctaataatagtaattacatcacagggttgtgaagattatgtcaaagtagataaagcatttagaacagtgcccaacacagtaaacattcaagaattagccattattattacaaaggtagaactgttttgattactgttaaggatgttgtaaaagtcagtgatctatagagaaatgcccttcaactaaaaaagccagggattgtggcacaagcctgtagttcccagctacctgggaggtggaggcaaagaggatcctttcagccaaggagtttgagcctgggcgatatagtgagaccctgtctctaaaaaatttttttaaatttaaaaacatttttaaataggaaaagaaaataatccttcttctgggtaatccagcttgatggacaatcccttagagacaattagaaaggatgcatttactcagaatttagtaagttctaatattgggcctcctgaatgaacttactgaccagcaggatgtggcctgagcaaatgacccatgtcagttgtgctgcctggccttcctcttttcattgtcaagaatacatgagcatatcaattatgaattaatctctcataaatttaactataagtcaattcttgcaagtcacatctctcaaaaagaactaataaaactgattttggtcctgtggctattcaccagggctatgcccttatgggggccacccagcaaccaaccagcctcactcttgctgaaatctgttaattgcagctcaagcctgttttactaactaaatgcagtgtctccttcaccactgcttcctgtgtgatatcactaactcattccttcattcatttattcaatcatataagaaacatttattgagcaccacctaggtgccaggtgctgggctcagtatttgttaagcaaaagcaagcaataaacagtgctcaaaatgctttttagagtttagtgaggaaggcacgtcaactaacgattagaaacagtatgctaggccagagacaaacctgagccatgagggacctcaggcctgcatggtgggacccagaaagagttcacacaattagcacaaagcacttgggaagcgaacagtttacccagggcacagaaagagtagactggaaagatacataggtctgagacattctgggatttagacaccttgcaaaggaagagaagtcttcggaagattttaagcaaagtcatgccatgatgtttagttttgcctttagaaagaacatttggttggcagtatggaagatgaaccaaggggctggccatatgtgcaaagcaggaggcaggtaaagagtttcctgtgtttgtccagaagagaaatggtaaagcctgaacacagggcaatagatgagggagcaaaaaagagagtctctgggatttcaggatatgaaaccacctgattccatgaagctatcttactttagctcactgtatagaaaactgtgcctgtcactgttcagctacttcttgaaagaactgagactacaaattaaaattgaaaactacatgcacttatactatgtccatgattccactgtgaaattgtacaaacccattctccaggactcaggaaggccaatgttcttattttttttttgagagagtctctctctgtcgcccaggctggagtgcagtggcgcaatctcagctcactgcaacctccacctcccaggttcaagcgattctcctgcctcagcctcccaagtagctgggactacaggcgcctgccaccacgcccggctaatttttcgtatttttagtagagatggggtttcactgtgttagccaggatggtctcgatctcctgacctcacgatccatccacctcggcctcccaaagtgctgggattacaggcgtgagccactgcgcccagcccagtgctcttgttttagaaatctgggagagcttgaaagtacagaggaagggcccttaagttaaatagtcatccctcctcaacaaacaattaaatgttattatgaccaaccatatctaacaggttcagagacatcctagcctgtctgtcaactttgtaggctaaatgaaagttccaggttgtcagacccagtgtagttttatttcctcagtatctatttcctgccactttactttacaaaatgtttccctttgaatgtaaccagagaattccatgaaccctgccataatgttaatactcacggtgaatgcacacttatatcactagaatatctgaccacatctgtttgttttgtgacatgacaggccttgagactggtgaaaaatttaccaaaccaatagtttactttctcttaaatgtaaaatgcaatggaatctcttctgtacctctggaaacactgtagtcagcttttctgaatgaacctgctgggaaatgtcaagatctctaaataaataagttgtgactttcattgtatttgcagcacacaacctctgacaaggaagaaaggccacaaggggatgttgatcaaatccaggtcagaactccatcaaggtggacagacactcaacgccctggtagataacaaagacaacggtggacgagcaataaagaaatctaacaaggtctcaaaggaacagcaaatgaatttcaattttaaaaggacatgggtcattctagaaatcaatgtgtgtgcaatccaacagttccatatataaataccagaaaatatttatgaagcaagattaatctcgttttagaaattattactaacctggctttattactggtttaaactaaatttataaaacaataggcttgtcccttagccaaatacattcatgtctaagaatgaagtcatactctatacgaagctaaagagaattttataatagtctcataaccccattagggggaaaaatgtatctgttctctcttatcgatcgatcgatcatctatctatgttgggaaagcaaatttaatgaactccctgaaactcttagagaaaaattatgggaagacacacactggctagacatatttcgatagtggttaccatagaaacaagtcattagatttcatttttggagttgtggcttttgataaaatattaaatttcttagagtatttgcatatacagatagcgcaactgctgatgtgcaattgaattatatgctgtaaaaaatatttacactacttctacttttagattactaatatctacaaagaaaaaaactcactcctaataagaatgaatttaaaaactcttcctctaccttgccattgtttcctactgggaaaaagctaaagtgagggtggtgaaggcataaaacaggctgggacacaagacagggatctaaggaaaccagcttggtcttgcttgagagaaactcctgatggctttccaaccacagctgctaatattctgcaggccacctaactgaacagcaactctggtaatttgtttttaatcagactaattcttcaatctcattttcctgtgacaagatggctgtttctcacggtgtaagaaatgatgatgtgcttccttcttgggggagtgagttgtgatactgccttgtgtggagctcatctagtgtctcctttcatttatatttcataacctccctgctgtgagcccaagaacctgaagagcacacctcacttcctattttgaaaattaagaaaaagtatacattttaacacagagtcaaaattgcaaagttaaacgaccactaactcaaatactgattttaaggcaggagcagcagcaggttagctgctgcactgaattttactgactgaaagccactagggtgtttgccaatcaatgctaaaatgatacttgaattaaaatcaatacacaaccccatatgtatgtggtgtgccaggaacagcctaagagttgctcgacctaggatctaagatgtccacgagccacaaacctggtaatctttgaaattagggttggcggatttagttttctgtcagctgggaatgtcctggcattaaaccaaggacctcaatccccttaaaacaatgaattcagcaacaatcttgacttcccagacataagaagtaaatcacattaacagctgagaagaggctatgaactttctgtttgaaggtcaactagaaaacaagcgaaagatcagctgaaaatgtcatgggtgaacctgagccaggtgctggctctaaaattacagcaaggtccccatgaaacattaaaagaacatagccaccctgtaaggtgttataggaggattctcttttcactttaaaaattatttatgtatgcatgtacatgctttaataatctctggcaatatgcacatatttatgtatatagccatacatgactaagatataaatctcgtctatatgactaagagatggaccttatctttatatgactaagagattatgttatctctgaagggatcaaaggtcacgtttgtttttctgttttccccaagctcagcactgacatgcatgatctccatagtaagggggggggaatacacacacacacacacacacacacacacacacacacacacacacacgctgactattcacatacagaaatatatatttgctattaaaaaaattaaaaccacatacaagaattagccaaacagtaggaaaaacgaacacatgaatcaaccccagaaccaccactattttagacttgccaagtaaaataaagatctaaaaattcatcttatagaaaaagaaatctgagaactacttctatattgttacagaaaatacaaaaacagatatattttattatttgaattaagcattaaaaaaattcatcttacaagtaacaggtatatcctaatctttaaaagttctatttgtactagtcatctactaggtcaaaaaaagtttaatacaaaacatttggaagtaaatgaaaaaatactgcatttttccaatactatcttttttaatgaaatatcaaaaagtttaacacatgttaatccttttgaaaacctattttgcctcctaagaaatgcaaaataacttataaagtaattctaacatcagtgaagaatgctactatgtttcaagtaaactgtctcaaaaattttaacttaaatatgaattttaatataatttatgtgaaaatgaaaaatacttgaaaatactttgctttggtctaggattaaattcatgatgtatttcattaaatatcctgctattgtctgctttacgatattaagaaaacaagcataacgaaaaataatggttatctcctcagccccactataatgggaattcttcctcataagaactacaaagcaaataagaggagatgtacttcaaaatcttaaatattcatcacaaaataagaaggcaaatggactttaaaaatgatgacccacgtaaaatcaacatttaatcctcaacatgtagactgtctgctttgtggctttcttagagtgaaccttagctttaccctcctagggaccaaattcctatctcttgcattacaaacatctgcaggccacaagacagcaaccaaaggttaatactgcctccagccaaacattattaagaagctaaatctgctaacttccattaaatataatactaaatataatattatttccaaagccaacagatattacttttgaaccctatcacttgtcaatatgaggctagaaattaagagttgactaaaagtatagaaaaaattagccaggcgtggtggcgtgcgcctgtagtctccagctacttgggaggctgaggcaggagaatcgcttgaacttgggaggcagaggttgcagtgagccgagatcgccccactgcactccagcctgggtgacagagcgagactccaactcaaaaaaaaaaaaaaaagagttgactaaaattatagttatatggtttccagataatatataataatatatatgtataataataatgtgataatgtatcacttaatagattgaaaatgatgagatgatacttctcaatggcagacactagcctgtagggtggtggtattcaccacagctaaaatcaaccgctcacttaaatagcacctggactgggaccaaatcctccaaatggctccccctcccacctactcaacagggggcaggctgggacagagagtcacgtgtgttcacattagcctgatagaggatcagaatggagtcagactgcaagggtaggaatttcctctcttccagtgctctcatttcctcatctacaaaatgggaactgctgtaaggattaaaaaatacatagaaataaaacatttagcacaatggccacaagcccacattttcaccctgtctgttgtcaaaagcaaggtaggagacaactaatgctagggtaggtggaaaagagggacagggtgtggctagggagagggacacctgccagtcacatggtgggcatctctgctcacaatctgaaatgtatgccacaggaagttgccaaactgcttatttttttaactgcccgttactaaaggttgatgagataacacataagataaatgaaaaaaaaattaaaaaacaactagagaaataaggtggggaatattatatgaaagacattatacaaggcttttgttttgttttgtcttggagtattgtttttttatttctaagctacaatctatcctgattttctttttttttttttattagtagactattttttagagcagttttaggtttatagaaaaactaagccaaaagttccctcttccccgtttcccctgttattaaccatcttgcacaagtatggtacatctgttataattaatgagccaatgatgatataggattaactagtcataacagtcaatatagtttacataagagttcactctttatgttacacagttgtatgggttttgacacacctatctatccaccattacaatatcatacagaatagtgtcacagcccttaaaatccactgtgctccacctgttcatcctgtcccctcttccctgaactagcaaccactgatctttttactgtctctatggttttgacttttgccttttctatagtttaaatcgtacagtatgtagcctttccagactggcttctttcacttagcaatatgcatttaaggttcctttgtgtctttctgtggcttcattgctcatttctttttagtgctgaataatattccattatctggatgtaccacagtttatcaattcatctaatgaaggatcccttagttgcttccagtttttgacagttataaataaagctgctatcaagattcgcatgcaggttgttctgcagacataaattttcaactcatttgggtaaacatctagatgcgtagttgctgaattgtacgttaagcctatcttgagctttataagaagctgccaaactttcaaagcagttgtaccaatctatcattttcaatatctaaaaatccatctaccaaagtgtaacttaatatctacacaatgtgaccagtgcattatttatgatctacctaagtgaaggacagttaactttcaggttctaactaaacttgaaagataatgtgatcaaaaaattcaggagttgttgactttgggctgttgactttgggcaaattatctgatttctttttttttttgaggcggagtttagctcttgttgcccagactggagtgcaatggcgtgatcttggctcactgcaacctccgcctcccgagttcaagcgattctcctgtctcagcctcccgagtcgcttggattacagggatacaccaccatgcccggctaatttttttttttttttttttttttttttagtagagacaaggtttctccatgttggtcaggctggtcttgaactcccaacttcaggtgctccgcccgcctcagcctcccaaaatgctgggattacaggcgtgagccaatgtgcccggcccaaattatctgatttccacagcctcaaaaaaatgtattaataactagtcgcaaggatcgtctttaaaaatcctttacagtcattaaaggttatgcaattcttaagaaggtgactatgatctttgtgatgccaataactccattttacttttaagcaaatttgttttagtatcattttcaatgaaacctcaacaaactgtagttcagactttggagaaaatgcttaataatcatgacagtgaagaccacttgggactgttaggctggtttttgttgctgttgctgtttttgttattgttttgcctttagatcacaaaagttttgtcctggtggcagaaggaaacatcagttttccattggaacattctctgactagcattatggtctttacataacgttcattccttatttccacaccctccctaatattacagagtaattactgaatctctttttcctatgaattttaaagtttgacaccactggccaaaaattctatgaatttggcaaaaatgatgatggatccaaaaaagctagcatccttttctcagcatttaaatagtttttttcctcatgaacaggtctactacctgaacagttccccatctcaccccaccatccctgtgggaagaaaaccattagaaggcatctacctttatgtagtaaaatttcattgattggaatagctcaattgaggagcaataaacctcagtcataggacattcattttttattttttatttttgggagacagagtctcgctctgttgcccaggctggagtgcagtggcatgatctcagctcactgcaacctccatctcctgggttcaaatgattctcatgcctcagcctcctgagtagctgggataacaggcatgtgccaccacacccggctaatttttgcaattttagtagggacagggtttcaccatgttggccaggctgatcttgaactcctgacctcaagcaatccgcctgcctgggcctcccaaagtgctgggattacaggcatgagccactgcacccggttatttataggacatttaaaaagaaatactgtcttcccaatttcatgtaatacagtaatagctaacatttactaaatacttactatgtaccagatggtattcaagggcttcgcatacatgttttcaattagccatcaaaataaccccttgaggtaattactattactgcttccattttacagattcaaacactgaagctcagtgaagtcaagcagaaactctgctgtgatctctccagaatctggtctagaatccttggataatggctgggcccaacattctcatggacagacactgctgcctacttggatggattagtatcagctgcttctggggtctccatttgggtatattgctcacctgacagcaaccaccccctccccccttcacacgcgcacacatgcgcacacacgcacacaaatactcgtgtacatgtgctctgtgctgtgcctcacacttgctgcctgtgctatggggaccactggctggtatcatatctgacacatcccatgtttacctactgcacttgactcctccctaaaagctgcttctattgccccctctgagccatcatcaccctcatgggcctttctagctccaagtgatcttccttaagctgctgaaattaaccaaacaagaaccgtgaaggattaacaatacctaatataaattatgctttaaaaataggctttagccaggtgtggtggctcacgcctgtaatcccagcactttgggaggccaaggtgggcagatcacctgaggtcaggagttcgagaccagcttggccaacatggtgaaaccctgtctctactaaaaacacacaaaaaattagccgggtgtggtggcaggtgcctgtaatcccagctacttgggaggctgaagtgggagaatatcgcttgaacctgggaggcagaggttacagtcagctgagatcatgccactgcaatcctgcctgggtgacagagtgagattctgtcttaaaaaaaaaaaaaggctttagtactttttaagtaaactgatgaaaattatttaagcattgcaaactcttccttaaaatacaattcatttttaaaagtaagtggacatttcaaccaggctcagtggctcacacttgtaatcacagtacttttggaggccaaggcaggaggatcacttgaggccaggagttcaagaccagtcagggcaacatagagagactctgtttctaacaagaaaatttaaaaaaattatccaggtgttgtggtgcgtgcctgtagtcccagctactccagaggctgaggtagccagtgaactgtgacggtggcactgcactccggcctggttgacagaacgagatcccatctctgaagaattttttaaatttaaaaacaaaagagtaagcagacatttctaaactggctaaaagcaatttcttaagtaggtaaacatagcctttatatgttcatttacatcattcagtagtttagttagctctgttcctgctaagatgaacttcaagaactagctatgaggtgatcagaaataatctgaatttgaaacaagagaagtctgaatttgaaacaagagaagtctgaatttaaagatttttcatatttggattaaaatatttgtaacagggtggaaacagaaaaaattggacaaaaatctatgaaaacttgctctccaggaattttctccaaaggtctcctggcccagaccctcattccatgacaggaggctggcagtgccagaggaatgcagcacaaaggggtggaaaggatgtcagcaagagaagctatcaagggaggaggagtgggacgtggcagaagttaagttggactgataacgtggcaagctgggtctgagtgactactgctggaacacaatgaacagtgggtccttcactcaacccagattggtgagagccaggagccactaagtcaaaattaacctaaatgcacataaactctaggattccaattttattctgtttttctgtgcctctactacactcccttgacctttaaataatcttcacaaaacagttataaagcagagttgattactgtacttttataagtataatgtgtaaaatggagacatcaacttctgaaagttataaaacatcaattttaaatacaatttttccacttttattcttactgttgtctactgaaaacaatattctccaactaatcagaaaacctcaggctcatccttcaatttctgctcaaaactctttaagataggtttcaacagatttccatacaaaagaaaaatgcgttacattcctccctattgatgtctaatgtagtacagtgtattaagatacatacattcacccgaaacaaaataacatgttctcttagtacaaactggcaaaaaaaaatcatttaccttgtttattgtttgtagaattacccccaattcaagaaaaatgagtacatataaaaattaggatttataaaatatgaattagataatataaatgaatttattttaaggtgatttgaagcaaaaggtcaccaagtatattacaatacaatctgatttacaaaatcatatttcaaaacaaattttctaggaacacagatactccataaagcagggtaccttggctaaaacaccaatgtctcacttacatagaatttgataaggaaaatgaaactttacactaaaattgttaggtagagcatgtggaagtattcaaaagaaacctgacgttaaagtcctatgaaaattttcttaaaatatgcatgaaaaacatacttgtaaatttacgatacttgttacgaatcaagtttttgatattacaaatgtgaaaaaaaaaccttcaaatgtcaggttaccgtttttactgtttaatgaaaaagacaaagctaaagaccacatataaattattgacctgcatactaactaccactataacgagaacatgactgcagtttacaaggatgaagctctttatattctcatttggagaggactgttgtagtacatttgacatgtaatatatttaaacaagtatcaatttctttcttcttcttcttttttttttttttgtagagatggtgtcttacccaggctggagtgcagtggtcatcatagctcattgcaatctctaactcctgggctcaagtgatcctcctgtttcaacctccttagtagctgggactacaggcatgcaccaccatgtacagttatttttttttttgagatggggtcttgctatgttgcccaggctggtcttgaactcctggcctcaagcaatcctcccacctcaatctcccaaagtgctggaattgcaggtgtgagccactgtaccaagtcacaagtatcattttcctaagggctaccaaacagcaatattagtaccattactgccttatttaaggtaattaaaatcaactttttctaaacttagaggaattcttcactcccctaaagtatagcctctacctacttttttagtctaatttcttcttattcaccatcatccaccctatgcttcagttaaaaagggttaatagctatccctggaatgtcttcccatctccatgcctttacccaagtggttcccatgcctagaatttcctccctcatagcttcagctgtcaaagttgaacccattcttcaagtagcacttcggtctctgctttatccaggatgctctctgatgtccctaatcagacagcatttcttaatcttcatccctacagcattctgtatctttcttggagattaattttactctcttatatgttatactcatcacattcaagtgtcttctagcttagagtatatcataggtgctcaacaaatgtttgttacatgaatgaatacatatgctccttgagagaaaggcactaattttattcctcattgtgtctctttgctatctccccaaggtgagacctctgcaaagccaggcaacaacccgtccacatgtactcagcacctagaacagcacatcatagtgcactgtcaacaatctacagatgtttgtgaaatcaaccaattaactaatctgctgtcgttttttcagtacttaacactcctgacagaattgcacattcttagaattggatatttatatttttcatttaataaaaaatatttttaaattattattcaataactcttccttgagtgtgtcctgcttgctaggaagtggatattacatacagcagacaaaatagccgtgatccctaatgggctcatagactaatgggagagaaaactattaaagaaacaaatgtatggccaaatatgaaattaaaattctaataagggctgggaaagaaaggagaaagcaaagtatggacaactgggtggtgctcattaagggtggagatcagggaaggcttctcagaggatgtgatgttaaaatgcaagtgaaggatgaacgagagttagaaaaatgaaaagtgggaggtggggtgggcatttcagggagaaaagcagcctcaggaagagcctggtgcacctggtcacagtggtggtatggggtcaatgaagggaaaatggctgcatgaggccagagagcctggctggggccaggtcagcagactcccaccaactccggggaggaggctggattcttagtgcaacaggaagccatggcagggcagatgaagaataaatgaactggctgcttcactactaccctgtcccaagggcccagaccatgaaacggtcttttatttggtttcaaatccaaataaaaacctatgtaggtatagaatcaaaagaaggagttaaaaatttgggaaggttttatacattttcctgttaacagaaaatttaaatataaaaatattttattatctcagagaggcaacagagatttatgctctttgattcagagataaactttgtcttgtagaatgggaaaaaatgactaggtaagatgattttcctttatcacttttcagaagacaagtcataatggaaatgactcaagataccacaatttggaagatgagtgactgtctttgccatgggagcagagtgagggtttgctaaacatcagctgaaaggagagatgtgctcttgctcttagttacagacaggcactgtatgtgatgtggccccataaaaatcctggcagatgatgtagcttcctgtcatcttcctcccataactgcaaagtccaggagacagagtcccctttccttggtagaaggaagtaaactttggcataagacacattttgtgccaactacctaacagcaatgtttaaataaaaataaaatgctattggagcatttcaatacatatcataaaaacaggccaggcgcagtggctcatgcctgtaatgccagcactttgggaggccaaagtgggcaaatcactcgagtccaggagttcgagaccagcctgagcaacatggtgagactcccatctctactacaaacacaaaaattagcagggtgtggtggtgcgtgcctatagtctcaactactcgagaggctgacgtgggggaatcacctgagcccagggagctgctgaggctgccacgaaccatgattgcgctactgcactctagcctggttgacagagtgagaccctgaaaaacaaaatgaaacaaaacctaagattgaacaacaaaaagcaacactaagcattttatccagaagcaagaaaaccctaccaagaatttgtatttgttcatcagaatagataacccaaatgaatactccacagaacaagactgccgtttatttaataggtggtaggtttttaaatgggagataggttatttcttcctttctccccacccacagagttttggccacttccagaccatgttcagctgacattcttttcaaagactcaaaaaaaggtaatgcactctcagtggaaaggtagtgttccaccagttttggtaaatactgatctaggcctgaacttttgatttctgaatgaaagaacaagatgattcatatatgccttaaggaaaaagtaagtctggtgaccagatctgaatgaaagcaaaaaggcttgaatttaaaaagcgaatcctgtttaaattttgggcaaatcatctaacatatcctctttccttttgcaatctacactaagaatactatttttttttccagtttaagaaaagttgacctaccaaagccagaactgctaaataattacaaaacagttgttttagaaatcacttcaccctccgaaaggagtcaactttccatgtatacttaaaatcactcataaaaatggatttaccatttaagaaataattttcaaacacacatgtagtttgtcaaatgaagcctcactgttcattcattcattcattcattcattcgacagatattgattgagccctgttatgggccagatgctgattgtggcacttgtgatacagcagtgaacagaagagtctaaactccctgccccaatggtgcttgcattcctgtgttacgtccacacagctgtgtaactgactctgaagaaaaatgagcttttaaaacataataaacatttcagttttgccagatgaaaaattctaaagatttgttacactacaatgtaaatatagctaatattactgagttatatactcaaaaatggttaagagaataaatgtgttcatttaaccaaaaatttttttaaatgaaaaaaataagcataacaaacatttactgagtacttaccatgttaggcagagcatcatctcatttaatcacaacaaccttagcaggaaggcactattattattctgttttacagatgggtacactgaggcacaaagaggttaaacaatttatccaggatcacatatccaagggatagagctgagatataggcccaagtaatctgataccagcaacttgtctcctaactccatacaaaaagtttcaaagataatactattttcagttggaactacagttaataatacaaaaatagtaataataatatagtacaaggaataataatcaactttttttttttaatcctgatgatttgtaacccaacttactgtccttttgatggccattttttcctaaaaacctcagtgttgaacaaactgctttcaaccacttctctgtaagccataatattcttttccttcaaatggaaataaagaaaaatcacacaggatggtttcttttagacaagatcaggcacgttcagggtggtgtggccatagacgcggatggtttcttttaaaacagacattactgaaactgtaaatatttttagccttttgtacttttcatccagcagcttaactgagaatgatatagaaacatttaaaaatagccactcagtactctgaaaaccattagtttagcacatacccagcacctgcttgacacatcttaatcaacactcttttgctagtcatattaaaaaaagagagaacccttttgctttcagaattttttcccttaaaaaacgtatgtgtcaccagggtattttgccctctctctttctaacttagagggtaacacctggagtaagtcatgggtgactaatgaagatgcaactttcccctcagcatgatatacttcacaggatggaagtaaaagcttctaataggagcatttattacaattgttaggattgtaatggaaagttaattttgttttatagtttgtagaaatgattcaggatgatatgagaacactttctataaacctgcactgataaaaggaagatgatagtgatgacacatgatatactttctgagttgtttttccaggggtgggaaagttcaatccacagatttcaagacagaaagaagaaaggaaaggagaaggaaggaagaaagaaaacaaaattttttttagaattgactatgctcaaatacactgtgctttttagcatcaaactttcaaccatggtctgagcagcactatgttgtaacaaaactggagtagccagcctgagcaaacatgaacatcacaatattttaaagttcaaataacataaggcaccagttttaagactgcccgggtatcctttttagcaatacaaagattcacacaacttggtgacagacagcttttccctccagccaaatctgatgaagacttgataatatcacctgccataatcaaaattcctgggcacatgggaaggtctctgactcaaatcaaagagagctttgggccccaaagctatgggccccacagctatgggctaccaaagaaaggttataaccaggctccagtgtaaaccattttgtttcttttaacagttttagatcttctaaagtatatgagatgatattaataaaatttaaatttcctgctaaatttttttagtctctttccttaaaagtaaaacttacaatgatcagaaagcatgctttcttctggctttatcattcaacttcccaggcaaagatgatcaacagcaacactcttatctaaagcaaaagtaatggatatgattatcactctggacagaaagtctgtatttgcccatttttatcaatgattgagacaatgatccagaagctgtattggtacaaaaacacaacaccagggatgccagaaacaggattacaaaagttctcacaaggttaaaaatagaccaaaatgaatatagtcaagtttactaggctcaaatgtgaggtcctgtatggtcagtacatggaggtccagcagcctcttgattcaatacaggcagtgtgatgggtttgcaaaaatgtactcttaggctgcattaataaagacactgttctcaaggccagataagccacagtccctctcaaactgctcagaaagagtagctttagggccaggtgcagtggctcacgcctataatcccagcactttgggaggccaaagcaggcggaccacttgaggtaaggagttcaagaccagcttgggtaacatggcaaaactcgtctctacaagacatacacaaattagctaggcatggtggtatgcaactgtagacccagctacttgggaggctgaggcaggagaattgcttgagcctgggaggtgaagggtgcagtgagccaagattgcgccattgtactccaacctggatgacaggagtgaaatcttgcctcaaaaaaaaaagggaggtacttctataatttgtccactaccttttaaggaactttctgataaactggagaaagcaaaaaggagtgagatcagaatgactgtggaactaatattatgagaaatattgaggggaactgggcatagataactttgaaaaagactttattatggcagatttgccaagtaaactgataattagaattattttcgatatagaaattaggataccttagaagaggtatctgcatttgatgggtgttaaacttcaggatgtttaaggtcttgctcaactctaccaatctgtaattacatggggaaaagtgctatgtccctcatgaaattaaatactaagaactggagggaggctgcatcaacagattttctgtatcatgtattgaagagttaattttctccaaccaagctagtgaatgaaagggtaactcaagatgaaataatgatgtcaaagcatttttaatatacctcgtggaagaatccaagtgtattttaaagagaaaacacagcacttgttacaccatatatttcatatttgacctgaagttggttacacagaggccttagtcataataaaaaacttctctctgctcaaatgcagtatgtacatagtcataaatgaaaacatcattgccgaactattttttttaaactatcatggcacaaattgcttttaacaaagaagtcatattccaaaagaccttttgtacacaattgtgcagtgtatctttgtcttactgtttagtatcctaaaagaaatagttttcaaaatatctacattcatttataaaaacttgaatgcaggtaatttagcaacaaatcacaactagctgagaactgacataaaagaatgatctccagggccagaaataaaccccaaaagataagacatactagaaaaacatgagagagagaaacaaaatcaatagactatcatctcaatatctagtatgaagcttggtaaagagttgatgaatagaaataaatgatccctacagacagactcaattaagtatacagcataatttgttcatgaaaaaatgagtatgtgaatcttcctagatcttttcaaaaattacttaaaaatattaaataaacatttttaaaatgggtatattaaagcatcctaataaaatgaagctgattgattggttgctctaagggagtagtgataaaataatctgctatataaatcctggatcatataatggtataatgcccctcaaaggtagtagaggaaggtgggttttaggccacttttaaattaattgctctctacctgtttgaatcacacacaatatgtttggctttaagaaaataaaaaggacctagagcagaaaaatagcttatacatagtatctatatattatatttagaatatacattttatatttaagagacatttcctcttggacttttatcctacaataaacaactacaaccataaaaacagtaccagcaaaacccaatctataaggagatttgtagaaaagtaacaacttgatatattctagctgtataaagaggtctcttgtcaattcattatcatccacttacaagtattttatgtacatcttaaaagcctgaagaagttattgtaatgtttcaaactcaaaactactcccctgagcattgatataacttatactccctacaaccaaccaacccaaatctcagtttgcctccattaacgctccaaaataagtcaagattgtaaatacagtgggttctcaatcaattgactttttcaacatcagatgggtggctggagccttcacaaacttcagagccctaatagagatccccttttctagcccacataaataatacaaatcatatctctatgatcattagagatgcaaaaaatcggtacaggcctttctccccttctaacacattatcttaggcttgttttatttatttaatttttacattcctcatgtgatctgtggccacacaagactgattctccaaactgaacttcattctatctgctccacaataagcaatatttattcattttcactcaacaattgtttactaaaaatgtactgtgtgtaagacattgtgctaagagcaagtaagtactaggaagtcacagttctatcatcaagttttaaatctagtaggtgaaagactcatacagaagtatcaaggcagccatgggccacctgagtggtgaaactgagacccaaagagtgtcaggaagacaggaggcactcaactgtggtaaatggggagaatgacagaggagatggcatttgagttgggcctgagaggacaggttgtccaggatttggattgacaatgatttaagggaagagaagagggaagaagaaaacagccaactttaagcaaaggaaacacaatgagacaaatttgcaaaagcaaaaaatgtaatgagcattgcataccaccagaagagcaggtgaataagggtactagctagaagcagcaaggttcattcatttgtattagagaaaagtgcaagataaatggttcatctgaacaatgggtggtttcacagggtttgaaaacatctctccctctgtaagtcatactatctccgactgaagggtccaacgtgaagcaggaacgaaggggccagtcctgtttggttgtccaggtgcaggacccaaaaccagcaacacacagagtgacatatgttgtgactatgcccttctcatatcaaccccaaaatgtaccgaaacactgaaaagacattttccaacggagacttgcccaagttttccttttaaaactattcagttttgaacctccaaattctgaatttcaaactcaaccacctgctttctcagcaacttcaccagtgaactcaatgttgaagctcctggggaaaaaaaaaatctcacataaaacgtacagtgtgataaatccaggcctcatagcattagctgtgtcctcccacttcccacagggactattccatgaaacttatagtgtcttcttcctggtgcacagctgggccacgttttccagcctcctttgcagctagttggtgacatgtgattgagttctaccacgaaatataagtgaaagtgattatgctaatttctaggcctaatttctatgctaatttctaggcctactccataaaaaccttccatgtgtaacctgccatgtttttccccctctcttgatgtgatgcaaacaagcacagtaactctgggagtcacatggtgaagatggagaaactacaagatggaaggaatctgaattcctgaaggatttccaggaggaaaatgtcacctaccattcatcaacacccatttaagacctcatgtgaataaggaagaaacttgtgttagaacagtgaaatgttgagaagttatcttgtatttttttattttgaaaaataatttttattacgtatatttatggtatacaacgtgatgttataggcttaatatagatagtaaaaaggttactgtagtgaagcaaattaacatatccatcatctcagttaccctatttttgtttttatgttaagagcagctaaaatctcacttagcatgaatcccatacctatagtcttcatactgcacattagatctctatacttgttcatactactttgtatcctctgacctacatctctccatttcctgcccacaacccatatccctggtaaccactgttgtattctctctgcatatttgaaatttttttggttccacatataagtaagatcatataatatgtctttctttggcgtatttcgcttagcacaatgggctttcccatgttgtggcaaatgacaagctctcattattttctagggctgaataatattcattttgtataaaccaaatgtggtatacttacagccacttctttctctatttgtccatcatcagacacttaggttgtttccatatcttagttattgtgaatcatgctgcagtgaacatgggagtgcagacatctttatgaggtggtgatttcatttcctttgggtatatgcccagaaaaggaatggctgggtcatatatggtagttctgtttttaatttctttagaaacctctataacgttttccataacggctatacccaatctacattcccaccaacagtggacaagagtcctccacatcctcaccaacatttgttatcttttgactttttgataacagccatcctaacagttgtgaggaggtaaatcacagtggttttgatttgcatttccctgatatgatgttgtgtaccctttcatatgcctgtggccatctttgtgtcttctttagaaaaatgtctactcaggccttttgcccattttataaatcaggtaattcgtttgttctttgctattgagttgtatgagttcctgataaattttggctactaactccttaccaaatacatgatttacaatatatctgatgtacattggaatattgggatatactgattggaattttttcccaatctgtaggctgctacttcactttgttgattgtttcctttactgtacagaaactttctagtttggtgtagtcccatttatttattttatttttgagatggagtctcactctgtcctccaggctagagtgcagtggcgccatctcggctcactacaatctcggcctcctgggttcaagcgattctcctgcctcagcctcccaagtagctggaattacaggtgtgcgccaccacacccagctaatttttgtatttttagtagagatggggtttcaccatgttggccaggatggtctcgatctcctgaccttgtgatccccctacctcagcctcccaaaagtgccgggattacaggcgtgagccactgcgcccagcccccatttatttaattttgcttttgtggcctgagctcttgttgtgatatccaaaagctgactaccaacgccaatgtccaggagctattcccctatgttcctgtgtaggagttttatagtttctgcttttatgtttaggtcttttatcaattttgagttgatttttgtatgtggtatacgataacagtccaattccattcttttgcatgtggaaatccagttttcttaacatcctatcaaagagactattcttttcccattgtgtcttcttggtgcccttgtcaaaaattagttgactatatatacgtggatttatttctggactctctattctgttccactggtctatgtgtctgtttttatgcctgtataatactgtctttattactataactttgtaatataatttttaaatcaggaagtataatacctccaactttgttttgctttttcataattgttttggctattcagggtctttcatggttctgtacaaatttaagaagcattttttctatttctgtgaagaaggtcactggaattttgatagagattgcaccgaatctgtatattgctttgggtactatggacatttcaacaatattaattcttctgatccatgagcatgtgatatctttccatttttttgtgcttaatttctttcattaatgttttatagttttcagtgtacacatctttcacattggttgaatttattcctaggtattttgttctttttgatgctttgttaagtgggaccattttcttcatgttcttttcaaacagactgtaattggtatgaaaaaaaacgcaactgattttgcatgttgattttgcaccccacagctttactgaattcattcgttgttctaacagtttttttgtgtggaatctgcaggggcttttttccccccctacaatataggatcacaccatctgcaaatagagataactttacttcttcctgacctcaatgcctttaatttcttttccttatctaattactattgctggtacttccagtactatgttgaatagaagtggtgaaagtgggcatccatgcctgcctgatactagaccttcatggaaaaactttcagttttcccccatgtattataatgttagctgtgggtttttcataaatggcctttattacacagagaagctttccttctatacatacactattgagcatttttctcaataaaggatgttggactttgtcaaatgctttttctgtgtcaattaagattatcatgtgatttttatctttcattctgttaatgcaatgtatcactactgattgatctgcagatgttaaaccagctttgtatgccagggataaatcccacttagtcatgacatgtaatctttttgatgtgttgttggatttggtttcctaatattttactggggctttttgcaccaatattcatcagagaaattgggtttaaattttcttttcttgtgatgtctttggctggctgggtatcagggtgatcctggcctcataaaatgtgtttgaaagtattccttctagttctatttttttggaagagtttaagaagtactggtatcaattctttgaatgtctggtagaactcagctgtgaagctatctgttcctgggcttgtctttgttgagaggtttttcattacttctccaatctatttgtgattggtctgttacaggctttctatttcttcctgagtcaatcctggtaggttgtattttcctaggaatttatctgtttcctctaggccacccaatttgttggcatataattgttcgtaatagggacttatcatcctttttattcccgaggtgtctgttgtaatttcttcaatttcatttttggttttacttgagttttcttttttctttgttagactatctatgggtttgccaattttacttaaaaaaaaacccaactcttaagtttattgattcttcctgtggcttttctattatccatttagtttatgtttgttctgatttttatttctttccttctactaatctggttttagtttgttctttttctagttccttgaggtgtaatgtcacactattcatttgagatctttcttcttttctaatgtaggcatatattgctataaactttcctctcagaactgcttctcctatatcccatcagttctggtatattgtgtttccgttgtcatttgtctcaaggcattttttaaatttatcttttaatttcttctttgacccattggttgttctggggcatgttgtttatgttccagatatttgtgaatttttcaagattcctcctgtcactgatgtctagtttataccactgtggtttgaagttatatctgaaatgatactagacataatttcaatcttaaattttgtggcctaacatatggtctatcctggagaatgttctatgtatactctagaaaaactttacattctgctgctgttggatggaaaattctgtacatgtctattgggtccatttggccaaaaatgcaattcaagtcctgcatttcttactaattttctgtctgaatgatgtacatgttgttgaactgagaagttatttttacagcagctagcattaccttaataatatacacatttcgaccaaattctttatgttagtttgggtctacccagaagcaagtaccaagatagaactagaaatacaaaagatatattgagaaaggaagccacagaatgtgggaggtccttcaaaccacacctatggacatggagaggaaaggaagaaggaatggctaggaagtcttggattccaacacagttccaagaaaggtctgctcaggccaataggagttcttgagccaatttggcccactggaaaagtcctgtgtcccacaggaatgagcctgaaataggagcccctattgtgcttggtcatgactgggagacgctagtggcaatttgtagtttagtacaatgcaagggtggctgcagaggggcagcagttgggccatcagtcaactacgcttctagctgtagatctaagcacttattttcatggacactacacccctcaaacttccaactttcaagacctacaatcccttatccatatccacacccagtctttcctcctttgttcccatctattaaaaactgagttgtcctttgtctagcccaaagctaatcttgccatgtgttctagcttacgtgccatcagatctgcttagagacattattccatcagttatctccttcttcttcctgtctaatggattatatctatcctccaggatgtaaacttgcttgagattttaaccttgaaaaagaatattaaaaaaatgttccttgacaactcttgctctccttcccttagtatctaagctccttgaaagagtagtataaatgaaccatctcatttcttatttttcaccacccactaattgctcttgctaggattactgaacctaccagttgacacatcctggaacccttgcttgacccctctgaagtattcaacattcttgactactccctccttctgcagattcctgctttgggttcgtggagcaccctatcctcaggttttcctcataccctcagatcattccttctaaagcttctttttatttgcttcctccttaaaagtccacttcctagggcttatatcattggttctctctgttctctgtttcctacattaatatcgccccttgatctcacgatctaattgagcacttatatacttatatactgatgagatcactcatgtagtcacccatgtagtctcaatactcataaccaatcagttaccaagttctgaggattctatttcttaactggctctcagcaccatcatctccttatctccccactgccactgccccatgaacttctgtaggagcagagtgaccctctcgccttggattccattcctacttatctgtacctccacagtgctgcaagagaatatttctaaagcacaaatttcatcatgaaacctctgcattgagattcctgaagttgttccccactgactacaggatgaaggccagcctccttggcatggtacgtaaggtccttcataatcagttttagtctgatcttcctccactaccttctccatgttcccaaactctcattatatgaagttatttgaaattcatacaatgtggcatatgtttcatgcttctatggccttgtatgggctctttgcccaaaatgctctatgaccctgccctaactgggggaatctactgtgcattctttcaatgtttggtttgggattcatttgtacagcgatgacttttacagaccaattcacctatctgtggagccccttcccatccccacgccccattcccaggccattcaagtggctgttgtgttgttagtacccattcatgggtaccatgcgtgcacatgattccaggacagcaatcctgccctgttcctttttgactagcactgacacagagtaggcactaaatggatgtttactgactgaaagaatgaatgatgtacagacccaatctccgaagtttggcctcacaaaatttgcctctgaaaaacaaaattatcacagagtagccaaaaaccatgatgacaccaatcaacattacatgcacacactggtgtccaagtgcaggtagtgacatctccaatttacacgtgaaaagtggatacttggcattaaaggagaaagattcaaatggtctacgtaagacagccacaaagatagctcaagagctattatcccaagggacacgcattaactgttagtaagtatataaactagagttcacatttcacacagaactttctaacacaaattggaaacaggagacgattaagctgatctaaggaaaagcatggctttgatacacaagaaactacacatgcattttacattaaatgctttttaaaattcactcacagaaaagagtacaacaattattttaaaagtcacagtttgtaaatttgatatgtaaaattggaatttaaaataaaaaatctccatggccactgaaggctgaaagagtaaaaagaaaaaggaaataaaagacaaaatgtgtagtttcaaactctctgtgatgcatctcacccctgatcagtgggaagccagttatcacattgaagacactaggtaagcacaagagtttactgaaaatggaccttttcatgaaaaatcatgggtcaaacatctctatgacatacactgctgttaaaggaaacacatagtttctcattcttgacatgatgatgcctgatgtgcttagttagacagacagcttaatatggttcccctcccaaagcttagtgaaaatagcttttttaaaaaatttgaaaaataaatccccaaacataattcttctggcaaaatattaaatcctaccgaagaaggaggctttcagggaaacagtccaaataaaccttttaatttgtttaatgttctataagctattggtatcaagaaaatgtatatctttgttttaaaatagacaaattagtgatgcatctacatgccatccacttaactttgttcctgctgttcagcctttataagagtagcattttttcttgcgctgactcctgaagcctaaatctgcaaaagtctgtgatgacatcaagcttaacattttgccaagcctgtaaaattatttctcaaaatagtgtgctaacacatcagcttttactcaaacctaaattaaatgtcaggaaaggactcccatgtttacactaactgcccattagtaaacatttctgactgtaataactgaaggtcccatgttctcaaggtaatggcaccagcaaaatcccttgaaaatttgctcctaaccacaagtctaagtaggatgtggtcactcaggttttagattgatgatgctgaagaaatgtatttacaggctgaaaagcttataaccctggccaaaacactgacttcagagcaccaggagaaactccttggactagataaagtaaatatttgaagaaaatctgcattcattgagtgatttgctggtatatacaaaatttatcctttaaggaaccaaacaggagttctaattacctccctatatttcttctccttatactttccaagttcaattacagctttgttcaatctctgccttttttactcttttgtcctctgtctgaagttttcaattaagacttactttataacaggattgtggttacgtaggaaaatgttcttattcttcagaaatgatgctgaggtcttcagggaaaaatgtcatgaaagtaagtctgcaacttacttttaaatagttctaaaaaatgaacccctcttgccaacacacatacaaaactataaattcagagacaaaataacaaatattaataattggcaaatataaacaaagggtatataaatgttcttcatatgattctttcatctcctctctaggtttgaatttttcaaaaggaaaagaaaaaaattttaaaagaattacttaatgagcaccaggttttcaaattgtaaatgcatttcttgagcatcacatatccaaaacttgagaggcctagggctaaagaaatgtcaagactaacaaaagacatgttgttgtcctctacagacatgatgttgactcaatttgcacatcctggaagtgtgtatctgggatggaggtgaagaggcattcacagccaggcatttttctccagaaagctgtccctttggggtttcctcgtctttccctcccagtgagaccctggttcacctgctgtctctccagctgtcaagcagtggttcctgggaagtctgggagacccgtgagaggttggaggtagattcaaagcaccctcatggaatgaatttaccaaataaacaactgcatgttagacctgtacatttaaaaacataagtgctacaaatattcttaaaaggctttcaaaatttcagtgaagacaagaatgctttttcaaatgtttatgtaaaaatcttatacaagctgtttgctattatagtcaggatatatttggtgagaaaaacaaaacattgtaactcaaggcatgctccatttcagacaaaacatgaactctctcctttaattatatcagccattacaacaagaaaaccttgtaaaaggttcacacatggggcccacattatggggatccacttcaccctcagagaggcttgttacacagctgagagagagcatggtggaggacagttgcttctcccttttttataaaatccttcccatttgctctaaaatagaatttctaaataacagcacccaaagagtgctcaaaataggatactaaaccactttggagggcaagacagaagtctcttgtcagcttccacaagaaagagaactttaggctgtacaagtattttctttgggatgcaaacactttgatataaaagtaactttctttaatatatttgtgctaacatgatgggaaatgcccaactcacacatcaggatcttagtgatagtgcatctatcctgaacatggctgtcttaattagcccgatgtgtctatggtaataaacaccacgctgcagaacaactcaatatacccaggtgaaatctttaccacttaaaacactttagacggcttgtaatcaattggatggcattttcccaatgagaaatcctaactgcaaggtaaggtacctttctatctatagtgagtgttgacttacgttgcaggcatggtgctaagagacttcctctgcattatcaactcattttaaacttaatactaccttgtgaagtatgtaatgtcctgggcaccagatagaagaggacagagaagcactgagaacagaagaaatgaacatttatcaagtactaccacatggtactgtaacagtgctctctatacattatcccatgtaactatctctacaaccctatgatgtaagtattagtaatgccattttaccagggagaaaactgagagatacataactggactaaggctgcagagatgggaaatgagcctatactgtcatatgcccaggtactatgtgggcacaattcctcctgatcaccacattctacaagctccaacccagatgctaaaggtagaggcaacaaccatggaggaatagccatgaatgttccttgcggccactgcacccatggaggctagagcagacctagtgccctgagggtgggatgtaaattcctttttaaatccagagggtgtgatatggagggtctatctctggtttaacgaagatactgaagccagtgaaaacagatcccaaatctggccccacgactgacccagcctcctaaagagcctgtagatgaccaactacagagagaggaaggctctagaagacagaagatgctccctgggaggttcttttcagctgtctttcttcttccctcatgcctctctatgacttaacttggcatctaggtgcacatgggcaattgttcacagcagccaaaaggtggaaacaaccctaatatcaactggtaaatggataaacaaattattgtatattgtagcatacaataaaattttatccagccacaataaggaatgaagtactgatacacacaacaatacaaatgaacctcaaaaatgttatgctaaatgaaaaaagccagacataaaaaatcacatactgcatgactcaatttatatgaaatatccagaaaaggtgaaaccatagacgcaggaagcagagaagtggtttccaggggttgagggataaggggaatgaggagtgactgcttaatggggacggagtttcctttggggtgaggaaaatgtttcagaactggatagaggtcccagtcgcacggcactgtaaatgtactatatgccactgaattgtacacttgaggagggttaattctatatgaacttacctcaattttttaaaagtacacatggcaacgcatagtctttgagcaatcttgaataacgatatacactatgccaagctataaagatgccccaccctgtgccctttttacattacacacaaatagggacggatttcctgtaagctgatcttgaagaaaaaaaacatgttagacaaagaaaatcagaactaagacatctcccccccaccaaaaaaccctcaacactgtatctttgttcttttcccatgtcctctaccctactaaaacgaacaaataatataaaccccaaccactgagtgtaccacagacagaaaacttggtacacaaaagacctaataaaataaaatctgtcaagttttgttgcccccaaattgaatagaaagatccagcaggcccttaaacatatgaaaagaagcacactcttgctggcaatcaggggaactcaaattaaaacagctagtgatcactttacaccgcagagagagaacacttaaaaagactcctaacacctggcaggggtgaggcaaacaggtactctcatattttgcaggtgtgactctacagcaatgcaacttttttggagtatcatctgacatcatgcatgagtcactgactccgtttttaggaatctatccttcaaatatcaaagtagatacacatgaatatatgtacaagaatttaactgcagtgttgttaggaatggtaaaaacctagaatgctcttgaaggtatatcagctggggaataattgaataaactatggtacaacgataccataggatattatgcaactgttaaaaagagccactagattcatatttgataaggataaatgttgtaacaaaatattaaagaaagttgcagagtattgtttatgatgccattttcatagcagaaaaaatgtcccttctccatgtaaaggtatatgtttgtatgtatgtatatgatgtatagagaaaggaaaagaaccagaggagtgggagaaagacaatcaactttttctatattcacctaaatattattttatgcattgtcctacaattttttttaaaatagaaaaagtttaagtaaacagcatttttttctgcacttgccttttttgtttttttttttttttcaagacagggtcttgctctgtcgcccaggctagagtgcagtgccatgatcttggcttactgcaacctctgcctcctgggttcaggcaattctcatgcctcagcctcctgagtagctgggattacaggtgcacaccaccatgcccagctaatttttgtatttttagagacgaggtttcaccatgttggccaaatttgcctcaaacccctgatctcaagtgatctgcctgccttggcctcccaaagtgctgggattacagccatgaaccactgtacccgaactgcacttgccttttatacatgcaagaaatgtgaaggggacagtccccaaaaacccactttgaggatatgttctgaaattagtatctactgaacttcagtctcctaagttgtatatattctgtccaacagtgcaactcgaactggactctgcagaccagccctagtcccagaataagcacagaaactgagagtagacctttagaatttttttacagcagcttgccagagtaattttatgtctgttgactataagaataataaatgtttaatcaggcttatgtttttagtttctttaaatttcatttttctagtatttcatttttctagtaaatcatttttattgtattttataaaattatcaatccatgacatactggaaattaaaaacaaaactggtccttcacccaagataattagagaagcaaaactctaaacaatgagagtcaatgttcataatgataaaacatagtaatataagatatttaggaactttaataatgaaagattagattctattgagaatacatgctaatatattcaaactcttatgaaaaaagatactaaatagatcagaagaaagctttctggtaataagaacagattactaaccattctaggtaaataattaagttcattcttgtcaggaaaaatgaactctagtttctattttcaagtgaagactaagagacctggagaataaatgaaaccccatacaactccaaaaccagctacccagagttcagccagacactttaacttttgctgaacaaaattaacttcattttcatttttttctcccctctcgtccttctgaatgaagatgctaatagcaacagaaaacagtaacagagacaagtggcagggttaggtggggctaaggtctgactactccgtgcagattctatttaataaagtttcacctaccaatattctatgctgggggtgaggggtgggaagggaagggagagagcttacatactcctaagtcttctgagttttctaaaagttgatacaccaagttacagttacccagaaaaactggtgggaagaataaagaaccaaaaaacatacttacagtccaaaagtaaaaaatatcatttgtacatacaaatttcttctccccttcctaaattttttaaactaatgctatagtgaggtgcatttccaaatctggcagcttaaataaaatcaactgtaactagcattgtggtgaatgaaatgctttacaactcacagctgtgacactgaaataaggaaatcctggattcccaccaaggggtaaccagcatcaaaagacagggcacattttgatgttttgagaatttctgagaagtcagagaaaatttaggttattttcatatcggttggactttccataataaaagagccctaaaacaaatagcagccccaagtgtggcagtgctatattgtttggattccttataacaatcagtgtgttcataagatgcttagaaatacacagaataagctgatggccccggtgagtgggacacacgctgggcagctgtgtgaacttttaaaattttaatttaatttttattttatttcaatagttttgggggaacatatggtttctggttacatggataagttccctagtggaacttcactctgagtctccagagtccattatatcattcttatgatacactatatttggttttccattcctgagttacttcacttaggataatggtctccaattccatccagattgctgtgaatgccattattttgttcctttttatggctgagtagtatttcatgatgtatatataccacattttctttatccactcattggttgatgggtatttaagctggttccatatttttgaaattgcgaattgtgctgctacaaacatgcatgtgcaagtgtctttttcatataatgacttcttttcctttgggtagataatagtgggattgctagatggaatggtagttctacttttagttctttaaggaatctccacactgttttccagagtggttgtactacctaagaaactctaaagactcatccaaaaagctcctagatcagtaaggtctcaggaggcaaaatcaatgaacacaaatcagtagcactgctatacaccaaccgtgaccatgctgagaatcaaatcaagaattaaatcccttttacaacagctgctaaataaacaaataaaatacttaggaatacacctaaccaaggaggtgaaaatctctacagggaaaactacaaaacactgctgaaagaaataatcgatggcacaaacaaatggaaacatatttcatgctcatggatgagtagaatcaatattatgaaaatgaccatactgacaaaagcaatctacagattcaatgcaattcccatcaaaatactatcatcattcttcatagaactagaaaaaacaatcctaaaattcacaaggaaccaaaaaaaggtacacatagccaatagaacaaaagcaaaaagaagaaatctggaggcatcacattgcccaatttccaactatactacaaggctatagttgccaaaacagcatggtgctggtataaaaacaggcacatagaccaatggaacagaacagagaatccggaaataaagccaaatacttacagccaactgatctttgacaaagcaaacaaaaacataaagtgaggaaagaataccctattcaataaatggtgctggaataattggcaagccacatgtagaagaatgaactggatcctcatctctcactttatacaaaaatcaactcaagatgaatcaaagacttaaatctaagacctgaaaccataaaaactctagaacactggaaaaactcttctagacattggcttaggcaaaaagttcatgcctaagaacccaaaagcaaatgcaacaaaaacaaaaataaatagttgggacctaattaaactaaaaaatcaacagagtaaaaagacaacccacagagtgggagaaaatctttgcaaactatgcacctgacaaaggactaatatccagaatctacaaggaactcaaatcagcaagataaaaacaaccccatttaaaaaaaaaaaaaaaagaaaaaagaaaaaagaaaggaaaagaaaaaaaaagaaaagaaaaaacattgtttatgaagttcagagcttggagattcattcaagtattgattgcagttttattttgaaaagaatgctacaatttatgtggtttttctcatgtttatattaaaagctaataaactaatttaaaaagaacctatcaaaaactgggcaaaggacatgaacagacaattctcaaaagaagacatccaaatagccaacaaacataagaaaaaatgctcaacatctctattagggaaatgcaaattaaaagtgcacgagataccatcttactcctgtaagaacggacataactgaaaaacaaaaaataatagatgctggcgtggatctggtaaaaagggaacactttcacactgctggtgggaatgtaagctagctgtgtaaacttatgaaacaaagaccaagctgaggtccttgcctcacctgctgtgcttcaagggctcatcagcttggtcccaaatgatgtcttcagtaggtggcgaaatgttaaaactgggagctatgtgaacgaacgcgctgaaagacaaaacacgttagatcagttaggtcactataacaaaacgtagtatcatgcaaccaagtgctgttaaccaacttccttctctgcttgacattgaactacctgcaaatttagtgcttagaaaaggtccagggacttgcccatgaggaagaactcagcaataccacagactttaatgcaactggatttcacctcctcatgtcaccaagacttactgtgcagggtacaaatggccttcttccgtgtcaaatcttatgtccccctttcactcttgttctccttgacttctttgtagtgtctgacactgttcagtagttttttttttcctctttttattctcctctctctcctgcttcgcctgtttcttttatggtttcctgctcctctttctccttctgcttcttgaccaaggacactttttaaggccctgggtttttctctctccctcagaaatcgtctgttcccagcacatcaattctctccttgcagatagccccccaatcatccccattccctcccttgaactcctctcctttattctcaactctccagtgagccatttttcctgcatatggtatctctactgcatatgctcttcaaaagccttcatttcttgctgcaacactactgctgtggaaaaatgagcttgtctattgacctcattgatttctgcaatagcagaattatcctcccagccaaccaagctccaaatcttagattcatttttgctcattccctcttcttcaattccagtcattcatcaaggcctcttgatttgttacatctcacctctatcttttgctacccacttacactgaccagatcctgcttagctgagaaaaactccctcttctcttctttcctaatgtttcctcttgtaaaattggccagcgtgctgctgccattttgatctttctatcactacccctgccattttcatcttcctctcgctatccccagcaatttgagaatcctcatcacccctctaacaagcaacctgcattgcccagtagagagaaaacaagacagcagagtagctaagaactcaggctctggatcctggtggccatgctttgaatcacagttccacaacttaactgctatgtgcctcagtctcctcatccctcaatgaaggccaggtgcagtggctcacacctgtaaccccagcactttgggaggctaaggcggaggatcgcttgaggccaggtgttcaaaaccagcctggataacataacgagttcctgtttctatggggaaaaaaaattagccaggcatggtggcacacacctgtagtcctggctactcaggaggctaaggcaaaaggatcactcgagcccaggagttcgaggccaccatgagctacgatcataccactgcactccagcctgggcaacagagcaagactctgtttctaaaaaaagtgggggcaggagggacttgataatatctcctgcaaaggcttgctgtgaagataagaatagttaaaaggtgtgaagaacttagaagagtgcctagcacagtaagcactccattaagtgttaaatggtaatggctcccagctggactggcccacacagcatctcctaaacctgtgtgctcacccttcctttgttattacaccttccatcatttggcttatacagtgtggaaactcttcttctcttggctcctctatacaaattctgcccactgtcaaggctcgggtctgatttcccactcagccagtgggaaatctgagtacttcagctgcaaactagcttttctgcctctgaacttctagaatatttactagatgtccctaaatcaagttgttttttaaattactgagtgtggagggaagctcacaggctggaaattactggtgatggagctggaggtcttgctctttcctctgggtgcccctaagtgggtaatgtctcagaaccccagcttctttctctgaaaaagttattatcttatttataaggtttcctcaaagactgaataagaacatgtaaagctcctatcatataatcaggcgtaaacattagttcccttccagtgggactataaacctccaagggtagctcacgtttctccgtgctccaaggacagtaatatgcagagattaaacagacagataggggaatacagactgaataaacgaaaacctttccaagtctgattttatgacaatattctgaaaagggcttttccatgcctattctaaacaactgacagtgcttccatcataaaatgcattttgacacacttaatcttccaagaacatacgttgattctatgccctgatgagagaatatattagctacttaacctttatctaactcttacataatattaagatttttttaagattcatttttacaaaacccagaaagtccacacacaacaaaaacaaaacaaaacaaaaaaaggaacacaaagtaattgaaaagacttttcatacctaaaaagggaatttttaatcacaaccttagtcataaacctcaacaggcaagtcagaagcagtgaaagataaaagtgccaacaagaaaatccggttgaagtgccactcgggttcatgcagtgggttacagggcgcacaagacaagctggcggaagtgggtgctgtacctttatcacagccgcccccacctgaccacctgtagcagcctcagaggaagcagacaacccccacacactttccagctgcatctttgcagccacaaagtacgcacatacaatcagctaacgtataaaagtatatcagaagcatcaatgtgaaaagggaaaaaatctttaactcgtgatgagtaacctgtgttatttagattctgtcattgagacctgatgctaaggggagacccctctaaagacacccacacaaccctgataactggcagcataagtgcataatctttgcatcaaatacctggggcactgaagaggctgaagcagcaaatcctctggtagagggtgaggaccaaatgggggtacctcagaggctacagttcctccccctagtgttcaatgacaaatggaaacatgtcactgggtccaaacgcagggaggactagtctttgctttggcaccaggctagacaaagaaaagaccccttgccccgtgaccccacattgtcctacaaaggaaaaggctggattttgttgatgaatgcaattcacatgtttggagcagtgtcatttgaaaggactgcttcagaaattcatgcaagtcacataagtggagagaaaacaggaaaaaattaagaatggctgtttacaagtcacttctaaaactttgctttgttctacttgaacaatttttatcatcatttaaagcagttaaattaaaatgcacctgcactgtaaatcgtgagagaacatacctgctcttcaaatatgacttgaaaattatttggtttctcccctacctccccctacctgggatgctctcattttacatttaatttggaaaattagaagaaaaatggaataagctcaaatcctaaccaaaatttgtttttacttttaaaatacaaccattttagaatttttaaataaatgtaaaatattttattatttacttaacttttaccttcagggttacatgtgcagatttgtgatatgggtaacttgcgtcatgggggtttgtcgtacagattattttgtcatccaggtactaagcctagtacctgataggtttttttttttctgctcttccccctcctcccactctccactctccagtaggccccagtgcctgttgttctggatgggcgtagcggctcacgcctgtaatcccagcactttgggaggccaaggcggcctgaacatctgaggtcagaagttcgagaccagcctggccaatatggtgaaacccagtctctacaaaaaaattagccaggcatggtggtgtgcacctttagtcccagctacttgggaggctgaggcaggagaacagtttgaacccaggaggcagaggctgcagtgagccgagatcacaccactgcactccagcctgggtgacagggctagatttcgtcttaaaaaaaaaaaaagaaagaaatcatcaatgggcattaaagaaaagtgtaacttttaaacctactttcatagttcaaatacacccagtatttggaggtcagagtagtcacacttcactaactttataaaggagaggctttcaataaatgcaaggaatgtctaccacagcaatacatgtgtaaaacgtttcatctatgacagccatgttctaaattaatgttatatttcctactctgaaataattttaatttatgactaaaaatggtaacaaatgttcttttcattgaggcccaagaaagtatgagagtatttattcacatattctcatttcccatgtaacatgcctagggccatcctgaatgagagcacagaaaatgtgaaggatttctctgcctagtctgcttaagatcaacaacacctataagtctaaacataaaacacacacctttaaatgatcaccattaatgttaataagcattaaaggtagacactgaagtcttttgtgttggcaaatcctagaactacattttcattcagacaggttgcctctggataaacgtctaagattttttctaaaaacaagttatggtatttataattgccttctttaaaagaatgcaaattcttttgcctacagattacgctaagcaaaagagtgagagagagaggaaatttcagtaaaattttgagaaccatagcttgcattatagattttggaatgtaccttcctgccatttaacccaaccccattttcttatttcctagtaaatacactccccagttattcatcccttattataccctgggacaatggtcattttggtaccaatcacaccttagttttccactatcacctgctaaaagttctcttgaagaaaaaaaatataactgtaagagaaacctgagtgatataacgtcagtattttaacatcctaaccctttcaaattctctctatatgagaattgactattttcatcctcccttgaaaaaatgtgttcgggcattaaaattcctctaccttggaccttttcataatggctgccttagtatttattttgatatactattcaagacaccaacagtttgaggttttcacttcttttcttgaagagtgtcacaaagtcaaatttcagcctcatctacaagacatttaaaaattacactgctttcctgatttaactcctaaatatgcccaacacaaataattatgttgttcacctgaagatatgttctagaatcttcacattgctactcataatggccccaaactggaaactatacaaattaataaatagtggtatagtcacacaatataatactatatagcatggagaatgaaaaatcaactaccatagtcaatatggtgtcatgcacaatatgagttaactgtgcatattatcgagtgaaagaagttagacacaaaatagtacattctgtatctccattgatataaagttcaaaaacaggcaaagcaaatctatgctttcccaagtcagagtagtggctaccacgggtgaagtagttactggaaggaagcctgagggatttctagggcgctgataatgctgtgtcttaatctgggaactggttacaacagcgtgttcactttatggaaattcgtcagtaagatgaatatatgttatatgcatacttttccctatttatattatcattcaattaaaaagaaataaaattaatcagcttctcttaagaaacagacttacaggaatgaaaactagtgtgtttcacacagtaaaatggaagaagcttaagagctaggttcaaattccagactctaccattaattattcaatcttagcttctctggcttccagttctataaaatggagccaacagcaaagatcaaatgacataacactgaaggcattttaagcaagaagaatatacaaatgctgagcactactgcctgaaatactaataatgtacttatccgagaagcctttaaagttacatggttctacacaaaatgttagtataaacataactggcaagataatattatcagttttgccatttaaagaacttcctaacaatcaaagatatgcaacatttattctacccaaagttaaagtgtcctgccctaacctctactttgagacacttggtaaataattttcggaagagtgtcaagatacataatattataggagacgatgtcaaatattaaagcttcaataataagtggactagagaatgattctactcacagctcacagttcaatccatctcttcttctcactgacttctcaaccattctgtgcttttccatgttttcctccttcttcccactctaccctgcctcctacctggccatgccccctttctctctgcccactgaaattctacccactcgtcagtgcccagccaaggcattcctctggtgggacacccttccaggccatggagacctttccaggccgtggagacctttccttcctttgaagcactttttttagtgcctcaaccgtctgtttgcaacagtcttggacctgagcattgaacagctatgtatctctcaagccatgatttaacaactcatgtgctcatatcttgcttccccagtagactatatgttttccctaaaggcagggacctgtgtgatacttattttaatcccccttcaatgctctgtacattgtagatattaaatgcttgctacccagtgctctactttgtgggttcaagaaagcagtaatctctaaaagtagggcaaaggtgcagactgggatttcttcaagtaagtggattctgtcggtggcacctcatctctaaaactctctgttaagctctgatcttcttttctctgagagctctcaatcactctagactttagagactaaatcagcactttgaaatcaaagtataaggtgaaccacatataattttaaatttctagtagccacattaaaaagtaaaaaggaacaggccaaatgtatcttaatatttactagttaatcctatatatgtaaaacattatcatttcaacatgtaatcaacataataaaaattatcaaggagatatatatcctttttgtttgaaagctggtgtatattgcacagcacatctcaaccacatttcatatgctcaaatgccacatgtggctgatggctaccatactggacagaccaggtttagagttcaagctagaatatgtgatttcaaaccattctgaaaaaatctaaaatcgaacaaacgctataggaatatgcagtaatcttcctaaatcttgctcttaaaaaaaaaagaatacggccaggcacggtggctcatgcctgtaatcccagcactttgggaggctgaggtgggcggatcacctgagatcaggagtttcagaccagcctggccaacatagggaaaccccgtctctactaaaaatacaaaaattagctgggcacggcagcacatgcctgtaatcgcagccactcaagaggctgaggcaggagagtcgcttgaacccaggaggtggaggttgcagtgagccgagatcatgccactgcactccagcctgggcgacagagcgagactccgtctcaaaaaaaaaaaaaaaaagtctacactactttatcattttataaagccctctgtcatacattatctcatctagatgacatacgtacagcaaacattaagccataaagtagtttcttggtcctatataccaaaagaacacagacctggtaacacacgcttaaatcaaataactcacagccttaaagaacatctattcatgagacgttttctccatttttactatacagtaaagcatattttatctcttattttaagtcatttaagaactttttattttggaattttatgactagccctttaaatattagttttgctaggaacatcaaaagaacaagtgactaattacataaaggggaaaagattaaatgaatcatggattccacttgaacttcatcagttaaaaggataattagcaaaatatttaaggaaaaagtaaatgagcttgttagtcatggccttttgaggggaaaaaggtaaaactattttacttgcctgatctcagatctagaatctaaaagataaagaggtattgtggagaatcattataaaatactcagacttcaaaggttcccataaggtcaaaatatggactatgtataagaagaaaaaatatgctaaatataaaatcaatgtattaatgagatatatttatttaaatatcccttttgagtattcttaacaggtattcagaaccctaatctgcttttgaattttcaatgaatataaaagaaaaatttgaagacattaatggagaattttaaagcaagaatctaatcctgtatgttagaaagaagaaaatacaacgttatgtaatattttaattcttataggtgcccaaatacataagcaacctaactttgacatcgggggaaactggacaaatccatttaaaactaatttagcaacaaatacttacatggttctgtggacatgtaacatcccaaggtgttttaaattgataatgtcaccatatgaactgataattttcagttgaacatacagtttattctataaaatcattaaatcttaagaaccatgagggatcttagagacatttagcccagtgcctctcaaattttgatgtttatgtgagaccccaggggcaccttgagaaagtgcagattcagactcagtaggtgtgggtggccctgagacttcatttctaacaagctccaggtgatgccgatgctgctggtccagggaccaggcagtgggtattgtggccccagtcaagtctaagggaggtcccacagcctctgcttgggcatctccagtatccaggacttgaaacctgcctccaagggtagacattacagggagggacttgtatattacagagagggaagcaacaaggaaaggctgcttccacttctagtgatggaagacactctttctctcccaacatctcctcttctccatgttgaaaatccccacttcctttggccactcttagaactgataggtttccagacccctaaacatctttatcacagaaaatgctccctctgtggtgaaaatctttcttaaaataaatcccttgggacaagacatagcatcccacacatgggacatccagacctgagagtagttgagtgagaacattacattccctgatctaaaggggacagctctcttaatgtggccttaaggaggtgtcgccttctgtaagaatcacactgcactggtggctcacaatgttgtggaggaaataataccaagcaagtgttcccatgtgcacttgaacaattatttttaactaaaatgtagcaatttacagttatttctatttaatgtcatcttgctactataacaactcacataaatcctttaaaatgtttactaataggtcacacatatataaaaaacatagacagtttttaaaaacaattaagaagaaagaatatccttgggaccactgtccaggttgggagataaaacactgccaggacctcagaagcccccagtgagccccttctctatcatacccactccttcacctctggaggtagctgttatactgctttttgtgacaatcatattaaatcatattaattttctttatagttttaccatctatgtatgtatccctaaataacatatttagttttgcatgcttttgaactttacatgaatagaatcacactgtatatattcttctatcttgcttctttctttccatattgtttgtaagattcatccattttgatgcacttttatttgtttaacaaacacatatagaatgtattgtctgccagtcattctcctaagcatgtcacaaacattgactcatttaaacttcctaacaacactatcaggtagacatcattttccctgatgtacagatgagaaaactaaggtacactgaagttcagaaattcatccaaggtcacacaataagtggcagaaccaaaatctgaacccaggcacaatccttcctcttgaccaccaagaaatgctgcctctccacacccttctatatgtggttatactagttgatttttcattgccaaatagtatcacagtgtataaatacctcacagcaaaatgtgctgattcgattcaatgttgatgggcatttatttgggttgcttccagttttttgctcttatgaacaatgcttctttgaatatgtttgtccatgttttttcttttaagttcaggggtatgcacatgtactggtttgttacacaggtaaacttgtgtcatggaggtatgctatacagattatttcatcactcaggtattaggcctggtatccattagttattttccctgattctctccctcttcccaccctctaataggtctcagtgtccgttgttcccctctatatgtccatgcgttttcatcatttagctcccacttataagtgagaatgtgcagtttggttttctgttcctgtgttagtccgcttaaggataatggcccccagctccatctatgtccctgcaaaggacatgatctcattcttttttatggctgcatagtattccatggtgtatgtaccacattttctttatccagtctatcactgatgggcatttaggttgattacatgtctttgcttattgtgaatagtgccgcaacgaacatacacgtgtatgtgtcttagaataatttatattcctttgggtatatgcacagtaatgaaactgctgggttgaatggtatttctatctttaggactttgagcaatcatcacagtcttccacaatggctgaactgatttacactcccaccgagagtgtgtaagtgttcctttttctccataaccttgccagcatcaattattttttgttttgttcatgtttcttaaagcacataggtaatcatttttcttaggtgtatacctaggggtaagatggctgtgttgtaagttatttgcaggttgaacttggttaggtaacagcaaattgttttccgatataattgtaccaagttagactcctgtcaactaaatacaaaaactcccattcattcacatccttacatggtattgtcaggttttaaaatttctgccaatccagagagtgtgtaatcatatgttactatgattttaatctgcatgtgtttgtttattaatgaagctgagcatctttttatatatttactagccaattgggtttcttcctttgtgaaatgcatgtttaagaatatgaatgtacagtatcatttttctttttggttatctggcttttttattgattcacatgtgtgctgaaccagtattatttatgtgccacaaacgtctttaccactttgggcttgttttctcattctccatagttaccactcagtgaacagaagtcctactcacttttttttccaacaataagtgaaagacccctcatgcttttttttttttcttttttgagatggagtttcgctctgttgcccaggctggagtgctgtggtgcgatcttggctcactgcaagctctgtttcctgggttcacaccattctcctgcctcagcctcccgagcagctgggactacaggtgcctgccaccatgcccggctaattttttgtatttttactagagacagggtttcatcgttttagccaggatggtcccgatctcctgacctcgtgatccacccgcctcgacctcccaaagtgctgggattacaggcgtgagccaccacacccggcctcctcatgcatttttaacttttgaactattttataagaattttttaggtctggccaggcacggcggcttacacctataatcccagcacttagggaggctgaggcaggcagatcacttgaggtcaggagttcgagaccagcctggcaaacatggtgaaaccccatctctactaagattacaaaaattagctgggcatggtggcatgtgcctgtagtccagctactcaggaggctgagccaggaggatcacttgaacctgggaggtggagggtgcagtgggccgagatcgcaccactgcactccagcttgggtgacaggacaagactccatctcaaaataaataaataaataaataaataaataaagcacttagaaaggaaaagaattatgttaaatatacatgttggtcttacagtctagaaattcagttgctttgactataaaatacaaaaagcaaaggctctgggataagaccactgtgatacgaagctaagatagtgatctctgatagtctggccaaactgcagcaaaaccaaccaaaactaaacaaaaaacaaaaatgtccccatatgtagacatacggaaatgggctgcaaaaagatgaacgtacacctgaattcctggtgacatctgggcagcccctcagcaggtagcacagttcttcctgagctagctgctccactctgctgtttcctctgactcgcattttctgttaaccttcctcttggaatcctttgacaatgactcacagggttatggggctacttagcaataccacagccctccgcaatagatgctgtgtaggagggacgcagctcagtggattgtagtctgcaccagtattttcctttctgcattcagggaggatttgcttttcagccacatttccctcaaacacagccccgacaggagatgcttagcgcagagatttctaaacgatgaaatgatctgagtttggctccttaatcataatgaaactaaaaacagtaagatgagaaaacaacagggggatcatcattcctacaaaaaacaactttatacttgggcaaaatcaagagattaaaaaaaaaaagctcaaactaacattttccaacctttcactaagagcaagggctaaaaccacatgttttgaaggtcttgcactgtgttattattagaagtcacaattctattgatactgatgagtcattcgtatcggcggaaaccaagaacttccatcaacatcatgttacacacagtcactgtggcttttctttattactggtcaaagctgcttcagaatgcttattgaaacttaagaaaaagaaggcaaactcctcaagggtgtgcaaagctttcccttccccagctgatcttactttaatcatcctttttcaagacagtttatgatgattggatcaacttgtatctacaaaaggaagtttatttagaagcctcagaaaagcaacatttcacactttccgatgaaaataagcaaaactgaactctgaaaacaaacagtgaaaccatctctgaaaatacatgctagctttaaaatgacctgaggtcaagttttttgttttgttttttaacctcaataacagggaacggatataaacaaaagctgtcatcacttagggacttcagccacataaaacaatgtcaggctagtcacttgcaccctcgcccctgcttccctactcaggacacactgctttgcactgagggagaagtgggtcaggtttcagttacgccaagaaagcctaactaagttaaaggtttatgaaaactctttctgatcttagtaggaaataacagcacattcccttttcatttattatcagccccttttgcctctccccttaaatattcccagaaaaataaagtgaagcaaaaaaaaagttttcctgaggcatatccagaaatgctatgaatctttatgcagtccctacaaaggtagaaatttgtccaattttctcccctgcaaccagaaggctgtgtctggctgctggcaggagaagaggacccagctcagcagtgaccacagatctgaaaatagcctcccagtagctaaccagcccagcagcccggagctctccaagggcggtgctggtactatgggcagtttacagtgcggccagctgagtgctacaacagctgcatgagtcagcaagcactgctggtaggaaagtgctgacatgctaaattactctcgtgtacttgagatgcacacacctacctggcaaaaacaaaaacagggtacatgcaaattagcaaacgggaacctctctacgcttgcagtttctattttccaaggttagaccaaaaatataaataatctatgccactgctcaaaaagaagtaacaactaataataattaatcatggtaataaacaactcactcttagtgttgctatgtgtggaacagctgcactgaaatctcacgagccagttaattttaactggttttaattttaactagatttaactgcttttcctcccttctgaaaaatcaaaatagttaccatatcgaccacaagaactggtaacagacaagcacagttcctgtttttcagaggggacttactttcaaacccacaatatcaacacgcttaacataagtggaaatttaaaatgtactgtttaatgtgggaaatttaaaacctgtatgctaattgagatctcatgtgccaggctttgtctgacaatgcctctcattcatctatgttctctcgttttatacgggacctaaaaatctgcaggaacactggttgtctggaactgagaatacattttcccacagaaatagggccaggccaatgagctaggattccttgatagtccgtgaaaatgtcttgaacttaaaatatgagaggttaaatttataatctaaaaagaaaatgatactacaatgatagttccaaaaccatttaaaagaaaatactcttgattaactgtgtttgaggaaatgtctaactacaggaggatgaagggacacagtcttccaagtgacactttcagacttcaactttagggtcattctggttctctaacatggtttcaattgatagtttcatttaaaatgcatagaattctcttactttggcataaagtattgttagaaaaaaaatctttatacttaccggttttaagtactgttttgttctccaaaaaaaaaattgagacttggaaaacaaaaaaggaggagaaacaagtacaaagagggggtactagagagagggaaacaaattaagtctggaacaaagaaagacacggaggtataactaaactgcaaaaacaaaggagaggtaggaactagagggcagttccccgctagacagtgtgttcccagagaaagaggactcttcatcatacccagctctggaggtgacagtgaagtcctgcaagacagttccacagactggcactagatggagccatcaactcaacatagcatggttgctggagaagggtatggtgggggagaggtgggactgaagggcgttgactctacagccaggtatttacctgccaacaactctatctaaaataagtatagtttaattaatcaaccaactctcctaatgtccagatgtcaccaccatgctgacaccactatgcttgtggtatgtcaaattgggacacaccaattttgaaataaatttatcaattcaatttgtatcaatgcaactggggtggggaggtaagtgaagttggatccgctgctttttttttcttctaaaattcaacatgcaaagataatatagaatttcaggttcattgctactgaataacaaaaatccctaaccacaaaccaaatggctttccctggaagctttgtttaaatgttaaataacataccatcttgctatagaggtttatgtgatcaactccaatgtacggcaaaaggcgggaaatgctcactgacaaatgtattattaaaaataatcttctctttgtattttaatactactttgatttaaatactgtaatccatttgcctatattctctgcctagggttgtgtttatttatcacgagccctctctccattcagaaatggtctcctatcaccaggttaccagtgtgcgaaattctattgtttttatctttagggttttacttctttggctttgtctcctattaacatgctgatgcttcagaaaagtaacacattaagtatgctcagttacttatatattagtaaaactgtgttcataaaatctttctctgagattggttttggaagggaaggacaaggactagttgaggggactgggtggccaaaaggtaagagagcatgaaacaaaaaagtgagcacagaaggaggatgggggaactggctgcaaaccgtgcctagcttctttacatctgggacacggaccatcatccctggcacttatcttcccaagaaaatgtatgaaaaggaagggttaactctgtctacattttcctcttgctgaatgggtaataatatctttcacagttaatttcatttttttttcagtttgactcttcagggcttattcatttgcataatatggaatcttgaacccacatagatattctacaaatcaatgcaagtaattctcacactaaatcagcagctttaatttaagctcaacattgtttgcatagaaatctttatgcactcatctgcttgattttttaaatcacttaaaacctccaacactgacacactaagcatctcccatttagctttctccaaaatttgaactaaatgctgaaaaataagcacagtactatacattcatacacttgatcatttcccaaattgagcttcaaatgtgtgcttaatgtttcaagtggctcctgagaatgatgcttcttgactaaagatgacaacttcggtgtctggcccaggcagagctgagtcagcattctaaacagtgaccctgcaaacctgaggtaattgggggttactgccataccaactgcctgagtcctttaaaaccattcaaatctccagctgagagttgcaacatgctaatctggcaagataatctcttcctgaaattgaccagaatgagaacaaaggttacctccttttatctgttactggtagctaatatttctaattaggatttctgatggaattagttctgaatgaacatcttcctccttggtagaatactctacctcttacaggtatagttttttaccttttcctacccaccaaaaaaacaaaaaacaaaaaacaaaacgcaaaaaacaaattccctccacctaacaagagggtaggagtgtgagttacaagtaaaccctggagacagagccatggtatttcagttatatgcctagtacttcttttgcctttatatgcatcacttttactttccgatccctaaatggacactaaaacctaaggaatgcaattattagaaagcaggccatgtgaaagacaggagatatactcactcagatttactgagaaattattttttaactttaagatagatgtcaacaaaacatccaatattttagagtgagatgacctttatttctacttctgggaactgctaaagagagttccaacttcaaatgaagaagaaaaggaaaagggagagccataacatggtaagagaacaggcccaagcatcagacagctagtgtccaactccagttctaccattcattagctgagcgacacctatgctgcggcttctagtgatcacacctagccctgggttgttctgaggattatgtgagttaatatgagcagcacacagaggaagctctcaatacaagttaactatcatcaaagaaaaagaaaatagaggggtgttagcatgaagtataatcaatttattttaaatagatgctgtcaaaattccttaattttgcatctaagaatggtctaaataagacgtgtccaatcttttggcttccctgggacacactggaagaaggagaactgtcttgggccacacataaaatacactcaacactaatgatacatgatgagctgaaacaagaaaaatagcaaaaaacaaaaaacaaacaaacaaaaacaaaaacaaaaaacctttgtgttggtccgcattcaacacgcaagaggcctgctggccatgggttggacaagcttggaataatcttcgggccacagaggatggagaccctctgctctggagtagccagggacttcagacagactatttagactcactttttcaccaaaggccctacacacatcagctgactgggagagaatatctttgtagcttctgatcattcaaatattgtcaaaaccaacctaaatatgttcaaaataagaatgttaacttgtattttttccaagtatggaaatgaacagtactcttggcagttaacttctgtttttatcaggttctaaagacccaggtaaataaatcaattctggactctgtatacaggaactattatttgccaaaatggccccagaggttccagcatggcttaggcaatactccaaagggccaaagatagtagtgaattaataggattaggaagctggagaaaaagtgaatctcaagtttcagactgtccctgatggaaggtcactccacaattcctcagggagggcttccccaacctcccgaccaggttaaatctgcccattagacactctggtgtatgaaatactttccttcacgagcagtgggttatctgttactaactgatcagtgccattcttcctaccagatgacgtgcttcatgagaccaggggccaggactgggtttgctccccattagcactgtggtcacttaacactatgcctgccatgtaagagatactcagtatatatttgtttaatgaatgaatgaggcatctgcctctaagcaacagtatttctggacacttggcccattttgcactatccacgagcttctgttgcttagaagaatacaggataggaaaaaaagaaaaattgccaaaaatctatggatactgaaatactaaggaaagatgctgagcatgtacattcactttgtttcctacttgtggaatggaaatcatcacattgggatctcccaactttaaaatccgaagtgaaggtctaagctgtctttgggttagactcctggaaagtcttgaggaaattcctgaagtatctgcagaaagtgacaggggagggagaatagaagatggcccaagactagagtgatggaagacttggaaactcgaaaagctttcttctaactaactgggactttgtctacatgccagctacaggctcaggcacacatgaagagaataatgagatgaatgggaggactggaaagtggaggatttaaatgcttaggaaaggagccaatgaaagctgacacaaggacaggagggacctagcaaccaagcgccggctctcatcacatcagcagcagcatgtcctacagccttcaggaaaagaacaaaaaggtcagggaggaaaatgacacatctcagaaccaaagggcaattcattatgaggctaaggaacaaaggagaagtcaaccagggaatatgctgaagaaacggtgattatgaagtcactggggaagactgagaggcattttggctgtagttccaatgactagaatgaaggatgatgtgaaatgcttttggattgggaagatttattattttggaaaaaaaatagctcaaggaaaaacaaatggcaaaattcctgcctgaattttgaagtagtgtcactagcaggatgaggttcaatttatacattctttagaaatgaaatggcccttggaaaagacatagtggtaagattcgcaggacatttccagccttacggaagctgagtagcatgctgatagtaaaattaagtttcagttttagatagactgacatttgaaattaacaaaaaaaaaagtaaagggaaaaaattaaaagaccctgaactgacaaaaaaaaagaaaaaaaaaagcaactactgtcttttttttttaaattaaatgtcatcacaaacaaaaaaaaaaaggtgaaagttgagttgtattttgggcaatcttactgagtttacaaaatgtttagttcatagcaggtttcagtttggacatgaacagtttgtaaatatttacataaaatttaaagataggaggacagcagaggtcatatattgctattaacaatacagaagcgattttccgtcattcccaaggccttggtgctgcgttcccatatgtggccccagctctgccaaaagcttgtcttcttttccaaagaaattccaatttttgcaaccagcattgacttctgaactgtgagtacctctgacagggtcatatgtcgctgaaacttcttcaacatccagacagggaaaggagaaaaacagggaggcagatttacagcgtctgctatctgaattgcagattttgacaaatatgttacattttatattgttctctgttctatgtgagggcagggaccatgttctctgtatgtcacagtcctacaccatgcccagtcattgattcaggactggactgtgtaatggaatggggaaataaccttcagacattcaagaaaacatgcactatattcagattaagttcattccaacatgagattagttcttccaactctgcagaatgggcaggcacgacacctacttcaaagggttgctttgaggaatcaatgaagtacattcaggcaaggtagtcagcactgggtctggcacatggtgcggattcagtaaatcaaaactattattttggtgagtgttctcaaatgtcaaactcccatggaggtcctcaggcattacccagccaagttaccccatctggtcagtaacaactaaatagagggcaggtggttcaaaagtaatggattattcacctgcaaggaatcacactgtactcatggtattaaattattcggcctttcatgtcgaattctctgttaaaaaggaagctgatcaatccctgagtgggactcaatgttgatttgaagttttgtttttttggcatctttctattttccaggtagttgtaaccattcattgggtgcatactcacaaatcatccactatatgccaggcctttagaaaacagagacacacaaagatattaaacaaaaaaagatgtttcagtctgttcagtagtgggagacaagcagcccccaggccgacactagctcttacatatgctttcatccaaaaattttttaaagatttgagccaatatttaaaaatcaggaaattccacataaatatccaatattcagcttcccctggaaaaatcaaatgatgtggcaacacaaagccagtagtcctaccaactgttccctagcaagagtctacaatgagttgagtaggggcggcctgccactccacactatgccctgctcctcaccagaaccaggtaagtacataatttgcagggctcagtgaaaaatgaaaacgaggggccctttgttcaaaaattattaagaatttccgaagaaaacagcagaaccttataccaaatatgaggtccttctgagcagggaagaggaagggggcctatgtaactgcacaggtcttatgcccatgaagctagtactggctctcaccccctggacacacaggaagatatttatttatctaagtattctctcattcattaacaatcaagcctgcatttacaataagctagatgtcacacccctgaaatctgaggttcaaaaactagagtagaggggccaggcacagcagagatagagagccactagggtctctttcctttttgttaagactggatccacaccagagacactgaaagttaatccaagtaaaattaaactgctctcaacaatacagattggcttgagcccttttgttggcatcacaggagcctcgattaggaattctgagaaacagctcacaagcgctaatgaataactaagtcctgtcggctgtgcagacagtgggcccagaagtgaagggctggcctaggagagatctgaacatgaacctgaccatctggccctctgtgactcactttgatcacaaaatgaattgcaacaaattgaagagcacatggctagagttaattgtctcatctgtaatctgaatctacttttaagcagttattattaccctctatcaggtggaaacatttcctaccatcactgcaaagtgcattttcctgatgaactataatggatcattaaattccatatctgaataacaatactgtgcacttattcagtgcctttcatccagggatttcaaggcagtttgcaaataattaagccccttacacagcagccagaggtgagctactggaaaagaattgcctgaagatactaagtcaaagggcataattcaataggaaaataataaatggctttctcccaggcactggtaatacagaaagtgaatcctgatcccctccctctctttcacctcaccccttcttcttcatagcagatcctgacatgcaacatacaaagaaccaaaaaagtaactaacaggagtgttcacaatttagctatgagttcagacacacacttaactgagaagtgtgtgtctccatgtaatcctggcaaacacactaccaactgacatttcagtccacctgcagaatagacagacagcagaagaatttactcaacacattcatgattaccaaatggcaaacctgaagcctcctgcaatgcaaaacgaaaatacggctctgcaccaataaagttatgttctaacaaaaatactttattccatggttgtgtgttccatttctgggacttcgctctatttcaatgatattcaggtttcgagagtaaaaaaaacgttggaaatgggcaatcaataaatttctttcaaaaaccagaatactagaagggaaaacatttcagccactcaaagttttgtggtgaaattataaactccagaaaaactgaatttataatggaaatgctgacagacctttcagtggagcagtttgaacgcaacactgtaatttggcaatctctcttacagactaaagactaattctaacaagatgtcattttgactcacgtttattattacctgcaagaatgaaaaacgccgtttactcgggaggtgcccgagaaccagggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactaggcaggaaaggatttttatctaaagtaattaccctttttagttaaatacactcaacagatgaaatttacagagagtgagagactgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggctcccttcccgcgccgtttccccacgcctccccgcccgccccgcgcgcccgctccccccgcaaacttgccccgccaccccgcccagcggcggggcccggggcccggggcccgggactcacctcgccggagaactttgcgtccttttccgcctcctcttccccgcgtcttcccggctcgcagccccctcccggcagccggcgaggtgggcagttcgtgggtcaccgaaagctcgcggaggggacgcgcatcacatggcagctcgttcccagccccccgagtgcgccgggaagggggaggggaaggggcgaggggaggccggggggaaagcgagagcggggcggcggcgggagtgggcaggcggggtggcgagggcggcggccgctcacgttagcgctgtgcgaccgcagcccgggcgtgcacggccgctgctgccgctgctgctgctgctgctgctgctgaggcggcggcggctcggcgctgtttgctccgcgccgcgcggcttgcgctctccccggaacgcccacactctcaatcgctacattgttgac

SEQ ID NO: 1541 - DNA, 370316 bp, Homo sapiens
tcagtttacaatgcataatgatatgtctttatttcatcaacagaaatggtgtctagacaaaattcagttaacactagcaattcaattgagtgaaaactttttttgcacaatagtgtatttacaatgagtaaatgaagtttcaattcattagttcatagcaatgcttttttcccccaaaaggtaaaaattcttagttacagagaataagcatcaacagcctttcattttttacaataaaaaccacgagaaaaaccacaatcacttagaaaaaaataaggacaagcctaagaactagtacaataaaatgatgcattgaattaaattacattaatcgcatagaatctgtgtaaaaagtatgtagaaaaacacctgatgtaacctgttacagtcgttgaccagttatgagaggtacagagggttatacaggtagatatgtgtgaaaactgtccgtattgttcaacctggggaggaagagaagaggggctgcagccccttgcatacactgagaagaccctgttttgaatatggcctctggagtttgtaaggcatatattagaggtgcacttgcatcagactggttctggaacaaattgtcaaattgtcacaggctctcttggcctcactagcaaaggtggtgcttgccttgaatggctcactgtgtctaacaagcacctgaagctcccaaatgcatatggaatcttcctgatcactcactagaggtgccatgtctttatgtcagagcgtgaaacgggcatcccaggatttgcacacacaaaatacattgttaggacttaaggggaggtcatagttctgcctccaaacatgttttggtagaagactgagcatccatctgtaggaaaacccctctttgtccaagtcccttcactctttcgcaacatatgcgtctgattattcccatgggagcacttggcactgaatgtgagtctacctgaaatgaatggtcttggtgcacacttctgcttctaagaagggccagtgttttatctgaggtcaataaactggaatgagaatgaaagtcagagctgtttatccattgcttgacagcaaaatgcatacaccgtgtcacaacattaaatcaaagctatgaaagttggcctctgcaaccaagtgggtattcttcacaaaatggcagcatcgttttcatattacatttaaaatgcactgatattcatttgatagaaatatcatctcccagggtggagtgtaggaaaatactataaacttttctttgcaagtaatgtttttgcaccgtcagttgaataatttatgctcaatctgccacaatgagacttttctatgtacaaatgctatttgcacacactatttgtgtacagatatgttctgttctacagcatcggttttggacgctggggtcatgagatggctcaggcagtactataaacatacactttcaacacacaatgcctcgtgcacacagatttcctgtatgaataccaactccacacagggcattgtattgtggactgactcaccagaaattgcacttccaacacagtcttcagtttggggaagaaacactaactcatgatacaacgaacagctttattcttagaaaacaaaaacaaaaacaaaaaacaccttgttctttagtctatttacagtcatttgaggaccaaacttgattcttgctccttctggatctgagactcctcctaaactgtaagcaatagtgaagcagtttgaagtcatttctaagacagctcctagtttaaatggggcataatgtagagaagtaggtagccaaatagggacttgagaaagctttgcaggcagctcttcctcattttgagaggattatgctactccacaggatgtcaagcagcttcacgggacaggagtttttggtgtcttaacaggcttatcattttcaaacctttgtctgttccttctttttcttcttctttgatggcaatcataaaatattaaaagagaaaatgtgggtttaggcctcttgacaacagcattaaacttcacactgtgcacacttcactttagccagtcctctcatgagtcttgtcgctggtcctggctccttttgaaggagtagtggcagttggcatactaatcactagacttttgttcccttccttggaaaagcaatgtaaggattacatcccgaattatagtgcatcttaaaagcagcaaacctttagaaagacagttaataaattactcgcacaacattcagttgcagacacacagagtcaggttttccactgcagcatcatctctgatgcctgagtcattgctgggaactcagaagataaatagcaggatggcctcgtaactttgtcggtttttttttttttaaagtttttctaactgttttgttccagaatcagtatgtaataaagttcgattttaatcaaggcacccccaggtaacgcagagaaacaaacacatacagcaaatcactcacctgtccaaagcctgaccaacttgaaaagaggttgcctggatacacaagcaggacaaaggcagatccaaggggaggactggatttaggtgggatgttcattagtctcagggtcactcacctccactggctctgccccaacaaccattcctaccccagccatttggagacccaagcaggcatcctcctaaacagcccgtggttggagggtctcttatttttgtaagaaaagagccttaagaacaaccaaatgttactgtactgtgcaaacactcttccttgctgttcactcacttttctttttcctaaaaggcgtggggttgacagagggatcccagggaaaagagacaggctaggttttaaaattccacttgaggccgtttggattctggtccccagcaagtcctccctttgaatcaacccagaaataattttgacaagcacatagttctgaataggaaaagacacacacacatcacatgaacaactgcacgaagctagtcactgttcatggtggattatgaatgaaataacttgtgagaaatctctatgaaattggaagatggtttttagagcagtgtttttaaccagttcccatggcagaagttaggttgggggaagaggaagaaaagcaaggcaggggtgggtgggaggaaggtgaggtctgagttagggtggagagaaataaagaggccccgcccctgctagaaatggctgccaaacaggtctgggctactgaaccacagaaacctgaggaaatggatggaatgtggtcaagactaccagttgcacatgagttgttaccagggtaaacctcatgccaagaagctgggttggacctggttatgatatgagcagaaagtgttctttttttaaaagaagaggagaggtcacttggaaaggcaacaatagagttaaaaagcaaaatactgtcagctgactccactgtaacacacgcctgcgaagtatcacgtgattcacattgagtttatattctcactgtcaccagttttccacaaaggcaaacctcatggtgaagcacagaactgtcctagtaggccaagaaattccaacaaccataacaaaaaccagcagctccaacacagagctttatcaagatctgtttcagacacacacacacacacacacacacacacacacacacacacacacacacacaaacaagaaaaaacaaaaacccagaggcaggttttaaaagtggaactgtttaaaaagaaaagccttttttttttttttttttttttttttatcctactgcatgaactgacaaatttctggcattcatacatatttaaacatttagtgctaatatttgtacagaaaaaagttaataatactaaaacatatgttactatgatttcacttttagcctacatcatatactaatttccccttttacatgcagctttaatattgtccaaacaatggcacaaataaagaaacaaagtcaaccatctattccccactgcccaccaccccatccccacatcaaaccgttcaggactctcttccccagccgggctggagtggccctcgggctgctcagtgagacccggacccaaggccactggagcgagggagctgattcctcctcctctggggcacaccttcctgtaaacgtggctggggccaacacggccccagagccaagggaagctgctctctctgggttgcaagccaaccagttttgcagcaagaagagaaaattatcatcaggtgagggtagggtatgtgtgtgattcgggaaggggacagggagggttcccggtgatagcttgtccaaagcctcagaatgaagtctgccttcagacaagacactggcagaaaaacctcagaagaaaactccaagcctttggagaaggaaaggagaaagaatgtgtcagcctgtgtcagggatggatcgcagatgccaggatgccctgctctctcccaatggggtgaaggcaggaccttcggggctgtgattcaaatcccctcaggccagatgtcctgggaggccaagcctgggcaggaaagccagtggctggttggccccgtccttcaggggagcaggtcctactgcacaacacttccaagagcaagccgaggcctcaggacgtgttgaaatgaatgggacttactccctgggtgaaaactttctaacttgatttctaggagccaatgcctgctgagttctggtataaaatcacggattcctgtttttctgatgtacttttgagtgagatgtccaaactctctccccacttaggaatctgaacatccagcatcaactctgaactctctatctgcgtttaaactttgcttagggaaaggtggggaggaggtgaaatataaaaatattcaagcagattattgtctacacatcctaggatgaattcattatttggcaagattgtttttcctacataattatcacctgagtgctttttaattagctaaaatgttttacttttttaactaaaagcaaagaatatacagtatacttgagttataccgaagttacaacttcatttaagaaaataggtttgacccaaaactcagtgcaagtggcaaagttgaccattactgtacagtatctgcaaggaaaacaaaaacaaaaacaaaaacaaacaaaaccccccaaacaaacaaaaaacaaacctacaatgctcaaatgacaccacttggaggtgccaaaaccaaaccaaacgaaaaagaaatctgaaataaaaccttgggaaaaagcttccaacactgaattttgtccataaataagtacgaattgaaaattgaactgtgaagcaagaaaaatgaccatgttaacagttaccaaactagttctagcatcagagacaaaagaagaggaatgttggaacctgtttctaaatgagaaataagtttccagttttaggatgagaaagttgaggcatgcaggacttttgcatatggatatatatatatatatatatatattttatatatatattatatataatatgtacagtctagctataaaactttgatgtgtatagaagctgtcttcaatgaaaaaaattgaacattcagaagaaattcctgagatagggtttgtgacatgggccactgagaaaaaaaatccgtggttggggcctagaggtgttgtagtctatccctgtgaagactgaaattgagccacagacagacagtgtcatcactgctgtctttccttgcctgggcaaggggtagcaccattgtgaaggtaactatcactcctgctcgagaagaggagaggatacttcggaacagtattgctgctaagaccgctgtagtgtgcaccaaatgtgttctcggtttcttcgggacagcagatgaacagtgccacaggctgactgaagaacgcctggatgggagaggtgtgcggactgggaggcagagccgagtcactaggtataatctttcctgggctgttcgtcagttgtacacttatcagtcatttcctggcagaagtccacggtcactgtttggctcctgggttcaagaggaggtcctctctctgagaaggttcccgggtcagtgccttctagtctcctcccagaggtacaattctcggaggtgttgctgggtgcccaggggggtccggggggagccgcgcctggctccaagcagcagggcacgttttcccccactgcgcattgggaggccgcaatgttctgctcagcacccaagggcgcagggttaatactggaggccgtgggcaagtccatgggtctgaggacagggcaataccgatgcagggcctggatctgctcggggctctggatgtctcggcaaacttcctgggaaaggcaggagaagttgtccaacagttcccccatgcatgctttcagttgattcctctctgacaacagtttctctttctcacacacctggacagtagagaaaaaaagagaagggttgatcaagcctgaactggaggacagaaggcctcgtttcaggttttccagcctttgttttgcatcctccattataatgtaactcaagaatgactaggtcaggctctagaaacttaaagatacatattcagggggcccagacacaggcttctgccacaccttccatctgatgccaacaccttccccaggacatctcttcatccctctccaaggcccgggcaaacaaccggcaaaatcgtcacgaatcagaaaacttcagagtccatgttttggtttcctggaatttggggtttgtagagagttaaatgaaaaactctcagtcccaatcttgtgactgaaaatctcccccaaatgtatcaggttgccatttttgaaaggcaaaaatctaccattccaaccgtatgacatttcgaaaaaagcaaaactatggaagcagtaaaaagatctgtggttgttaggggtaaaaggggttgaacaggtggagcacagaggatttgggggcagtgaagccactctgtatgacactatactggtggatccatgtcattatacatttgtccaaaaccatagaacgtgcaacaccgagagtgaactctaatgcaaactatggacttgggtgataatgatgtgtcagtgtaggttcattgactaacacatgtaccactttgtgggggatgctgacagtgggggaggctgtgtgtgtgggaacaggaccatatggaaactctctgtatagtgtgttcagttttgctgtgaacctaaaactgctcctaaaaaagtaagtcaggctgggtgcagtggctcccacctataatcccaacactatggaaggccaagttgtgcggatcgcttgagctcaggagtttgagaccagcttggggaacatggcaaaaccccttctctacaaaaaatacaaaaattagccaggtgtggtggcacacgcctgtagtttcagcttcttgggaggctgaggtgggaggatcacttgtgcccgggtggtggaagctgcagtgagcgagatggtgccacagcactcaccctgggtgatacagtgagaccctgtctccccgcaccaaaaaaaagtttattaaaaaaaaagacaaaaaaaaagtcatcaacaatttcctgtcgttgcctaacatacggagtttcatatagaacccagtatcagcaggctctctggccttggtagcagagcagactgaacaggagggaccctccctaggacagctgggaaaagtgcagtctggagcagcgattctccccgacttgggaagggagaagtaaggatggagcctgaacccttgagtactagcccaaggttctgagatgttcttctccttaaacaaaatcctacacatgctcctgtgttactgaaattcaccatcccaatagagaggtgacttcagcagcagactggagactaattaaggttttaccatcaacatttgtgagaagggggctgggcatggtgggtcatgcctgtaatcccagcactttgcggctgagatgggcagatcacttgaggtcaggagttcgagaccagcctggccaacatggtgaaaccctgtctttactaaaaatacaaaaaattagctgggtgtgttggtgcgtgcttataatcccagctacttaggcggctgggacatgagaattgcttgaatccgggaggtggaggttgcagtgagccgagattgcaccactgcactccagtctgggcgacagagcgagactttgtctcaaaaaaaagaaaaaaaaattgcgtgagggtgaggggaggagatggggttccatgaggcacacacaatgaagtggatgaagaaaaggggcatctgaagcagcatgaagtcagttctcaccaaccctttgcaagcgcaggcaggagaagaggacgggagagaaaatgaagaggagaaagggaggagcaggcatgcgacacgcacaaggaacaggtctccgacacgggagctgcatgtgccgtaacatgaatgcaatctggcaggcggcgtgggcatgtgtgtcggaaagagagatttacaccgggaaagggcacctcctaaaatatttataaatttatcaagaaaatatgttttaaaaatgaaaaataaacagatgtacaagtgcaacttgagagaaatacattatgcgagtttgcaacagctgagtggcgggtgtgtgggagacggcgtgggagtggggagtgagtgcagggcctgctggggaccgggcagggcagggagggacttggggagaggtggaagctgctccgcccaccagcgccatccctgtcaggacatagcatcctcaccacagggtggcagataagaaacaaaacacatctgggatgtctccttagggaaaaaacttatatgggtggctgtgcaacctggagctctccccttttagtacagaaatctgcaatgtgaggggcaatactgcttgggcgctgggagaggaaccccaggatcattctgccacattaccccggccaaagcacggacccctccaggcctactcatctgttaaatgttccaggccactttctagggggaagaaaatgaggtgccgcgtgtgacagcagcaggggaaggcattgcaaatcatgccttggttaaaaccatgaagctctcagtcacagacgtacactgatgaatgtgttcttattcggcactgaaacacaacgtgttatttaaggggatgccaaaaagtggttggagaactagatgatgctctaatttggttttttggttgaaaaatgctagcaaagcgctttagatatctgcctggtctgtggcttggaatttatttgttcagtatcacaaaattacactaagcagaatgcaaattaccaaaaccaggcatttctcaaatgtgggtgactgaagttattttactaccttaagaggagtgcagggcactatagacatgtgcctaggcccctgtagactcacacccagtggacttaactacctaagcccagcaggctttcagaagacccacactcaccagcaggaatgtcgtctccttatgtgatttaaattaaattttgttgtttaacgacattaaacatgttaaagcaatatttgaaagaaagaagaaactcataatcccctgaactgaatagtcacaatgtccagcgaattttagggcaatagacattttctgggcgccagcaatgggtccaacactggatattcagagatgatcaagtcactgtccttgtccttgaggaactgacagttgagggctggggagacagacaaatgtatagataactcaagagtaagtgataagcactaagccagaggtcagatcaggcttccacaggcaggtgcccagcctaactggggactcaggaaaggggcttcctagagaggtgatgcataacctgactcattcattcatttagagatggggtcttgctatattgcccaggctagtctcaaacttgtggcctcaagtgatcctcctgcctcagcctcccaaagtactgcgattacaggtgtgagccatggtgcccagccatgacctgactcttaaagaacaaaggagatagaaaaagtggaggaatgtccaaggcagagaggaagtggcataggcacaagtgcagagtttgattttatcagggatcaagtcctaggaagggagtggatggtgacactggagaggtagctacagactggaacacaaatggcaggagatatcctactaagaagcttggactttctttgttggtgatgggagctgctaaacacagacattttccctggtggtgagtgtcaaagaaacccacaaaacaacaacaacaacaataacaaaaaaccctgacgtccagggctatcttgataacatataacatcctgtgcttttctaacatttcatccttgtgctttcgttctcattagctggtggctcaccatgaggccaggaggtgctgcaaacagtctgaggagccacacttagatcatgaccataccatgtggcctccctcttcttcagcctgacacagacatggcacctgagatgagtttctgttatttggtggcagaaaggtggagctgaaggaggttgagttggttgtcttcaaagctacagtcaggagccagaggtcacctggatttactttctgtagtttatggttgcttatcaaggagaaggggcgggggcacatagctctgagtatgggggagcctgggagacgggagtttgttttctgtgacaaaacactctcaggcacagggatggcgatgacagccaccttgaggcagaactgcaaaagaaaggaccctgggcctgcaaagaatgtcaggagatcatctcctgagcaatggcccctctgcaggtaggcgtcctatctctattccattctcttctgccaggaggcaggagaaagcagtggtacaagacacgatttggaatcagacacctgggtttgcattcaagttctaccaagtactgggaagttttccagcccttctgcagttccctcctctgtaaatggggataaaggagtgcctgagtcatagcgttcatgtgaggattaaatgggatcatccataaaaacagtttagaagaatacctggaccatagatgctcataatcaacatcagttatttattcatttttttttgagacagggtttcactctatcacccaggctggaatgcagtggcgtgatctccactcactgcaaccttcacttcccctgctcaagtgattatcctgcctcagcctcccgaatagctgggactacaggcacgtgctgccatgcccggctaattttttgtatctttagtagagacagggtttctccatgttggtcaggctggtttcaaactcctgacctcaagtgatccacccgccttggcctttcaaagtgctaggattacaggcgtgagccaccacatctggccaacatcagttattttcacatgttggatggaaaataaaaaataactacctctatatgaataatgactgaaggatataaaatattgacacactattacacacctgcgcgcatgcatgcgcgtgcagacacacaaacacacacacacacacgcacagatgtaaagctattatttctgttgagaaacttcttaaaaaataaacccaaacttccgcaaagggtgacccttctgtctacttttccaactttcattgctgttactttacattagtcctggtcacttcaggttgctgatcacaatggatgggtcaactcaccaatttgcggatttcacattctaaattctgaatacagtccagtttccttttgcggcagcgctgggccgcgatgcggttcttgctgcgccgtcggacatcatgaataaactctaactgttctgaggttagcttgtgcattttaatcatcatctggaaatcgttccttggaagatctgtgatttgatctacaggaaaaggaagttttacctgaaaccaagaataacagaaaatgattatggcagctggattttaattctggcaggcggaacatcaaaaatgataaaacctcctttttatgatgaccaagtaatatggaaactactgaaagcaagcagtgattacttatttcctgtttaaagacagataagatgtaataatacctggataatcaaacagaataagaacacatatattgcaatgttattgtctctgagatttttgaagcaaatgacatgaacaatattggaaaatgtgtcatttttcattgatgtagcacttttgtaagaaagattctagttagttgaaatgtacttccataagacctacagcctaactcaataaaatgacaagttatagggagataccacataaggacatatctaaagcccctgaatgaagagagccccatgtatcctgaaaatgctggagacacaaaaaacccagtgtgattcttagttacaatagcatatgggagataggaggagataacttggataggcttcactagcatatagtaggagtcaaaagaaccgggctttcatccttctcaccagacatgagacctcaggctagctactccacctctctgagattcaatttcctcatctgaaaaatagggcattttaaaaaagccgtacagtgctatacaagtgttgggcactttgggaatttattttccaattttacaatgaaatgttgacattcctttatcaaaaggtgagatgcatttttcctgccttttgaccaacagaatgcagcagtagtaatggtgtatagtttctgaggctaggtcgaaaattagctgccatgcctcgaggacattcaagcagctctgtggagaggcccatgtggagaggggctgatgcctctagtcaacaaccagcatcaccttgccagtcatgtgaacaagccaccctggaaagattctctagccccagtcaaaccttcagttgagtgtagccccagccaacatctgacttcaccttatgagagatcttcagcccaaactgctcagatgggcaactcctgaattcctgactcacattcacatttctcatagaaactgtaagaggtgttaagtgattactattgttttaggtcattaagttttggggtgatttattatgcaacaatagacattggatgcaggtacttgccagcaaaattccaaatcttgacaaattccaattcttgacaaatcaaggcaaataagcattatctaaagcgaggacagcagtctcctgaaggatgggtttgtatccttactatgttgttaaatgattgcttatatttcttttttttttttttttttttttttttgagacagggtcttgctctgttactcaggctggagtggagtgttatgatcacagctcactgtagccttaacctcctgggctcaagcaatcctcttgccttggcctcccaagtagctgggacaaccctgcccagttaattaaattttttttttttttttttttttgtagagatgaggtcttgcgccacagagaaggggaaaaaaagagatgaagtctcacaatgttgcccaggctggtttcaaactcctgggctcaagtgattctccctactcagcctcccaaagtgttggtattacaggtgggagccactattcctggcctgaaatatttcttttcttttttcttttgagatggagtctcggtctgtcacccaggctggagtagagtggcacgattttgactcacggcaaactccacctccctggttcaagcgattctcctgcctcacctcctgagtagctgggattgcaggtgtgcaccaccatgcccagctaatttttgtattttcagtagagatgcggttttgccatgttggccaggctggtcttgaactcctggtctcaagtgatccgcccgccttggcctcccaaaatgctgggcttacaggggtgaaccatggtgcctggcctgaaatatttcttaagaatagcaaccagtgaaaaagactgcatgaaagagccccaagtgcggaaggtgagcagcaaaccactactctatctcaagagcctccttggcacccatgaggtgacacaggcttgcacctttgagcagtttgtcactccccttcccgaggctcttggggattcagcagcttctgggttcagtctggtcctgcttcagaagctcctggaataaaaaggttgtgtgctgccaggctaagagacaacgtgtgggttagctcagattgcttcattcttgtttacattcacgtctgctccggatgagccagcagatggcactacaaacctaaacttccttcaagcactagcccagccctgtctaatacaaacaatacgagctacatttgtgattttaaattttccagcagctacattaaaagaagtaaaaagaaacaggtgaaatgagtttgaatactgtatgttatttaacccaatagataaaaatacttccaacatatagctaatataattattaatgagatagtttacagttttttttttttttgtgctaaactttccaaatccaaagcacattttatccttacagcacatcataattcagactagccactttcaggggctcaacagccacgtgcagcatgaggcaaatggactggacagtgccactctaggagacagaataaatggactcaatgaatcccagcagccagaaaaacatatgggtctgggctgaactgatcaaaatgctcttgggtgaagaaaccaacccctcgatagtgttcagatgctgcagggttaagtctgtgttcttcaagggagtgaggatgaagacatttgatcctgagcccaggtttctctttggttacatcatttgcaggcagacacgagtcccggctgccggcatgtgtggctagtcaattcccgtgcacaaaggcaaatgtacaaaatgatcatttgacttttctgtggttgggtgcaagctctttgtcaggttccatcacagctccgagcttgtgcagtgtggcatttactgaaggttcccagcaggtgatctgattcaacttctacctggtgagctctgtcccatgacacctgtaaaattttggtccaagaaagcaaaatcgcagtagggcccatgacaccactgtcggcttggccctgctccgactgctaaagacaggcagccaggacaaacagttccttgttatgggctcgggaaaggcctttgtgcacggggctgtgtttgcacagggcttctaatgatatgaaagaatgtttgatttccctcttatacccgttggataacaaacacactcagatcctgcacggtgtctccggaacacagaggtctgtctgttggagatgtggatgttccaacacagcagaggtggtggcgctttgggggcttgtggagttttccctctgatgacaacaaagccattctgcttctgctctaaatgtgtttacttactctcagaaagaagatatccctatagttcaggccacagggaaagtcaaaaggatgtctataccaagagctactgtatttaaatcatccagacagtgaatataaaacactaggggaataggagggagagttgccaagaaaaagaaaaaaatcaccaatgctagtttcaaagtccttgagacaaaaagccatacaacacttcagcagagctgctgcaacacaatctgctttttaaagagggtcagaggaaaaggtaatgggtcaactatagactttctcccaggtgaaaaaaaccccaactcactcttgtttctctttacaagtcttggttccccctctagcaagggaggacttatgttcactgacatgcgggggtctctgaggtgttctcagacaggcaccgggtcggggtgggtgggaacttgaccacatccaagttgtttcttgagtaataagttccaagccaagaacatcttgtctggaaataaggagtagccactgactgtttggtcccgtggaggacatgcctctcccaggctctcggcactcaaaacattcctcaaatggggctgaggagtcagagaaggccaacagaccttggaaagcggaaacacatcaagaaggttgaggcccacctcttttccttctagataattattctgagccaaacaggcccagttgggcttaacatcttattaactgtccctccacacacttgctcctccaggatctcacttcccagcagtggcttggtttcctaaagagtcccaacagccaatgtgatgaggtgaagagtcctgtggactgtcgccatccccactagttatactcagccacccacacacagctccggacacacaggctgcatataaggggaagggcacgagggattcatgggcgccactctttagccaggggtctaccactttggttctcagtggagaatcggagaatcagggcagccactgagtcagcaggccaagggccaaacagggcaccagaggcctgtgccacagttggcacaataagctgctgttgattttattcagcccagcaaagtgttgactcttccccctctggaacacgacaggagcagcaggaccgaggtgggtttttagcacggtacctgccctgtcctgctaagcacggctataggagggttagttcttctggagattccagctttacacattttttttcttttaaagacagggtctcgctctgttgcctaggctggtctcaaactcctggcctcaagctatcttccttccttggcctcccaaactgttgggattataggagtgagccaccacgcctggctaggctccagctcctgagcagtcagtaaaatggatagtccctgcagtgtgtccagggattcttaggtccaggtgtgacatctggacagtgcatggaacctacatatgtctccttgcatgctgtctgcaccaacgaggcagaggggaggctgtaggctgggccctggaatgccggtgcttccttctcaccaaacagaaatcggctgctttatttctcttccctgccaacagccacgaccattcttcagcctaaaccatcatccccttcctcccagttaaaaggaaacattgaaaaattatataagtattatataattatagattattctgtaagtattatataaaaattacatattatataaatatagctttcataaaatataagacaaaagaagggaaaaaaaattctcatccccaaatgatgactctcttgctctggtagatttccccgtgatctttgttttctctgcatcttttttaggagttgcaatcaagtggtgctgtatctatctcacccaacaaacatttcgcttgcctagtgtctctgctttgctgggtgaagtttactggaaaagcaggaaagtagctgcaaattttgcagaaaaagccagaaacaaatatttcctgtagaaatctcagtggaagactagtttgttaatattttttcctacttcatttcttggttttattaccagatgttgattgaaacccatgggagtagggtcacattagcatgataccctgagacactgatggtgtggtcagctctccgaagtctttaacgcctgtactctgaggagaccctcagatcccagggagctgtcgagggaggaagcaatatgcccattggagatgattccagtgctgctggaaccaggacagccagctcagtgctgggcagatggcaatgacaaaatctcccctcccaggtgaagaaatgtttctcgcgcaattgtccttccacgccctcttctcatggtccagtttctagcacaaatatgggacacctgggattcagttgtgatacgtcaattaattagttgtgtgatctcaggcaagtcttcattctgtctgtcccaaagttcttggaggatctaggagtcacagggcgataacgcctgccctacttagcttacagggttgctatgaagaatacaactggatgacaggtggagaaagtgcctgggaaagtttcaactgcctgatagatacaaggtattattatttctgtttattagccctatctatctctgtcacatggtttcgtcttacagacatgtgctttggaattccagacacttacaatgttctagacaacataaaaacactgttttaattagaaatatggctgatttctatgctgcccagcaaggtttctttttattaagcagaccaattacagacacttctaaaaacttgcctgattcaccaaaccacaaaaatgattgtgaaaattttacatacaacatgtgtctcaaagtcagcattggggtgggaagagttagagtcagatggctcttctattctgtaccatttccatgttttctctggactttatctctctcttcccttctctctctctctctcccgccccctgcctgcccccaacacactctcttactctcatacacttttatctctctcagtgtaaaacatgttaataaagcaagtccaaaaatccatacttttgactgtgcaaagaaactctctgtggtgcttctttactaaaatctacaattaagtagaaatggtccagttacaaagctgtcttactaagaggcttactactttggaaaatgactgtaattttctataatttccaacatctaaaaacaaacctataaaccataatgagataaaccataactactcacacccactagagggcactaacaaaaaagatgggcaataacaagtgttggcgaggatgcagagaaactggatccttgatacactgctggtgggaatttgaaatggtatagccactttggaaacagtctagtagctcctcaaaaggttaaatacaaagttatatgatttagcagttccactcctaggaatattatggaaataactgaaaacatgtcttaaaaacaacttgtactcaaatgctcacagcagcattatttataatagccccaaagtggaaacaacccacatggccctcaaccaatgaacaacaaaatgtggtattagtcaacaaaatggatcaacattatggaatattactcaggaattaaaagcaacaaagtactaatacatgacaatatacctggtgagtacatcaatggcaagggtaaaccttcaaagcattatgctaaagtgaaaggagctagacacagaaggccacatcttgcaagattctatttatacaaatgccccaaacaagtacatctacagagatagaaggtagattactggttgcctggggctgaggggagtgggcaatgaggagtaactgctaataggtacagcatttccttttagggtggtgaaaatgttttagaattacatagtggtgatggttgtacaacattgtggatatatcaacaaccactgaattgttcatcttagtagggtggattttatgatatgggaattatgtcttaatttaaaaaataaacctgtgcaagatagacatacataaaattcaaacattacagacatacatagaaatgaaactttccctacactcctctccaacggtgctcccagttttttcttattctctatgctgattttatttatatggtgtgtatatttaggaaacaaactaggaccttgtgcatactgctttgtgattttcacttatgtgacttgttcatttttttttactggaagagaaaaattcccaacctgacttcttaaggaatatagcaaatccagaagtcataaagaaaaagacttataccttgactacataaaactaatatttttttatatgggaaaaggtacaataaataaagaagcagactaagggaatatctaagcaacatttatgagaaagggttaatattcctaatattagggattaagattcctacatgttgatttaaagttaaacaatacaaaagaaaaataggcaaagaggtaaaccagcaattcacaggaaaggaaatataaatgttcaatacacataaaacaagatgtcagcctcattagtagtcaccatttttttgcccatcaaattggcaaaaattaaaaagactggtgacaactagtatgggcaagaataggggaaattggacactctaagttgctgatgaatatgtgaattgctacaacattttgggtaggtcattaggtagtatttaataaatgggcacaacctttagcccatctttgaaactaacccacaaaaataaatgcaccactactaacagtagggtcacaaaatgtttattgcagcaatgtttatcagagggaaaaactgaaaacaactgaaatgtctggtgataagtgacagctgaatgaactacgatttacgagaacgagagatattggagaaacatgtcttggccctgtgtgatcgacctacagccacgtgcatggtagacagctacgtgaaaaaaggaagctgctaactctacaacataatgccattaaaataaaacccaaacccatagagaggtgaatatatatttgtatattgttgtaggcaaagagaaagcctgttaaatttggtatgtttggggctgggtatgctgtgttctagaatttaaaaaagaatgtcattttaaaaagctgattattgataaaggataatactgcgctaatttgatctttctcgaagccagggaacagttaaaaaggatgggagaagccaacgactgtgagatggaagggctgcttaacacggtataactacaacatcttacagaatacaaggtatgttaacacttcacttttggtctaacgttttggctccctacggggtggaggaagacagattgggaaaacacacgcgaagtattacactggcgtctggcaaggggtggaaactcctgtcttgatttctgactctggtgtctccgtggggttcacttgaaagagaaggcacctggatcccatatgaaagcagggcagggcagaattagcccaatagatgctggcttcttctggatcagttcaggaaaacaagttttgacttgtggagaaggatctgccttgagcactattactggggataatacttcaaccagggtcaaagtaactccctaaagcaggttatcaactcctcgagcagcagtcatggcaagtccctgagacagttcttggaaacctaacctcctctactctaggaaaactaagatgtcaaattgggaaaaaccttaactttactgtaactgtcctgtccaaactgtaccactgagaggggctatgttttccaaaatggcatagagctttggtaaatgtctcttctttcactgttcaggaatgcagaagatggatttttctttctttttttttttttgagacagagtctcgctctgtcacccaggcaggagtgcagcggcgcgatctcggctcactgcaagctccgcctcccgggctcacgccattctcctgcctcagcctcctgagtagctgggactacaggcgcccaccacgacgcccagctaatttttttttttgtattttttagtagagacggggtttcaccgtgttagccaggatggtctcgatctcccgaccttgtgattcgcccgcctcggcctcccaaagtgctggcattacaggtgtgagccaccgcgcccagccatggattccttttttaaaggtaaaaataagagtatttttaaaagtagcggtatttctcaaggggggaaggctagtcctgttcatgactattttacaggttgaatgagtcctccttttaattgagttaatatttttagttctaaagtaaacaactgacatggtcccaacatacacacaaaaaatgtgttcttgctgtggccccaagactttaagctctcttttgggatattggcggcgagggtggggggacacaaaagaagatgtatctgaaactgacagttctttgaacatatgcaaatgtcataaaaacaccaccctcccttgagcttaatggccagccttttatttttttttgagacagggtctcactttgtcaccgaggctggagtgcagtgccaccatctcagctcactgcaacctccttctcctgggctcaagtgatcctcccacctcagtcccacaggtagctgggactactggcacgagccaccacgcctggctatttttttatatttttggtagagatggggtttcaccatgttgcccaggctggtcttgaaatcctgagctcaagtgatccacccacctcggcctcccaaaatgctaggattacaggcctgagccaccatgcccggccccaggctcctcttaaaggagagacaaaaaacaaagactgcaggcctttgtgctcttctccctccaccagtccttggtaggaagccatgatgcggatgaggtggacgcagtgacttgccttccacatcaggcacgctcattcacggtttcagaacaaaaggaaaacctcacaaaagaggtcagagggaaagaatgagtgaggagagagaaaacacagcctttcactattttcgggaaagctcaatcttcccaatgtcagggacacagatgtgagcctggcttggggcactgggcacaacccaccaccccaaacctaaggggaggtggtatattcgcatgggaatagctcccattcatatttcctttctaatttattttaaattaaatccttgcagtgtttctctttctccatgtctgctaggcagttaagagaggggcagaaaccaggctagcaagcaaagaaagtgaccacagggcatttttgcagttggcacaggggcctttggcatctattttcaaaacacgcccaaactaaaacctcatgtgcttctcgccaatcttgcagaggctgaataaactgcacgtggctctgtgaaaagccacctcatcccgtatggcatttctgctttctggctgggttaacatctctgccttacagaggctggtaacatccagagagcacagatgggtaccaaggttgccggcctcaggaggaccatgtttcatttcttcctgtgtttttgggatacacagctctgagaagggacttgtcactgggtttgttcaatcccgctcctgaggggggtctgagacacaggtagcagtctcaagctggtaccttgtcaatcagcaagacagtgcagtgaacgccaggtcacgacacagactctctcaggtctttctagggaatgttcatgttattggggaggtgggtcctctgcaggggcctcttctttcctctccttagtcttgtgagtcttgctcacgatgtggctgctgttgcccctgttcccctcttccagcaatggtaagacacacatggagcctctggacatttttcctagcaagtacattgctttcagggtggatgaaactgctactctaccccactacttctcaaaatgtcttcctagcatttgagggagcttgggaaatgatccattatacattatgtgtggctgactagggtgcttctgtgatgaccccaggaccgggataaacggtgaggcttccatcaccttcactgtgatggacatgggatggccctggggtcttctgttgacaaggaaaatctaaaaggtgctgggagagtgttgatctatttggtttcaatcaatcaatctggaaagagattctatatcttcctttacgctgaacgggtgaagggcaaggatgagggtgatgaacatggcatcctttcaaagcaggtgtaggagggggagagagggaggagaaagaggggggtctggagtgcctcagtgtacttcatgcattagacttcagtatatttttactcagcagcttgcctctgcttgtcgagtattgagatccagatcaaatatcaagtgcttttctaggacagaagtggttaatgtggaatcaccttcagcatcctgcctctgtggatggggaaggcagtctctctactgtcatctttaatcttagcacgtaagaacaatgtgggagtggtggggggcagggagtagtccagataaagggcctagagagtgggtcacatgcttgaatttatgtgggttccctacctcctggcccctgtcctgcacaggacacgactcactgtctgcttccgagaacgatccggattcgtcactggagttggttccataagactgctcacatttaatttggggccgcacttggttgtacattccatctcccatcaggcctggttcctgatgttctgtggcaaggaatctggctccctgggaacagggcgaggaggagaactcacagagagggaggctgcagggtgagcccccgctcccgtcctccgcgtaggaataggaagagcaggagctggaagtcctggtcctggtctccaaggggggtgagcgagggcagactttgattggtaccgggcagctggtgttgggccgcatccttcctggcaagtggtcggccatcagcccaccgtgggagtaggcctgcgagctggggagggactggccggctcccacccacagaccctttggcaccggctcagagaggtctttgtccaaactgctcaccccagaataagaatgcaccgaggtgctcacttggtcacaagcgctggaggagaagatcacgctcctccggtccagctctccctcctgtttacagagagcctccaacccaggccccctgaggggcgaccccatggtgaagttggacacctccttctggcccacgtggggctgtccataattccctgtgaaaggggtgtagtcagttttaaggtcaccctgagtgatccccttgtcaaaagggcaggctggactcctggcaaagtgctgctgagatgtactgggcaggccagacagctccacacttttcgttatgctgaacagagaccttaagcaggagggcgaggccacgctcctggatctctccaggcaggcggccccagctggggccgtgggggtaggggcagggctgggctgtttccggtccatctcgacatcccccgctctgtccttggcgtcaggctcatctccagacaggcagagcgtgatgctctcttcctcattctcttcactgggcggctcacttttaatctgccccctggcaagccccggcttgaggctgttgctagagttatcttcccggaatgtgcttgcaaaacctgaggtactgtgtgatgatgcattatagacattcttggtacatgcaagctggtatttcttgtatctggggtactgcgttaacgcgtccttttctgagctctccttggtgtctgtgggcacgtcaggctcgggcagcagggcttcttccttctctgctacggggatggcggcggcctcaaagctgatgggctctggaagcatctggtccctggggcaagccatcttggccgtctctgaatccatcgtctcctcctcttcatcctcctcctctcctgcagagttctcgcagtcctcgtgtgggcgctggcacgcagcatccttccggcacacaaacaggccatcctcactgttcaggagctgggtctgcaggaagctgaagcaggagtcctccaggttgtgcatgcgcaggaactcagcacagcggatgacctcgcggatgttttctctgctgagtaacagcttggcagtgtaggcaaactgtaacagcggcccaaagcccctggctgtgacctgcaaaacaaacagggaaatcgccaacattaccatcagcactgctattgtcccgaatccctcaactgaagcaagataaccagacagtgctaatgtcccagaataaagactgcaaaggggcagttaatcttgtagtactgggtcagcaatgattctgcttccaataattagtgcctgtctcgtgcatgccactgttgtactccatcacagcacaggcagaattgaaaatcaccagggtcaagtggctaaacaagatgacaacgggttcagtgtttacactaatgaaatatcctggcaaaaatgcacggtgacaatggggagcctattaatttccctcccaatcagtcctgttgagagccattctacacgaggggggagtgttgtgacacttcttgcagcttgctggagcccaagagagccttaacgttttcttgtcaaccacaaaaatggcaatgtgaccctgcaaaaaactaactccagggagttgtaaaaataggttttcctcacttacaatgttaaaagagacattaaaacaactcctgttttgctcatccatcacagtttctacttgagactttcggtcatcatgtctacctgatcttatgatgatgatgatctcattatctcaccagagatgacaacaatcaaaagtggtgtgctcaagatgaaatcaacccctggcccataatgaatgggggttgcagagttaaacaaaccggctctcatttaaatggttgaagctgctgagtggcacagggtatgggctattccttccctaattattagcagcagctttgccatgcagctgtctttttttcctggtaaatcttcaggggctaagcctactgtcatttgctgcttatctgttatattttacaaagattgaaagtgtgctatttatgcacagcttgcatatgcacacaaacacgtgtgtgcccacacgcatgcctgctcacacacaatgacttagacaattaagaatatgttgcctaaggccaattgttttttcagatggaaatggattaaacttgctggtgttcatcagggtaagcttccttaccctgcacataaaaccacacatcctctaggttcttgcaagcactgctgaccacacaggaaggtgacgcatgtctacaaatcctgtacaaatcaaatgaaagcagcaatcatggggtccttgctagaggctatggtagcagtgatacaaaattttagcggggggagtgagtgcacagcaaggtgaactggtaaactttgtagctgacttctgtgtgtattaaactcaccgcagcatacagagccaaaattcttgcaaggacctgtaattgatgttcaagattcaacctggacattcactcctttgggagtgctctccagtcctcttagagagaatgaatgacattgtcctctcagctctcatagccagatgaggagacgtgctggattctccagggcagcactgatttcatatcattgcattctttccagtaacggaaatttcttagacatgtaactgaacgggattttaattgttaatctttttaaagtactcaagtaagattccacattaaatttttctgtcagatgatgagtccagagatatttggttaaaaaaacaaaacaaaaagccatgactgctagacccacattataaattctatatgggcaatcagtgccatctcccttttattatacctaattgtgcctgtttctaccataagacagcaagctccttcagatcaggaatggttttgtctgtctttgtaaccttgcatctaatctaacctggggtctctcacatggtaaatacttgttaaaagcttgtatgttaccaaatatgtcatgagtcaaactgtgtcctaacatactactactgtgtatgcaaggtgacaacacagtatgtttagagagtgttgtctcaagttacttttggagcaaggcatcatgtaaaccaactaactgaaccgatcaactgatcaaaggcaggcaggcaagggtctttgtttgccccgtgtcacagtaccagtattaaaaaggaggtctgaccgacacttttgtatcctgctaagctgacatggtaataggttcagcaaatgtagtactgacaatacatctgttttatgtccttttcttccaagaatctttaaaagaaagtaaaaaagcaaggaaatgtgtatttataggtaactgaagaagatgacaagaatgtcacatgacctattcctttactgccacatggctccaccacaaagaaagaaatggtgaaatcaatgcagagttgacccctgccctcgtaatgatcctatgctcctctgtaatgtgccagttgccaaaagggtggataagacacttcttgagttttggcaaaggtgctcactatatgggaaatgtaggaaactaatttcaatgctatttatactgttcacacagtttttctttttttttttattattattatgctttaagttttagggtacatgtgcataatgtgcaggttacatatgtacacatgtgtcatgctggtgtgctgcacccattaactagtcatttagcattaggtatatctcctaatgctatccctcccccctccccccaccccacaacagtccccagagtgttcacacagtttttctcatactcccatccttatcaccattttttttttttttgatgctgtaggtctaagtaagtcttaccactatcttccactgtggcctcttgtaaagaaaatttctaaagaagccagggacatccatggggatctgtagatcaggaagcagtactgggagtcaccctctgccacatggctgcaaggagctggagaaagcatctccgctcagggacgagctgatgcttaaatgtatgaattggaccaaggaggtgaatgagcaaagtctccacatcacaaatcaatggcactccttagatcactgaggcttaggaaacttcctgagcttgaaatgatcgtcatatggtcatgaaagagtcatagataaaaaatctggtttgtaaactgtcacttaagcccaagggcagaggaaatggtgtcctcaccatgaaagttcaagagctcataactagctcttctcccattctggtttcagtcctgctttgtcatatttaagtctgcaagattttgctcagcttctgtgtgtgaggctttgtttggtgagccagaatgaccatttaccaagtatctcctagtgcccagcactgtgctcttgtaacaccctgcaaggcaggcatgactgcccttattctgtagataaggaaactatgaagcagggaggtgaaggagtttatccatggtcagtgctagtcagtggagagctaggattccaaaccaagtccagtctgtttcttcttctgtgctagtggtgtgagggaaggatatgtgtaggactcaggcctgtgctcaagagatctaagatttagctttgtagaagaggtacaaatgatgaaaagttaactaagtaacaatgtaagcaagtcaacaatggaaaagccattgcaagattatatgagtagttgtcaactgagaaatccagacaagttcaggataggagactactgaggctgaggggactagcaagggggccccttgaacacttttatcagcacgccttgagtgtctgctctaggtcaagggttgctttgatacgatggctactttcggaactgtcacaagggtccctcccaggaacccatctctggtctactttcggcagtggtaatcgctccagatacacaaaacagaaagcaagtgcccatcacacctgccagcaagtgttacaacaggcagaggctttctaaatactggcttagcctccatcttgagaaggtggcactgtctacccatttttagggaccatttaaattcattcattatactcagaaggcaaatattcaggtaccagtgaaaagctgtatgttcatgaaactgtgaccacaagtctgcattgttacttactttttgttcttaacaaataaggctctaataatgggaaaaaataagaggggggtgggaggtggagaattacacgcaaaactaacaactcataaaatggtattttaaaaagtaatgatcataaagttaaaatggaatgaagtggctataaatagaagaatagttccaactcactgatgttaatggagttgcatccctctgctctaagcagacccatctagactaaaatccactggtcagcagtggcctcaaggtatgagaaacaaatgcaaaatatggtgttagggacaacttgggataacagtcttgcattttgaatgaaaatattttgaatgcctcatttcgaagaacattttttcattgcacttaaatatgtaactacctggtctcatactgtgcaatactcattctgatacagatgagatgggatcacacattggggccagaatacagtgtgccatgtgggggcgagacctcggagaaggcagaaagttaaccctccaacctcccacagactgcttcctaggaggtgatgacctcagctagcagttggcacatagttggttcaaccctgaaagaaataaggccagggtaccgtgtccgatggtgcaagtcaacatgctgacaatgtgttgaaatttgacccactgtaactatgacccttaatccttcattacattggattctaacatatcatctctctgctgaaaggaagatgggctgatgaaaactcaatttgtagagaaagtttgggcactgtttgcaaagctggggagctcagtgttttggggagctcagtgttttggggagctcagtgtttcatgagacatccattttgctgcaggacagagtttatgaggatacttacaacagttccatctctggactatgatagggatgaggcagtcagccttcaggcatttattgaaaatagggtttgaggatttttgagacttggaacatcattctctatataagctacatgactaaggtgtctccagttggttttggcagtatatacacatggctgtagcattgagcccatctgcagaaggctgatcagatgaatccggaggacaggtgactgctccctgggagagggctggcacgcttctcaaggtcccttaatcacaacttcacaaaaaagggaaacttacatcttcagcaacaccatgtacactttcctgatgaagctgaatctcttacacactgcaggaaccaggaagataaaggtaatgaacccctgcccaagggctttttaaaacgctagaccactgacaacccctctgggttgtatttgcacagcaaggcacttgtcaaatgatgaaagcaatgctggtgacaattaactctcccttcccactctcttactgcactgcaacccactctgcaggatgaaaactgacttagtgatcaggcatcactcctcatcttaattttctataattcatatccacattatcacattcttcttccaaagcagcatgctagacatttagaaagtatttgtcaaattaattcaccttactatttcaacaaagcttctggttattttagtattaatttttattttatctatttttacagacagggtctccctatgttgcccaggcttgtcttgaactcctgggctcaagggatcctcctgcctcagcctcccaaagtactagaattacaggtgtaagccaccacatctggcctcgtattaattttatttatttatttactgacagggtctcatactggttgtccaggctggagtgcagtggcatgatcttgccacttactgcagcctcaacctttggggctcaggtgattctcccaactcagcctcttgaatagctgggactatcggcatataccactatgcccagctaatttttgtatttttagtagagacggggtttcactatgttgcccaggtggtctcaaactcctggactcaagcaatccgtctattttgacctcccaaagtattgggattacaagtgttagccattgtgcctgggcaattttattatgaattttagatagagcttattttgtgttctattcctaaggtaataatataaaaactaaatcaacattgaaattgatttatacatatatcatttcatatggtggttcttttagctaaagaaaatcattatttgtcttagtgaatatgtcttaaaacataaacggagtgtcttttctctcctgtgcaggtttgaacttggatctgcagccataatgtaaaaatccttcccctatttgtaagttttactcctgagactctatctgatcattcagtcacttataatttttttgtttactaattttattttattttttagagatgaggtctcactatgttgtccaggctggcctcgaactcctgggctcaagccattttcctgcctcagcctctcaaagtgctgggattacaggcatgagccactgtgtccatccatactcattttttcattctccaacgatgtgctaggcactcactgtgtactatgcaaggtctggggactccactttcttggattcaagtctcagctctgctgtctaccagctgtgtcacttgggctggttacttaacctttctgtgctttagtttctctatgctttagtttctacaactgtaagacagggatactgacagtgcctgccttatagtaaaacctttggaacaggacctggcattaagtaacaaccagtattattgctgttgctacaaatatgaataaaacaccacctttttctccaaggagctaacaagtgactggggagacagatgttcaatataaatgtttacagtgtcacctgagtacgtaacagaggtatttgcaggatgctgggaggacagggctggagcagtaactgctaagggaattagtgtaaggctacttagaggaggtaacacttgccaagtgttgagggctgagttgaagttcttcagaataagtaaaagaaaggcatgtctcactccctcatcatcttccggcttttcctcaaacgccatttcctcactgagacctttcctggtcctctattcacaattgccctcccctaccacaaaaccagaactggctagatggtttgcagggcctagtgcaaaatgaaaatgttagcctcttgttcagagattaagaatttcaagtgacaagagaacattaaacaaagtgcaggacccctctgagcatggggccctgtgcaattagttgcacaggttttatgctcatgaagctggccctgtcaataacacatgcatgcacaagtgcacacacacacacacacacacacacacacacacacacacacacacacacagttacctattccctgcagttgaaatggactccctgatttgaggagggggtgatggcatcccagggtggaggtcaaacagtagaccaccatttgacttcaactttgggctgaaaaacatggtcagcccaccaaggtactttttgattagtaaaaaaaggaaaatcatgtaggctcagtgagcaaaggcctgactcgaatccccatgatagagagtcatgacttgaatcagttaacagactcagactccctgcaattattctcaggaattcttgaggacagaccctaccataacccacatttttgctatgatttctcctgtcacagggttttccgaaatgtacttgtagttttttcctaaatcatgactcaatacaaactttttaaattaaaaaacacctaaaaaaattattcagaaactgttgaggccagaaccaaaactattatcactctctctgtgcgtgtgtatctctgtaacactactttaatacaacttaactaccttaatacaaacataaccggaaaactgaaatagtccttaccaactactaattttgacttctattatttgactgaattttagtttgatgttgtaaactcatatgttggttatttactattgtctctcggactcacatccacttttctcatatttccctcttgctgaggctgggagttcaaaaactcttgtttcctaggctcttttgctggttaacttattatcggacctgccaacaggtgcacaggtgggtgagctcagaaggtgggaggcatgaagacgctgtggctccttctgtctcttgctctgtttatctttcctttcttggcggtgtgttctggaagtggctgcatccctgactctgtggtggagtgtccggaaggggctgtctgccccacagctgcagctcccgaggcacccgcccctccaccatgctcacaggtccctttcatcccctccagccctaggagtggtagatactttctgcggtcattaatcattaggttagctctccttcccttttctgttcttccagttttccaacacctgtgtaaccaatttcctgttttatagcccctctatttgaaacacctggcatggtttctagttccctgacttaacaatccaatttacagacaaggaggccaaggcccagaaaggtgaagggatttacccaaagtcacagggctgcctggccagggctaaactcatgtcttccgaccgcagagttcaactctcatgctccctttctacctgttgctgtttctctgaagtgaactaggaaagaaatgctatttcatatggaaacatgttattgtaaattttattactctctctaaaatattgttttatatagctctatccaaagaagtctggccaattggatgcagtacatcttttggtatgcagaaggtgaatctcataattggttctatttttccagtgtctgcattcctcctgaaggatgaagataactgctgtgtccctttcctgctcaatgaaactctgcaaatcctacgaagcccttttaccacatggggatttggtaaattatcaggcctagctaagtattggtccttagaatctagaagacaaagcagaaatgcccttctggcggggtgccacatggcaccagagctttgttccacagtggaatggcagtcggatgaagctgatgtctagggggagcgttacgtgtcccctctctgtgatagtcggctcagaatggttatggggctatataatggctgaaactgccccttaggtatttctttggttgtttcaaggttgatgggaacaggagaaggtcccaaaagcaaacattccatattgtctttcctgagaactggcgacaccttgggtatgtggaaccttcgtttcaactgggtggttttgcccatctcatctcacctccttcatatgtggcgctcataattttcccattcaggtatagatggttatatttcctaggttagtgacaggcaaaagtcatatatgatacagatacaaggaactatattcatatttaccctaaaagcatacggtgaaaacagaaaatctcccttctgaaagattataaaatgaagttcacagaataatttttaaaaatccaatttcaatataagtgtaggtcttaaaatagatatgaaatagtagtaatgtttcacgtttttcagtgtaaaataaaagtgaaaagcatcccactcactggtaatgaagtagtaaaacctgcatcaaggtttatggtttcattcgaaaaactgcctccaaaagaaaattatttttaaaaagaagatttagaaaaaattacctaatttccattttaaatgaccctcttcccattccagaaaccagtgattttcctaggcgagaatttcttgactcaaggtctggtttcaccctctcaacccctctagtcatttcaaaccaactatgaaccacttgatcttcaaccagaaaatacaaaacatttttgaaggcttccagtgatgagaagtttggcccctcattagcaccttctaatggttcttcatgttaagtttcaggaatggaagttttggcttagtcagttatgagttcttacacctttcttgttactctcctctgaaccacactgcctgcgactacacccctggcagatatctggattgaataaatgctccaatcattggtacagaggacacactatcacctctctctgtctatatcctattttctagaaatgctcagatttcactgtcacttattatttacaattaacatctctgagcttatttcctcccagtatctattgataagccatgtgtccattttaaccttgcaaaatcaaatttttgacccaagagtgtgtacttgtctagatactcagaaatcattcctattataaaaactactattcagtcaaatttttaaagatccactttcttctctttgttttgcaaattacgatgcaatttctgatctctagtcttttgacactttccttagctccacagtccctgaaagattttgaccatagcaagttgtatcataatcatattattccccctgcagtttgggggctttacttcatccagtctgggagcttagcattttctttttgttcatctacctagggcttcctttcccttttccaagttttttctcacttttcagtcttatggtcattcattcagtcattctccttgatgcacaatataaaattaactctgggctttttgccatcctcagtactacacagtcagccccaatgagcagctgttggttccctcatctttacgctccaaagagaaccacaaattcatttttgttttctgtggtcctcttcgaaaggtctccactcattttgggcttgagttttcttgaacgccttatttgtggttccatacatgttcccatagttgttcgtgtttttccagtgtttaaaataaaactctgaatgaaacacaactgctggcacaatttaccctcctttttcaagaaaagggtcctcatgtgaactttgttttggacacttctagccctcctgaatcatctttccccacagatgcataatttctacctttttcttgttaacataaaaatctgtttaaaaatgtcttgaacccaaaattataaaactctagaagaaaacatgggggaaaagcttcatgtcattggacttggtaatgagttcttggatatgacaccaaaagcacaagaaacaaaagcaaaaatgaacaaatgggactatatcaaacttaaaatctgattctatcaaaggatacaatcaaagtaaaaaggcaactcatggaatgggagggaatatttgtaaatcatatacctagtaaagggttgatatataaagaacccctatgtaaagaactctcatttaaagaactcctacaactcccaacagcaaaatataaaataacccaactaaaagtaggcaaaggacttgaatagacgtttctccaaagacatacaaatagccaacaaacatatgaaaagatgctcaacgtcactaattaacagagaaataaaaattaaaactacaatgagatctcaccttacacccactgggatgactactaccaaaaaaacagagtaacaagtgtcagcgaggccgtggagaaattgaaatccttgtgcactgttttattttttatttttcttgtttgtttttgtttttaagacagggtctcactctcacccaggctggagggcagtggcatgatcatagttcactgcaggctcaacttcccaggctcaagtgctcctcccatctcagtttcccaagtagctgggacaggaggcacataccgtcatgcccggttaatttcttatttttgtagagacagagtcttgccatgttgcccaggctggtcttgaactcctgggctcaagtgattctcctgcctcgttctcccaaagtgcaggaatgacaggtgtgagtcactgcatttggcccttgtgcattgttgaagagattgcaaaatagtgcagctgctatggaaaacagtatgaaggttccttaaaaaattacaaatagaactaccatatgatccagcaaacccagtttgggggatattttcaaaagaatccaaagcagggtcttaaagaggtgtttgtacactcatgttcacagcagcattattcacaatagccaagaagtgaaagcaacccaaatttccattcatgagtgactggatcaacaaaatgtggtagatacatacaatggactctcagccttaaaaggaagaaaatcctgtcacgtgttctaacatggatgaaccttgaggacattacgctaagtgaattaaactaatcataaaaagaaacttctgtgtgattccacttatatgaggcattgaaaagtagtcacattctcacatggacacaggaaggtgaatatcacactctggggactgttgtggggtgggaggagtggggagggatagcatcgggagatatacctaatgctagatgacgagttagtgggtgcagcgcaccagcatggcacatgcatacatatgtaactaacctgcacaatgtgcacacgtaccctaaaacttaaagtataattaaaaaaaaaaaaaaaaagaaaagtagtcacattcatagaaacagaaagtggaatggcgtttatcaggggctgggggaagaaaaagagggggagttgtttaatgagtacagagttttggattttccaagatgaaaaaactttggagatctgtttcacaacaatgtgaatacttaagagtattgaacttatttaacactactgaactgtacacataaacatgtatggtaaattttatgttattttttttaaaatcacaataaaaaaggtcttgaaatattttggaccgtacaaaatcttctttgacttcatgttctttaagatgatactgccgctttcttctaaagatcttctcatgtgtactcttattaattccttttagccagattacgacccgaatagcagttctacctttgcatcttctactttctggaaggtggaattgccaatgtggcaaatcaataaccactcaggtattcaactactggtcgaggagaattctggtagctatttgacctaattctgtacatgggaataggaacatggaacctttaattgtcctgacaataggacccataaactcctacaatatcaattttgctcctctctcttctaatctcctagtgctcttcagagggcccctgccctatgtttctagatttgcttacagaccttattagatgtaattcttttttttttgagatggagtctcactctgtcacccaggctgcaatgtagtggcacaatctcggctaactgcagcctccgcctccaggttcaagcgattctcgtgcctcaacctcccaagtagctgggattacaggcgtgtgccaccacacctggctaatttttttgtatttttagtagagaaggggtttcgccatgttggtcaggctagtctcgaactcctgacctcaagtaatccacccgcctgggccttctgaagtgctgggattacaggcataagccacagtgactggcctagatatacttttggctctgcttgtctttccagtggttacatttttattttgaatatggaattccttcccatagccatatttcactgtgatgtccttctgcttaccaggttacttgggttctctgagaaattctatttatcactgtggcaataatctccaagtccatttttacattactcctgcttcaaccatgaatagacattggagactgtaacttcttgatttatcccatgatttaccaaatattttactttcctaccaatatcaaacttgctgggttctgacctaattggtattatgagttaagcaagatattcttctctcttcctccccactccatcactttcaattgaaagcatgtgccttgtacaccctagagtctcaataactattagttgaactaaaccgagctagccctagtactgcccacttgggcaagcaatttgaatccctctttcacatgacaatccatcacatatttgaagacatctgtcatacctggttagggaattttttcttcaagaactgaagtcatattttccacctgaaatcagaactgaagaactgacagatcacacgtctcttatggaaaatattattttcttcttgcctctggaagcaagtagcttgacacaccactaatcctccaatagccttgagaacccaggtgctaccaggggaggcccactggtctttagcagggaaagcaatctgaccttgatacctgctgtcatttgtccctttcatttgcaaaataggaataaatagggacaagctgaagacatgtaggtagttaatatacttgaaaggcttttgagagaaaagtactaaaaattctgaagatgtatgtatcagcttctcaagcagagccctttccttggcaatagaaatggtgttactgtggcttacagaaggaataaagctacagagtatgccttatcagcatggttgatacagcagcaatgatagtatttctacagtctttagtctctttcatctaagtcctttaccaaccatcatgtaacaagctgagatatgctgactgggctactcaaagctgtacagtaagctgggataaaaatcatacatggaaaccagactttttgccaaagggacgatacacttctgatttctcctcccttcttgtgcttctgcaatgggctctgccaatggagaacagttaatgctgatgcaatgcaggcaccatctgtgctctgtgaggatttaaacagcagccattaacacaaaaccccatatgtgaattggacaatggctgccctgaagctacaggactctcagatagaacataccactctgtagcttttagggatgcagaaattgttatgatccaacacccacgcccctgaataagagcatgaagtcaggtttgtcagtcacccacttcccctccctgcttcttaactgagtttgaatcttttctatatgttattcctgtctgtcaagggaggaaatgaaacgggagccgataccatctatcagcacagccatgggtgccatttttacctgaagccattgggttcttgtcctgaagcttcccccaggacaccagggttccaggcatataaatgacattgacagtgactgggtgcaagcctttgctgggaagagcagtgtgtccaggacttcaggttgctggggcatgaaggcagggtcctatttatttttaatttttgtagagttaggggtctcactctgttgctcaggctggtcatgaacttctgggctcaagcaatcctccttccttggctttccaaagtgctaggattataggccggtagggtcctatttttgacaatggtgtcatctctggcagcagcagagatgctgaggcaggggagaaagaaatttctaacaatgactggttggttgtgtccagtttctgtggggctgaaacacgcttttcacaccaacacaggggatggtaagaaaaggaagtaagtcacaggtgcttcagaatggtaccttggaggctgttctgggccatctattttgaacatggcttgggactgttatgaaagacctcattatttatagctcgtaactgggaaaacaccttttctcctagaaataaagatatccaaacttcctgaaaatgaacctttggtttttgacaaataccaagtctcaagaacaccaggtgttctttttctgggtgaatcaaactatttctgagtttacctttaaggatgtgagttaaaacacctacagcatcccgggtgttccagtatttggatggaattttagtcaccgaggttgcaaatcagaaacctaagaaaccttaaggaaaaataagccctccagtttccttgcactattatagcaagaaatgtctggttcatggcagggaggattcatagagctcatccacagtagtttaatggcaccttcccagagaagcgtagctttgaaaacctcaactaagctagcaggtgtctggatggcatcgtcatttctttctttaacaagcgtgggaggccagggcttaagaatctctaggtagaggcaccattgtggtaaaaatacagagactcaaagcaaaagggaaaactaatactgcttttatatcccacttctgtgctcatgaactctcctctctgttgatgccatctctcctctctcctgcccctccatgatctctctggatagtcaatcaaagggaggctggagagtctctgagttaatgcttctgacatggactatgtttcaagcagcaactccctggtttagaaagcaaacctgattctctcctgcctggccttccaaatttcccccaaatctactcccttttcagtctcatctccagttatcctcttgatcctgactcctagccttttctttgacttactagcatttgcccaagccatgaccactgcctagatgcactgctgactctacttcaccaattccaactgtaaaattccaacatatgaaaactgtggaggacagggaagatggtatccaccaatgtggaatgaaagggccaggggaaaccctggcaaaggaggtggcaattaaactggaccctcccttctatgacctggacaatcagcacttgcttacagaccatcagtttgggcatttaatcacaggagggctgttttgcgttgttatctgaatattccactggacctgtcttgattagaaattcctcaaagtcaaggaccaagtcttacacttcttacatgtcctctgcataaattctaataaaatctgttaaaaatctgcattgtgatgaaagtgtatttttttaagaaggcaataacattacatgtttagaaagaattaacaaaagtccacgttttcatgctagttggatgacagtatttaagaaaagttaaattgataaaacatcattagatcacagaaaggctaaagccataagtattttgtgtacatatgaggcattttgcataaatgttactaaataatcaatgcaaaaaatttacttgagcattcactgtgctggatgctgaagtgaacttgaaagaagcaaaaaatgtagttttaaaaatctgtcttgggctgggcacagtggttcacgcctataatcccagcactttgggaggctgaggctggccgatcccttgaggtcaggaattccagaccagcctgaccaacatggtgaaatcccatctctactagaaatacaaacattagctgggtgtggtggcgtatgcctgtagtcccagctacttggggggctgaggcaggaagactgcttgaatctgggaggcggaggttgcagtaagctgagattgtgccactgcactccagcctgggtgacagaatgagactctgtctcgaaaaataataaaaaaagaatgtgtcttaaaaatgtagtctttttttttttttttttttttaggctgagtttcactcttgttgcccaggctggagtgcaatggtgcgatcttggctcaccgcaacctccgcctcctgggttcaagcgattctcctgcctcagcctcccgagtagctgggattacaggaatgtgtcaccacgcccagctaatttttttgtattttcagtagagatggggtttctccatgttggtcagctgatcttgaactcctgacctgaggtgatccgcccatctcggcctcccaaagtgctgggattacaggtgtgagccaccgtgcccagcaaaaatgtagtcttaagaaggtaagaattcctggaggaactcacaatgtatcacaatcaaataggagaataattgatgctgacctatccattgttgagactcctggtgcagcagaagatgagagacaagggacggatgtgggctgccaccactctaccactacgcttggatgggagcaggtgggggacagagagcgcagcaccaacaggagtcagcctttgtccttcaaatattgtgaccctgaccttggcagcctcatgctttctaggaaaggctctgccatatgcacctgggattaacacccttctctacctgagaaaccagtgccctccaccccacctaaatgaaacttcaaatggggctcataaaagggaatgacatgacaggaagagaaacgatctgttgggaagaggctgacagtgctcggaaaaccatggagcaaaacagatggaagaggacacatataccagtcctgctggaactgcaggatggtgagaaaagactgcaagctggcttggaaatgaaggctgggtgagttgagtgagcaaaactggttcatccttaacctgctaagttagagtaagagaattttagatggtgggggttgggggatgactgtcttttagatcagcttggaaaaaataaaaatcctcttctacactaaagtaggaaagaccacagagttagcaaagaaggcatttcagaaagtcaaatggggaaaaaagaagaatgttagataaataggtgaaattataaagtgtctaaaagcaactccaacaggagaaagaaggtgggcagggtcagagttcggaggatgtgaagggcaacagaggccctgtgaagtacaggccaccctcgtgaggagtaaggacagtgctgtcctgccacctcaaggtagggcctggcagtgccctgttcccagttctgtgccccgaagtgaagcgccgccgacaggctttgatgatctttccacctcctgactcttggcgggcagagcatacagtcacagaccagatattagaacactttatctagcatatggaaggaacagaatgtcaaaggggtttattactgtacctgaccagataatcaggtaattagcactattaacagaacagattggacacatttatacatgcatttgtatatctccggggaggcatagcttcaaaaaaacataatatcaggtgttttttattataatgtttgtgtgtatgtgtgtttttctaaagaacattttatttctcagaaaggataccaggcatgtttcttttctgcacctgtacggccctttttcacttagtcaagctggactgcaaacaatgaagaaggaaatttgtttctggccccccccagatcttacaacaagcactgccgagctggctggcttctttgttcatatgcccaggcccccacctgggtggtgcgcaattctaggaatatgctctggctgaaagacagaaaagaccaggagagggagcacaagaacacaagatatttctatatctgggtcgcagggaaagtcacagaaagagagcaaggcaaagagaagcaaatgcctcaaaaaatatatgcgggatcttaacggtgtattttttaggtgcaataaaaagggaatttggaacttatggtttgttcatcacatagaatacatttttagcaaattatatttaatgcagaataaaggctattttatttattagtttgtcctgaatgatatcattactttatgaactgccaaatctgtcagcaattattaacactccacagctagctgccttcccctaggtgtttcagttcacctttgccacacagtaacatgggaacaactgcgtcagacgacaagcatgcagccccaggcacagatcagtgagtttcagtgacactacagcacttagctggattaagtttataggctgagaacaaggtaatgacaccaggcattctcctccacaggaattcacaatatgggatgtcactggtgggcaccttttcaatataagatacaaatcaccttatccctttaacgaatgcatactgaccactttgcatggttctattgtgtcttaggtgctgggggcataaaacaatgaatatgaaggaaacggtacttggtctgagaggttctaggctattgggacagagacaagtcaacaggtaatcacaacacagccatgataagaactgtcagtacggttcttacttacagggtgtgtaagtccattttcatgctgctgataaagacatacctgagactgggtaatttataaagaaaaagaggtttaatggactcacagttccacatggctggggaggcctcagtcatggtggaagatgaaggaagagcaaagggacatcttacatggccgctggcaaagacagaatgagagccaagcgaacagggaaactccttataaaaccatcagatctcatgagacttattcactaccaggagaacagtatgggggaaaccgcccccgtgattcagtttatctcccaccgggtccctcccacaacacatgggaattatgggagctaaaattcaagatgagatgtgggtggggacacagccaaaccatgtcacaggggaagtacagctgctggcggaagggcatctaactgaggaggtgacaaatgagctgcagcctgagggaggattagttaggttttgggtgggagctggtgttccagatggaagaaatgaaatgtgcaaagacctaagagagaacatagcatgcagtgtggtgtggcaggagcagcagctggggcaagggcacaggtgaaactggagaagggagcaaggggacgggctgggaaggtccttccgtgtccgccgccgaggctggcccaggggcctcactggagtctgttgcgcaggagagtatgagggagactcctttggctgcatttggggaacaagccagacgggcggcaagccagtcacagaagtccaggcaagcaccactgtggccgggatacaggcagtggtgttgggaagggaaatatagacagatgagagaggccattaggaggaagagttggcgaagtctgagagtataggccaattcaagactgagaacgactaaaaaaagcatcatgttgcttctaactaaccaaagccacaacctggataccccattgacgaaaacaaggtatctttggaagctatttgggacgctttacagtgtgtaataggaattatgtacaggttcccaggcagacccaaggcagtttaggtttcagagtcataaattttggaggaggatagggctcagaattctgtagcctggggctttctttaaatggacacctttgatgtcagtctgttgtttcagtttctgcctaatgtaggatttttaaaaacagcacactttcccagtaagtcattctgatctggcaatgagaaagaggtgaaagttctcacaggatgtaaagggtctttaaaaaaaacgacgggctgggtgcagtggctcaagcctgtaatcccagcaccttggcagggtgaggtgggcagatcacgaggtcaggagttcgagaccagcctggctaacatggtgaaacccgtctctactaaaaatacaaaaaaattagctgggcatggtggcgggcacctgtaatctcagctactcgggagtctgaggcaggagaatcgcttgaaaccggaaggcagaggttgcagtgagctgagattgtgccactgcactccagcctgggcaacaagagcgaaattccatttcaaaacaacaacaacaacaaaaacaaagatggctgggcgtgttggcttgggcctgtaatcccaactactcagcaggctgagggaaggggatcgtttgagcccaagagttcaggaccagcctgggcaacactgagaccccatctctaaagaatgaaaataaaaaaataagaaaatataaaaaataaaggtgattggaaaatagatgagctagtataatgtgagatgatgctgcatacagccatggtcagaaacggggaaaaggcaggggaaagttgactttcctcccaggacctgtttgttgatttccatgataattgtggagcaacctaccaaacctaccagttctatgaccagggtctccacttggacctttagaagcttcttcaacacttgagtggacttcaaacttcaaagtggactttgtgattccgaccctcctgcctccctcttttaaggacccttgtaatcattcaggacactcccccacctcaagacccttaacttaatctcacccacaaagtcccttttgctatgtcacatgacacactcacaggtttttggggataaggacatgggtatctttgggggccagtatcctgcctgctataccgggttataaaatctgcctagctggttgcctagaggagtcttattctctcggtgtctcaaaatagaggagttccctggcaaaggtaggttcttatgtaagttaaagtgatgcaggcattaatgtcttcatgtgatcaactgacgtaaattgaggagagccattaatggataaagtgaaagaaaaatgatgaaaatttatttcagatttcagatttcagatattctctctgttatcactttacattgcaattttttttcagcatcctattatttcttgtgtaaaggcaaatttctagtgctgggttcatggtgacttctgtgtggtacagagaaacttgaactagagctggagatactcactgagtctccaaacctaccgctgactggtttgtgaccctggacctgtttcccacctgttaaaaacacagacatttgcatctttagtgagtcttactcttgtcattgaagcaaggagttgagaacttgggctctggagtcaggctgcctggccttaagtcctggctcctctgcttaggagctaaccttttggcaagttaattaacctctcctgctccagtttcctcacctgccatatggagataataatggtagcaatcccatagcgtcaatgagttaaacacgtaaagtgcacagggcagtgcctggcataccctggatgctcagtaaaggttatttaaaaaaatcatcatcatcatcactgtgttagacacaagggatatgcaaaagataaaacagagtccttttcttagtgctgggtcagataattttttaagactaaggttttacgattccccatatatcacgggagaaaaaacgccctgatgtcctcacacgttccatgcatcatgctgtgttagcaagatcttttaacatttctccttgctgccaattaaagggcaccaagtcaaagttgatacgtaaaaattactgtcccattagcaccttctggcctcgctaataaatcctaacttaattaggcatatgtatctttttcgtgggacaagggatagccaaaactagaggtatatgggctccagcttgtttacaaccgtcccttaaaagagctcaatgcataattgcatacccataaatacaaatgctataattttcttggatcaaagatcattttcaaaaagtagacacgtatgtatcttcatggtagcttttaaagcaagttctacaaggtctaacaagtcagttttgagagcaggccttccaatagctgtcctccacttgaaatctgaagtgcggaaagtggagtggatgcatgttttactgaaagagtcagcaacagaaaatagagtacactcacagctgtagcgagccaggatgaatttatacagtgaattttaaatcagactcaaaattggcttgcactatccattgaaaaaaatcccattgattttgggcttcatgatgatgttttctgggagaggcagaccttagattgagagccaagcaaagcttcagatgcagattttttcttttattttccaaggaatttgaagaggcagaaattgctaatggaatacagggataaaaatgaatattgtatttctacttgctagcaactatcttggtatggaactcgactgatactgttctgtcctagtggctgaagcctttcactttattaacttttttagatagactttaacaatttcatttttttctttgtctttttccattttctctcttctattcaaacacttctgcaaaatacagtgtttccattaaagtccctcagctttcttttgtttctcagactctcacatctttgcaattttgctcaagttaccttcatattcacttggcacacagtaggtactcaataaagttggtttcttccttcttcctctgcctggccgctgtctggtaatgtacttcttcctttattttttggtttacaaactacttgttaaataattggctccaagagcctccttcagagtttacatcatttcttgggaagctcagcccaaacagagataactctcctaagatatcctggaaataaggttgcagagaaaaacaaagtcccacttatcaaaatgaagtgcttttgttctcgttttggatctggtggcagaaacgaaataccatctttcagaggtcccaataaaatatttgacaagatatgtgaaatgtttttcttcacttggactgctttcttcataatacagtctatgtgtttcaggagaaaaacaaggtcaattcaattgatcaaacactgtgtcagcgacagacacacatacatataaatgctcacattctctcacagttataacaacatggaatctaatttagaaccacaagagctaggaaattaagagttaatacttaaaccccatcctgaatccatcttgtcatgcctgagtatcacttctcctatagcaagcaagatcgcccgctgttctgaggccactagacagagaataaaatcagctataacattactgtgtcacaaggagggaattagggatgagtctggagaactggcttgggtgctctttgtacgcaagagcgtgaagccggatgggagagaaagaaaggaagacaaaaataaagcgtaaaaatgcaggcacattagccgcaggcaagctcccgcttgccttctatcctattattaccatctcactactgccttagggggcatctgtaaggcaggggcaagctgctgctctcattacagtgggctactagcagtctaaactccaaaacaaacttgaaagatatatgaaccacaatgatcacagccgacaatatgctgtggccttatacttgctcctgcaattgtgtgtgtgggcaggaaaagggggtcttctcttttactcaactcaaatgtcccttgctttgcttattttagaaacggtttgaatgactgttccttcaacagcattatgggtcacgtacccactaaaacgaaacaatcacactttatgtctctatcctgaatcactgttttaatttttaacctaacctagcaggaaatcatgggtttagccctgtttgatcatataaaatctctattaccaaagagaaaaaactcatggtactagcccaaaggcaataacagattttaggagataattgtccagatacctcgttggctctggagcaggtaaaaaaaatcacacataaaatagcaaaaagcaaatttattaacttgcctgagctttttgcctcccttatctactacttcaccagaaaaaggtctgctcgctatttacaaattcacttttctttaaagcttcttcatatgactaggtcctgccgataagtaatactctcaatttgtcatttgtctgtaaacttttaatgttaatactttttcatttttgcaatttggcaaattttatcatgcagtgagaaattattatctagatgctatctgctaggatatacaatgaactttctccttatcctactgaaagtacacctctcaaaaagaatacaaaataagagcccttcttggatttatttgaaaaatgaatacatatattcattattgggacttttcaaatttatgaaaaaatatatatttgaacctaaagccatgtacagaaggttagctattatcttaatcctaaattctgctattatatttgtatcacagatgtactgtgctgatagagaagtctgagctattggatttgccagcttggattaataactacccatttcaaatcattaatgatgctggttccagttcagtgattgaactgggtaaaaaaacatttcatcttattctttccttatgaaagagctgctggctttgcaatccatttctttctgaagaaaagtccttttgaaagggagaatactaaaaacggtgtaagaaccactggagaagaatagaaattcattttaaagcagtgtaccatgtacaaatgctgtcttacaaataggattatttaatttaaaccttagatctgtcaagctctattacttcaaatggagcctatcgcttcttgagttcattatatatcgagattatattacaatttatgttaggttaagtcattgctgagatacaaggcggttgaaaaaaattacacagcagtgtcagtaaatagagcaaagtcactgcagtgttcagaaaggcaaaaagtcatcttgctaaatgaggatccaagctgtcctgtacgaagactgttactaataaataaaaggcctctgggaaaagtgctgagcgtacgctggatctattttcagcttgcatcagcagctgctgcccctgggatcacatctttacgcatactctacaccatatgtaatcactccagtgctgcaaccagtaagataatgaaagagcatggcataaatctatacttgagtggaatgctaaatgagaaaaataatacaaaaaggggggaaataaaccgcattttcaagtcattaggaagaaagactttgacatatgaagtgctgcaaccattaatagcacttatcatatagagtggagacaaagagacaaattaatcaaactgacagaactgggacattttatgctaatacaggctcctgggttttagtctgtattcctctgcgtctggaaaactgataccattacagggcaggaaattgcatgaataacatgcaacagatcataaaaattcacacaccaactgcagaaacactgccaaaagctctgtaaaaacaaggatggagacctcaacagagaaactaccagcaagtaatgaatgcaaataagtccaggaatatctcccattcatgcattgtaattaactataggcttctcgctcataattacagtggtgaaactgaagcctagagagcgaactctgcagttagccagagaaggctgctcaggctctgattcaaggctgtttgccatcagctggggtgagtgccactctgacctaaattttctgactgggttgtgttggctttaaaaaaaaaaaaaaaaaaaaaaaagcaaaataaacagcagaacattagcttaagactttaaagtggaggagggagagaaataaattgataatgcaaagaaaagttgaacaaaattttctatgtatgtttctgtgggtggtacaaataaagagaatctgagactgaaaacatttttataaaatgcacgctgtccctgacttataaacatcccctactttctgaataagctgtatgtacttaaatccgaatggcaggcaagtcctcatgaaagctcgtgggagcaactaccctttgttctccaattgtgaactccgagggggttggtggagaaagagccgctagctcatttataccaatctatagagataaattactgctgccttgtgatctctgcctttccctaaggaaagtgtatgtttccttgatactggaagcagatgggttccttagctggaacaccaaagagattttcccataaaaaataactgtatggacagaagtgtggatgaaaaaaacgcatcagaatttctttctccaatgataccatgtttgctggcattcaaggcttcagggcttagtgatctggtttcaatccttcctctcattctcacctaatacaaaccacatacttgcctgcctctagaactttgctaaatgatctctttcatttatttgacaaacattcaccaaatggctattgtgttggcctggatatatagggtagatttgtacaccgaaaacactcccctccaattcttgcacaaagaactaactgtccaaatgagaagacagataagcaataactcaatgacaatacagtgtaacagctgctatgacaaatatggagaaggtactacagacatacagcagagggacactaaaccccaaatggccatttcccatctactgaaattctacccacatctccctctccacgatgtagtccctcatcttctcattagaattacgtgttcctgctctgtaccttcatagcccttcacttatacctagaccataggattaatttctgtctctcattgatgataaatatctgttcattgaacaaaccgaaacaaaaaagaaatgctatacagatatgagtttgggagctgacttaggaaactaaccattactcataacctgtttctaggaaaaaatacattctgggttcaaactaatttctttacaaacttttgaaatgtaatttatccaaactgtttaatcttccttccttagacactgggctaccgaaaatgtaacctgcatttgcatgaaccaaatgcatgagataatggaaatgtttcaagtagtgcaaatatgaactgaagattcttcttacagtcatataacttgtgtattaaaaatatctgttttagaggccaggcgtggtggctcacacctttaatcccagcactttgggaggctgaggtaggcggatcacctgagaggtcaggagttcaagaccagcctggccaacatggtgaaaccccatctctacaaaaatacaaaaattagctgggcgtggtggtgtgcgcctgtaatcccagctactccggaggctgaagcaagagaattgcttgaacccaggaggcagaggttgcagtgagccgagatcgtgccactgcactccagcctgggtgacagagcaagactctgtctcaaaaaaaaaaaaaaatctgttttaggggacgatcctcatttcacatcatccttggtaaaatgaaaactgaaaagcacacctggacacacacatgagcatggggctctgtttggccatgtgctgctctgtacagaaaagtgcattataagtaagtgccctaggttaatctattgttatgattattgccattatgatgacaatcatcaagtgaggctgcccacagtggctggtccagggacatagctagaccacaagggctaatgttatgacctggtacagtgcctcagtggccaccatctagagggaggagaagggctaggtgtggtttttctttactgttttttggccctgaggacattcacctgagaagactttgggtctattaataacctaacagtggatctgcagaaccctgctggcctccactggaaggtgttgagtcttttctgaagtccatacacttcttatttcttaatatcataggattctgaaatgtattggtttctttctgtttatcttgtgtagttttagcatatttaccattttaaccttttgttctcatcacaatcaggtgtcatactattgactgtgtatggtgttaattttcagtttttttttttttaaccagtgaatggggttagaatgttcttcttccttgtgtattaaccacaaagagacgtttgaattaaagtttaaagatgacaaatggtctaaattctgattaggcttaattagatattggtattttgggaagaaaaaaaatataacccaaatgcaagatagacaatagttgttttagcttaaagatgataaaaactaatagggttcatcgtgattcgctttttttttttttttagacaaacagtctcgctctgtcgcccaggctggagtgcagtggcgtgatctcggctcactgcaagctccgcttcctgggttcaggtcattctcctgtctcagcctccccagtagccgggactacaggtgcccgccaccatgcctggctaattttttttttctttttgtatttttactatagacagggtttcaccgtgttagccaggatggtatcgatctcctgacctcgtgatttgcccgcctcggcctcccaaagtgctgggattacaggagtgagccaccgcgcctggccgattcctgttttaaacagagttaaagagagaacacattctcagtgagagaaagtattggggaatataatgacaaaaactgccaatcgatattcatgttccctgaattgacaagcatctatttgtctacagtttatggctccttatttaagcatattaaaactgagaaaaaaataaaaagatcagaaaagaggtcaaagttaagaaagtcttggagaaatggaattattagcgagaaaataattctagtggtaacattattttcaagtggattctctttaaaaatcctgggtctggggaacagcatgagaagttgacacacaggcaaagctttgagcctttcttgtaaggagttacctagaggaagcgtgtgatttgatacacctaaatcaatgcaatatattatttgacagagttatacggagctcctgataaccaactctgtgctataattacagagactgaagaaagggatatgggggtagggcaggaggggaagtgatgggtctgtgagatgcaggttgctagagatttctttcttttttttttggagacaaggtcttattctgtcgcccaggctggagtgtagtggggagaccactgctcactgcagcctttacctcacaggctcaagcaatcctcccacctcagcctcccaaagtgttgggattacaggtgtgagccactgtgcctggccaaaaagatatttcttaaggaaaggtgacaagtgctgcaggagaatttgtaagttcagggaggtcagctcatagagaaaagagtctaaaacagtgggcctgaggcaggtggtaaaatatagagcagggaagatgagagaagagagtgaagaggctacagtggcaagtgggaggtggtcttgggcacgtgggggtggggtagagaggtcactactgcatctaaaagggcagagatgggatggaaagacacaaggaacatcctggcagcacgcatactgaatcataacaaggtactagaaaaaggctgtggcatcagctttctcagagggtttttaatattaaaagagataaaagtctgatttggattgtttaggttctgttttggatgcagatagaatttgataagttatttttctttttctgaaaggcacatataagaattatattttaatatagctgtgctttttaggagtacgttcggatatcactccagcttgtgtgtaccataataaatatctgaacaatactttatggattataaaacacgattttcctattatttgttcctcccaacaactcggtaaatgaggtattatgattcttattctcattttctaggcaacggtgttttggagagtataagtaacttaatcaaggttacagagccatggcaagcagggccgggtcttgggttctgagcccctcattccaaattacgcacaatctcccccatatctcttcagccattctaacaaatgttttcttttccccattcctgcagaatgtttttcattttgatgattacccttaacatgtttcaaaaaagcataggcattggaagacccagaaacagagaccaagaaggcagggaccacaggacagaccctggccttgcccatcacccagtttcattggttccctttgccttgatttgaccccacctgcaggtgctgagagcttcagtttaaaatctgggaatatcctaaatgtttataggaaatccccatcctctgcctccttctttaagcaggtgccaaaattctcctgaaaggagtatatggatttgaataggacatcatccttgcttctgttttatagtgcttctttgtatttattcattccatcatatttattgagtacctactatgtgctcagctctgtgaaaaggcaggcatgacacttggaacttgtactccagtcctgcactgtccaatagggttgtcacatgttgtctaattaaaattaagtaaaatagccaggcgtggtggctcatgcctgtaattacagcactctgggaggcagaggcaggcagatcacctgaggtcaggagttcgagaccagcctggccaatgtggtgaaacgctgtctctactaaaaatacaaaaattagccgggtgtggtggcaggcatctgtagtcccagctactcgggaggctgaggcaggagaatcacttgaacccaggaggcagaggttgcggtgagccgagatcacgccattgcactccagcctgggtgacaagagtgaaactccgtccaaaaaataaataaataaaataaaaaagtcagttccttagtcacacacgtggctactggctaccatattggccagtgcagaagaacatttccatcatcacagaaaaggctacttagcggtattgaaacatgtaagagtaatcaaaatggaaaacatattctagcaggagtggggaaaagaaaatgtgttagagccactttgttagaatggttatacagttataggggataacacacatgcttatttcatggtcttattactccttgcttagtccgttgcaacaacctggctgttgtctctttcttccccgatccttcctttgtataggtgcctgactgaccttcctgatgacagtgactttatctctttgcttcttgcagaataaaacctaagcccttcaagcatggcattcaaggctcgtttaaatcaggctcaatggacctgtcctctctcccaccatgtcctctccataaactacaatttagtaacagaaagcggggttattaatatcaagcccactgccctccacatccattctgtaggagaatatctacaattacaagatgtccacaaaagtcaaacagacagaccttttaaataacttcattgaactgaaacacaagaaaagagaaaaggagggaagatatggtcacagagaaacgagaggattattgtaaattatctaaattagtcctaaacaagtaatgccacacaaagcactagtaagctagaatgtcattctctaccctcaccataaagagggctacagaaataggtgaggaggctggacagatgcttagggaatccaagcagaagagctaggatattttggaaaaaatatatcagataaccaagaataggtgagtgaaagaagcagacacaagtgtgttcatctacaggtactgaaccctaaaagcctattcctatattctatacacaatttaggataataggtgctcctgacaagatgccactgtggttttctttgagtagagattatacaaaacagacagggctggtggactgaaaaagtactgaattatggtttgtttcccaaactacaggtacttaggacccactgttagaattgtaatattttctctaattgcaactcattttcttctttaaatatagtttaaaaagaaacttgtcctaagcaatatctgcaaaatctcaagtttaacacacgaatcatactttctgcaatacatattaagataaacacaattattttgaaaaaaattctccatataccacctgaagtcatttcacttttaggttatgctgtacatattcctattctgggaaacactgggaacccaaacaattatcctggctgagtcctcgggcaggagacatttggccgtgcctttcctattttccagggataggactgtgagttacttccgtgtggtgggcggtgggtgcttgcaggggtgaagtactaacaggtagcaaagtgttggagacacgaagcattaatcatcagtcaacaacagcagtggcagcactgctatctttcctggggctagtgagaattaacggattaatgtttaggagagcacagaagtttccaagcatctactgtggttctcaatcctttgcagggaagtaaacaactgaggtggccacctgggattctcatctgctggcggggctggtgggagtctgggttttgtgggtggcctcagggggccctggcggcagcttccagcctctgtggtgacaggccatctcctctctgtctagttcacaactccagatgctgtggggaggtggcagcagtccagtgggggcgggacactaagattctcacattaacaatgcacagacatccgtccatccggcactcctgggtcatgtccctgagagtgacacagggctgcccctggggcagacacatgagatcatctgaactggttagctccagagggcctcagctgggcaggggctctgcagcttttgtcagaggctgtttccctgcaaaatggggggaaaatcggaatactcaaacaaaggggatttctgtaactcttctgccatttttctctcaccttttctgtgtagctgagctcttaggaaactggtgttaaagcagttcagtgagaagcaaggcaactgaaagccccttccaacagctgccaatggttgtggacgagcaggcagacaccagggctaggaggaagggagccaacaatcactccacagtggcatttttcaggactcagtcatttctgatgctggaaagaagcttgagaaaccaaagtacagctgtgggaagacagtgtggggctggagggatgcgggtgtgggctgctgcccacgtgctccctggccctgttatagccggacttgtaaggctttcttaagccttgcatctgagaaaggcagagaccagagaatggaaagacaaagctggggagactgatagtggcggcggcgaactgaactcagccccctgcctgtggaggggatgggctgttagtgcctgggccatggatgggggagctctgtaaggatggcttttttcggtatgtgtgttaaagtctgagttttttttttttttttcctgtggggtttacaagctcattccattgtccagaatccttgtgggcatatttctcctagggacgctggccctggatcgctggccttgcctgaaagaggctgcctcctactgcgtttttgttcaacttgctttctctgtaatagagatttgcagcactgtgggcttcagggattcaaagtttttgttttttccctaatatccagcttccatttctggtttttaataatatcccaatcttttcagccattctcccaagaattgtagtgaatgatttttttaaagttttcttttaatttttataatgaatacacataatggagcattcttttctctgacattttccctgtcactaaatttgaatgtttaggtggcacttaaaaaacctttccacccgctctctgaatgttctgatgctcttggtgagtaaaacaaagtctttcaacaccacctccatctgaattgtatacttgatctttctgagcttggcaaacaaaccatcacccactcagaacctagacaggaaagtggcagatgattcaagcttcattaggaacaagtcatgccaaaataacttcatttctggttttgatgggattacagctcagagaatgcagcagaaatagcatcccaggatttcagtatgtcagctgacatctttaggtcactctttgaatgatacgaaaaaatgaggtctggagacagtaaaattgagcaatgagtagctgcttgatggatcaatgttaactgcagctcaaagagaagtgtctggtgatgtgacccagccttccgtcgcctactctgtcacacttaacttgtctctctgtcttagaaaagatgtgagtggcaactggtgagctactccaggagatagaatcaggatcccaaatgatgacccaggctgatattatgtgttaaatgcagaaagatttaacaaaaatagatgtcaaatcctgtatcaggattaaaaaaatcaactttgtaagaagaggatgggagagtcctggcttaaggagttgggtcagtatggtgacacaggtgacaggaaacttaccctgatgatcctgaactacactgaaagatgtgtgatgcagaaagcgagtcacgcctctgctctgctctttaccactcaaatcagatggaggctgtcgaacttagtcctggctgtgtgtgagggatcacactgatcactgagtccatgccccaggtggcatgtggaatggcagaagtacattaaacactgagaaaggcagactcatgggcaccctataagagttgccttcagagagctaacaggctaccatgtaaagatgagattagatttgttctctttcatgccagagggtgtaaacgggatcatgagtgaaattttaaggaagatagatttctgccacaaataaggaagaacttgctagtagtcacggttgtataaaatggaggaaggagctctcttcagtggtggtgagctccccattgttgcatgtgttcaagcagaggctgaagaggtacctatgccattattataaaaaaaaaattccaaattggatggggcctggactctaacatgccttattttttaacctccaatccttgatgcttctccccttatagcacaacagcccaacacgtgttatggttcttagtattccctcagcataaagttgaccaggaagaaagacaaggttgatagtattttcatttactctggataccactagcaaaacaaagagagctctcttgaacttctccaagtctcctataagtctatgaatgacacctacttcgatctacttcagtttggaatgctggcctagtccaaccagtttgctgagatcatgaacaatttgcaggaaacacagggagcattgataggatgaaatagaaggcagtattttaaaaaaatcaagtcaataatttcttatgtaagttttcaaagaccatcattcctattcaacacaaatccatctgtactgttgcagaagcttgaaattaaataaatgttgaccacagcagtctgaatttcatcacatttatacagcatttttccaggcatgagtttccctcactgaaaaataagctttttctacttaggcctatcaggtgagcaagggtagtcagtcacacagacccacagttttgtttgaatggacagcagcctgccccatcttgtattttcttgggcttgacataataactgagccatcaaaaaagttataaatattgtacacaccctgccattctatacaccctaaaatggcaggagaaaatagctcaaagcctttcctccttaatagctccttagacaggttttaggacagaaccgggtaatctcagaatctttgctaacaaatggaaaagaaagcagaagatctgactacaagtagaagagttggaggacgcaagacaatgaaataaggagaggagggtgaagaacatactctaaaagatggctgcaagtactggcatttactcatggtcgatatccaatacatatctattatttatcaagactgggcaaaaattaggaaagaaaatcgtttcttatgagcaactggaggcaaaggcaaaaaagaagttcatgcaatgatgggactgcctaactcctggaggtcccctgtctagagctcctgtttagccatctgttttctgtgacaatggttagcacctgactctgggttaaaattttttgggtagttccctcaggtctgcaaccttgatttaattaccaaatctaggtcgaactctagacacaaatttgaggtgaacaatcgaaccaaggtgtcatgctgtgcattgagcagtggaaggaccttctcttgacctctcatggcccctgatcacagatggctgtgctggcacagagcatgtccctccagttctccaagatggagcaagaaagaaggccctgtatgctaagacaatcatactcttttcacaaatatttcatgtgacctagaaatgtacacagtttggtagtgttaaatatattcacactattgtaaaacaaatctccagaaccttttcatcttggaaatctgaaaatctatacccattaaacaacaactctccttttccacctcctcacacccccggtaaccaccacttgactttctgtttctatgaatttgagtactttaggtatgtcacataaatggaatcatttagtaacttttttatgcggtgggcttatttcttcaatatagctttgaaaataaacccagggaggtgggaagggagggcatacagagcgagagagagagggcaaatccacctcccttctgcttaggtggtggccagaaagggagtatcctgggatatcctccgggcgtggagcatgttggcagcatgcattatagttgcaggagaaggtcctcctggcaggtgggctcaaggctcatcacctccatcaagaagcatctactaagggcccaagttgtccccatgtcaaatacattctctgaagtccatagaacctcagcaattcttgaagaattctcatgaaatgctctcagcatcttcctgggggaggaggaatctgaataaataaggctgcattattttaagagcagtctctgtaggaatcttggagggagagcagaagaggcaatggaatgcgaatgaatagtctcaaagctgccagagcctgctcttgaggaacgaaatatgcttagaatgtgtgtccctcatggactcatgcgtggggcatagaaggaagagaaatttggcttcaaaactgaaagacagtctgtgaaatttagtcacatgtcagagggatcactggcaaaaaatgtctgggaaccactgttacactccagctcaaccttgcggggccactcccacaatgccacctcatatgtcactgtgaatagggccacatcttcaccacatattctccctttcccaccaaaacttccatccagcaccaagaacaagggaggcctcctacagcagctccatgtggggagctatacccttagagacaggagtcggtgcaaactgggagttaacattttcattggagctgattgagctcaacttaccaataggttaatttgtaaatgaaaaaattctattgaaagagtttttgtaaggcaaactcctaattatccttgcacaagtctgctgcgaaattctcaacagaactttaagcttttgcctttttcatccactagactctttcttcatggctgctggtcacctactcatcttgccatccacctacccaaccctgtgtctcctctcccagacacttttctgcttcttcaggccaaaatccatagtcatactggcttttttttttctttatttcacatcccatttctaatcagtttgcaagaaaaactaaaattgtgaaggcaacccatctaccttggctggtctctctcctcccaatacccacccccaccgacccctccaacctctggtccatgttcgtatgtcaccttctcactgagccctgtcctaactactgtattcaaaattccaactcctgtcctccctaactactcccctcctcctagatttattttctcttaagttgctgatcactaacttaggtattcctgcttactgtctgtcatccctaattgggatataagctctgtgaaagctcagagttttgcctgttttgtatccctagtacccgcaacagtgcacacagtagatgctcaatgcaaatctgttaaatgaatgaacagcttcttctggtcattcaggtctcaacacaaagttcttctccttagggaagccttccttggccatcccatctaacgttgcacttccctaaattactgtctatcacatcactctgctttactttgcttctaggacttacaataatttaaactgtcttgttttcttatttgccctccacaatacttgtaggcccataagaactccaacttactctgtcttatccattgctataaccctagcacttaaaacggcttaacacagagcaggtactcagtaaatacttcttcaatgaatggagaaccttcatgacaaaaccaatcaaaatccattatttattttccccaactttcctgatcttgaaaattctaatccacagaaaagatggaagaatcatatatccacctacttttagtctggattcagctgggggtgaatctggaatgtcgggaggaactagactgtgttaaatcattacatttgctaaatttgtgtgctctcttctctcaatgtatatctatacagtcctgttcacgtaagcgtgcacgcgcatgcacacacacacacacacatgcatatgttttcccagaaccatttggaagtaaattgcagacaccatgacatttaaccactaaatacttctgcatatatctcctgagaacgagaacattctacataaccaaaataccatttttccacctaaaaaaagtaatgttgatacaatattataaattaatatatagtctacattcagattctccaaagtgctccaaggatgtcctttatagattttttttttttcaatctgggagccaatcaaggatcactcattacatttggtctcattagtctcttttaatctagggcaatccccccatcattttgtctttcatgacagtgatatttttgaaaagttcaggccagttgtcttaaagaatgttccacagaggatgtctagtcatagcattatgtttaaaagttaatctaatctatttgttctttagtttattattttaatatacggtgagttcatttttgtttgttttaaatttttaagtctgctgattttcatctttgttgattagattttaatttcttgactacttaaaacatttaattggttcaaaagtcaatactgaacaaaaagatacagagtctcactcctatcccaaacctttcactctgttgccacctactttctataggtaatcttttccactagtttcctgtttatcctttctgtttctttttacaaagtatgcaaatgtatgcatgagtatatatttataaatcacacatatatatttatgtgttacaattatgtattattttcccttctttgcacaaaaggaagcataccatatatagtgtacatatccctctgcaacttgtttttctgcttaaaaatatatctcagaaattactcatattggggccaggcgatgtggctcatgcctataatcccagcactttgggaggccaaggcgggtggatcccctgaggtcaggagtttgagaccagcctgaccagcatggaaaaaccccatctctattaaaagtacaaaattagctgggcgtggtggcacatgcctgtaatcccagctacttgggaggctgaggcagaagaatatcacctgaacccgggaggtggaggttgtggtgagctgagatcgtgccactgcactccagcctgggcaacaagagcaaaactctgtcacacaaaaagaaaaacaatcaaacaaacaaacaaaaaaaaacaaagaaattactccacatcggttcacagagaacttttttctttcttatggctacacagtacatgattgattgtgtggctgtatgtggataactttgtgcacatgttgttttgtatctgcacgaatctactattttttcataggttgctatagagttttttagtaggttgttataaagtttactctttaacacatattgaagccctaatccccagtatgattctatttggaggcagggcctttacaaaggtaattaaggttaaatgaggtcacaagggtggggccctaattggatagaagtgatgtccttataagaaggagagacaccagagcactgtccacacacgcacagaggaaaggctatgtgaggacacaaggaggcggctgtctgtaagcccaaagagaggcctctaacagaaaccaaccctggtggcaccttgatcttggacttctggcctctagaactaagagaaaatgaatttctgttgtttaagccacccagcctgtggtattttgctatggcagcctgagtgaactaataatatacatgtattagaagagctaaatgctgtagattcacatgaaaacaagctaaggattgagttaagagaaaatcacttaacttaataaaacttaaaaacttgtctcccaagatatcacttgagaggcataccccttaaaaggtaatttagggagcaactctatatgtatcctcagtctgataaactgtgatttaaaaaaagtgataaaaaagtgaaaaaaagataaaagatatttctggaggctcctgagaaggaagcaaggaaaaccctggcaatccatggaccaccgagtagtttgcgtgaagtcattttaaacattagcgtgagccttacaggtgcagatccattatagcatcaccttctattctgactcactcttctgaagtctcagtcacacaccaattaagttgtcttcttctacatcttaggcatgatgaagggaaaccacctcattaccacagggtccacagtaaatggttcccagactccaattcaagtgacatgtggatagggaggaaggtggcatgaactccaaggacaccagggcccaggacttccaggatctagggtgactttatgtttttttttttttgaattttttttctatatttcatacttgaataaactggctcagaaggtaaatgtcttcttttttataaaacccagttgaggatggaaatggcctcttttactattagtttttaaaatgtcatcattcatctgattaatatgaaaacatgcccttattactgaacattgtgatatatccttgaagaagcagctacttggagatattccatactcaaccagagcctaaagtgtacattatgcttattgagtgacttaccaaagcacacgcttacagacatttatatttgtttgaaaataaccacgaaagcagtcttgttttcttcaacttcagtacttcagtatgtgtataccaagggaatgggaaaggagagacacctttcctcacactccctgcttccttcacagtcatacaagatttgatcagaaggtaagaatttccttgtctgtcagatacagtgtctgacatagagtcagacagttggaaaaacatacgagttatttccactgaaaatgacactagtcatttccagagatgtaactccagaaaacatacaggaatgcaaaggcatctgtaggtttcaatggtcggggcaaatttaaatatgggaaaaggtcttctaactttaaattagaaggaaatggaagaaatctaattgagttcctttgttgctttttggattttcatttaaccaatgagactgtgagtgaaagcccattcagccaaagtttaggactttggttcttagaagaatgaagagccccgagttggacggaagggaccaggaagcattggtccccttaggtcccactggtggctttagagagaaatcccatggggcatgcagaacctttgaaatcacaagcaaagccatactacagagtttcattgttccagtactatgccccatccttttcctgatcttccttccctttcatccacctacccattcaaataaccctttcttcattatagaaatgtaataatgtacactgtaagaaattagaaaatgcacacaaagaaaaagaactccattacatttctaccattcacaggtcaccctgttgatatttttactttgcacacgttctcatggctcttcgtatgtacacaccacttgcactcacatttgtatttttaaccacagtgagatcatactgggcatatcgttcctccaaccactttttctgatcatcacctttcatcaactacttgggtcatatttgagtttctccaatttcccccactccagagtcctttataactggtttgtgtaaaccagtaaccactccaggaccatgaactacatctggtttttaaagctcttaaatcttgtttaacttagcgcagtccatttttatgtcactgacttattgaagaaatcaggcctgcaagaagttgtcctgtagaattaccctcaccctcccaccccaccaccatcccccgaccccagatttgtccctttgcttcctcatggtgttggtaagcttgttcctctaatcctttattttcctctcactggaagttatatctcaaagctttataaggtcaaatcataccgactacgccagtggggatgtgtgacaaagagacatcatggctgtcagcgaagggtattgtatttcatgaatatttggatcagaagatacctaacacctggctgacactccaggctcagattgacccctgcccgggttactgtgaagacagtctgatcctttaatgcacagttctgacttatcgcttgtgacaagaaaagagtgtgtgtgatgttactttgtttccgcatgtgttgttttggtataataatagtgtccatcaaacattcaccttaatggctttgaccccgagtgatcacctgtacctgaatttgttcatggcatttaaaacaatacgtggcactagattacaaacagctttgagaacaagtgctttgtcctttagaaatttagcatccccttgcaggatcttgcactcacctatgctaagtaagagttgatgctcgcgatatcacttgggaggcataccccttaaaaggtaatttagggagcaactctatatgtattcctcagtctgataaactgttggggcttaaatatgttccaaataaatgaagataaacttaacaccagcaattcggagtaaaccttgttcttagtggaggaaccagccatggagcctaaatgttggagctcaatctcagcccctgccccttttttttcctgtttctcaaaggggtcagcgatttctagtgtttccagtcattgcctatgctggtgttcctcctatctgtctatacctttggctctgtgatctcagtgccttaggcacatgtaaagcactacggatacgtatcaaggccatcttgatggcctctttcaccatccatgtgctccctacccaatttcttggtatctctgaaaggccccctcattctcccagttctttacccaggtgtagaccttcctcacctatgctaggctcaggctgtgtctcctgactgtgctctctgtctgtggtgggttgttgttgccatccaacatgcattccattgctagacagatattccttaaactgttttttattatgtcacttcttggttcacaatgtttcatgaattcctattgcttacctggtcaagtctaaattcttttgtctaaattttattcttccatagtaaggccccatgtagtgagaccatattttgacttatttccccaaatctctcatttgtgctgataaaagatgcctcctcaaagtcctgcaagtgcctctttttgggtctttgccacaccagtgtcctctcctgaagggtctctccccacttgctccctagtgaagtcctgtccatcctgtgggtgttgattttaggtgagataaacttcatgaaagagatggaagaaaaatcctgtccttccctccacctgaacctctgcagcacaaacaactgccagtaccctgccatctacaatgaatactcttgaatcactcacctttgatttctatgtttttcttttgattcttcaactgtattgtgggttctttgaaggaggtaatcttgctttacatttctaagttaatcccccaaagaaatgacctctggggtcttgtggtccattcctctgcttctatgaagtgttgtacttaaggattttgtcttattaagcatctggtttaagcacatgcacacgggcacacacacacacacacacacacacatgcatgctcctctgaacgtaattctgtattttttggtgcctctctcccatgtctagcatcttatactgttacaaaatcctcctttaatatagctgaaatccctcctgtatagttgggatgctatttcttcttgtcagtgaatgagacatctggtcaacatctactaaagcagccttaaataggaggaatggaaagactttgttaaacagaactttgaaaggttactgcacttctctacatgaacaccttgtgaattgaatgcatttaactcatccaaaaaaatctccagttacgaaaactgtgcttcaattatcttcccttagtaacttcagttatcttccctgatttcccaaactatgaagttcttaccctgaatctgggtgttccacatttttaatctttccaccttcctatttgtagggtacaattcaattcctgtgctactacagatccacttggcagatataagaaacacaaagaatactcccacatagactaaggcattcagtgggaaacaaacagtgcacacatcagaacgcctctcatggtagtagagtgttcatctttatagagcaagacgcttgagggtcctgtctgttaacagccattctcctggcctttttagtaacttcctgttttccttacacttctcttttcttaactatcatacaaaacaagaaaaacagataagcagggaggcatcagaagggtttctctggatagatcttcaaagtgacccatataaaccttccatttgactggtgccactcaacctggcttgataaacccaagggtgtggccactgctcatagactgccctgccctacccagttctggttgttaatgccacctccaggaatgatgtcatctatgtaacacttttgggaagaataagctgtcatttggttttgcatataaagaatacaaaaattaaagaaatcaatagaaaatgatggcttaaaaataatcaggaaaaaatgagtaacaatgacatttaatagctgtcctttataaaacagaagataaaatgaaataggtatttcttcaacaagctggaggcctgtaattgtgaccttctgtatccttcctttggttttcttctaagcccaggaatctttcattggctaaatcccagcatttttttttttcctcccttggccaacttttggccttgcttgggaacagctgccagtatttctctttgctgccagtcagtcaaaaatgtgctcacgttggaggcctggctccatcccacccagggtgtggaatgcattaactttttcacaaacagccttcgccaggctgcacacgaaagtccatctcagcaaagctcaccgcattactagctggcttggaggtgatgccaatgtcagttacagagactgtcaacatattttaggagtctatggcaaagtgatgaattttactatgtgtaccaaattaatggcaaaaaagaacacttccgagatcctaggaaaccaaaagtgttattatttaattgcttctccactcctcaaagcaaaacaagccaattcttttctagcctgcaatttggttcagaacccaaacaaacaagaaaataaaagtattaactgattagtgcccacaattttattctattttctttgtgcttttaagaacagccttctttcttttttccctttttttttttaactgaccaccatgcatcactccaatgcctgggtatgatccattttattaaaaaattcctgaatcaatttcctggcttacagcttatccaaccaagattccaggtgttctcaccataagaagggcctctttcaaaagctgtctgcttttataactgcacacccaccagaaatgtcatgaacaccccaacaatggagttgaaacctgaagacattgggtgacattccaaatttttgaatggaatgcgaatccattaagattattaggtaactttattgatatcctcagatttgtgccaaatgttaaagctgccaaagaaaagacagaacaaaaactgactcttggattctaactctgagtattttggtgtggaaactgtgttttcttgtaactcacttaaaaaacacaccgtgctttcactgtttaactgcaatctcagttttcaggaagcaagagaaatgagatacataatcaatgtttgccttctattcagctttcagcctaaatgatcctgcacttgtattggcaaatgaggacaggtattaacagcgaacaggaaacctattctaagaaggactggctcaagtgaagcaccactgcatcgtgagtgactcaaccatctactcaaagagtgattactctgcaaggatgaagccatgctaattggacaatggcttgctgccagttcgtgctggcgtgacctacaatacccttggctgacagccatgatgtctctttgtcacacctttttttttttttttccaagggtgtagggtgtaatctggatgggaagtagaaataattttgaaaaactctcacaagtgctatttaaattcttatcataaattaaaaagtttaattaagtaccttggtaaaggcccgggttctatgattaactacgacaaaataatagttatgatgactgatcaagtgaggaactttatagctctgaactttgtctttaaagctattattaattttaattgaaatagctaagagactccataatgggagaaagaaagaaacatgaaggatattttgttcatatacagaggagtttaaaaatgaatagatacgccggtaactattttaaaaaaattgatgcaaacaagtttactttcagaggccttgtcataaatctatttcaaaatgttgattattgtggtcatcctacatcagatagggataaatagacatagtgaaaagaaatcttaaaaacggctttgaaatcaggtcacttaaaatgatttttagatatgtcttaggtttttgtctactcaactcctactactatgccaaaagaggaacacatttctgcataagtttctttaaataggcttactggcctcaggatttaaaaaatgtaagaggtttggaaacagcttatgtgtctcagttttaaaattagctattgctgtggctattttcacactagatttccctccctctgtatcagcaccacagcctccagggctggagtcacaatagtattagctcccctttctgtggcgctgccttaccgcaactccatccgagactgaggaccacatttcagggctagcagtcacctctgcgttactataaataagttctgcctttaggcatttcaaaattatcagtatgattctaggacttgaaaacttctcatttgccagcaagtagttacctgaaatattttgacttcttatttatttgcttttttttcatctgctgccaagtcttactaacgcaacttggaaaattgcaccacagcttttaatgaggattctgaggtaacagccatttcatcagagaagactgttctttccttttaggggaataataacacctactgtttctatagcaccatccttccaagaagtttaacacatcacatttcatttatctgaacagcggccctgcaagtcaaactggtaactagcattgttactccttgtacactcatattgaaattgaggtcattaaatgtgaactaattttctcaaaatcttaacaccttctgacatggttaaagagccatgatccgcctatgttctaggtgatcagatagcccagaagtctctttccgctctttagctgtcatctcctgtgaatgcctgtaaggaaggccctttctgaaaagtcagggaaaagtcataaaagtgggagaactgagcttgtgcctcttctggagtcctgtggttctctcccttcctggccagtttgcctcccatctttatggcttttccctacctctcaatccaaacatccctccactcttcctgaccaacaggattttttctctcttcctccaacaggaagctagccaagttcaaggactgtaaacctgtgtgacataggctaggatctcagagatcatccagccccaatccatcattttcagattaggatgtgacttattgagtctggccatttggttagtagatcccatcctctgttgcatactgaaggcaattgaacttctgtctcctgtatcatcaagttttctctctcttttggaactttcccttcagcccaggtattaggacaggttaggctttgctgtgctaacagataaaacaccacatcttgagagattgtttggagcttctagcaggcagcacagctatgtatatacttgtgaatgaagaacggtcctcctctatcagggaaggtcgtcctcttcaaccaagcctgcagcttcaggagggacacacgtggagcagtgagggagggaaacgacacccactgagccagccagatcagcccaatcaacctggcgatgttggggtgacagatgttgcagccagattgccttcacatccagaaacaccaaatcttgagtgcttaattaacttaaaagtttatttctcatcatgtcagagtctgatttgagtcagatggattttgctggctctcttccaacagtgactcagggacctaggctacagcttcatcactctagagtcctttgacaccagctaagtggatgggacaaagcataaagagcttatacctacttttgactgccttggagcagagtcctcacctcacatttcatcagctagatctagtcatatggcctacctgattacaaatttagtcttcctgtgtgtctaggaaagaggaaaactgggtgtgggtgagcaatggtaatcttcaccacagagtacaaacatgttgggatttcttcctacttaaaataaaaaaccaaatgaaacctcttttgacaccgtttccctccagctactgatctacttctctgttccctttcactcaaaaagccttattctctctagaacacaatcaaattggtttttgtttctactgctcccccaaaagtgctcaacgaaatcacaaatggcctccaaattgccggatggtcagtttttggccttcatcttagcttacagtcagcatcatttgacctagttgatggctctctcctcctcgaaatgctttcttcacctggcttaccacgcactatgctttgttgcttttcctcccacctcaggcttgctccttcttggtctaccttgccggctcctcttcatctccctgacctgttaattcgagaaagctccaaggctcaatcctgggacttcttttcctttctatctccactcacttccttggtgatcgtatgtagtcctgttgcttttagtattcccaatattctggtattacaatttttatctctaggatagacttctcccatgagttctggccatgtaagtccaactgcatactagacatctttacttagatgtcaacaggcatctcaaacttaatatatacaaaatagaaggccgggcatggtggctcacgccttaatcccagcactttgggaggccgaagcaagtggatcacttgaggtcaggagttcgagaccagcctggccagcatggcaaaatcccgtctctactgaaaatacaaaaattagccaggcgtggtggtgcacacctgtaatcccagctacttgggaggctgaggcaggagaattgcttgaacctgggaggtggaggtggcagcgagctgagattgtgtcactggactccagcctgagcaacacagtgagactctgtctcaaaaattaaacaaaaaaataaacaaaactcccaattctacccgagtccccaatcctactcctctcagtcttcgcttcacccatctcagttaatgccaactccattcttccaatagttgaggccctaagcctggatgttatctgtgactcctctctttctctcccaccttgtatccaacatataagaaattcccatgagctctaccttcaaaatatcaccagaatctgacaccaaccaccatgtcactgctatcaccctggtgtaggccatcaggtcacacctgggttgctgtcttagcctcttgtgtcttttccctgcttctgccctggccctctttcaatttattttcacgtggcactcaaaatgacctgtgaaactctccagtggccagctcgttccaaaaaaagaccaatcgctcagtgaggtgcacagtctggaccatcacctctctgactcacctctccccaccctgccttggctcactctgctcctgggtggcaaacacgccctgcccaccacagcctccttgtgattcctcctgtctggctcaccctttccctagacatcagcacagccagctccctcacctgctccaggtctctcttcaaaagtcacccccttgaacaggcttttcttgatcactcttcttaaaattgtaatacttgtatcctaactcccttctctgttttattttcctcaatggcatctaacaaagtatatttaacactgattaatttcctctttttcctcctcctccccactggaatgtgagctaggttcgcctagcacctagaatgatgtctcctggttacatagcagggtcttgacaaatatttgttgaatgaataaataaatgagtgaggaaacagaagcccagagaggaagactagtttgctgaagacctcacatgcagtgataccaaggtgcagagtgtggttttcccagcccctcaaggctgatgatcctagtttaaaaaaatctgcccattactctttttcaggtaaagagtggtggtgtcttcttcagagttttgtttaggtgaatggggtgaggccaaagggcaggctctgtgctctgggctaagtgagtgttttgcccttctcatcctggtcatgccacttcccaaagacttcacccctgtttcccaccaaaactccaccttcccttgtcctcaccctcaggctcagaatgctgttgtcaccctgtgctgtggcgttaactactttctgtactattacatactgaaagggttgcccaaagataatcatgactgtcttattgcttccttaagactgaacctaaaccatcccagagacattaacagctttcatatcctctaaaaacttccagacaagaagattccataatttccttgttggcatctgtgcttggcagtactgctgcaggaatgttctttattgcagcctgtggttaagacttaacaacaaatgccttttctttagaatccttctgggtcagctttctttcctgtatagcactgaaaagtgagatttgccccaaaatgttgagtgagagagagaaagcaaaagatagtgagcacaagcgagcacaaacctgaaatctatttataccgaggaaaacataaggtctacctgcaggggccatactcacccccagcctgtagctgttccctgcatgaacccgtccccttctctagagggtacaaggacacaggaagcaagccagagaaaggtggtgagaccttggcagtaaccttttaacagccacttttcccctagcattctgtcaaggagccaggcagccacgtaagaatagtgttgatgtgcaaacccactgtgggctgagcatcttctaaggaagcacatcccctccctgtcctctgaacttgacacgccataagactgaacttcatagttgtgatgctacttccgtcatggctggcatccagcccgaaatggcctccatgactatagctaaggaggtgtcatactaatgagcagtggaagaacggccctgcaatgcttagcacatcaactactttctcttcatctcttagcaaaacatatacttactcattataaaattgaatgatctgctttattatgtaatgaaagtactaagtacagtggcttatctcctactatttgctgacacaattacctgggtgtgtttttcagtggggaacaaacactcaagtcctagaaatcctagggattgccatttgtttttttttaaaaacgcaagataattcaattattccttgatttctagaaggaggcctccctctatttttgtctgtctttcagtttagagactatgctgggctctgtgagtggctctaatgtgctggtaatggcgtggctcatcaggaattgggatttgggggtggaattgcacaactggacagtcgctggacggcagatctgggtttggcctaaggtggatggggagttggggggaggagtggcagtttgtgttcggaagtttcaggctcctaggaggaactctcaggcctggctgtgctggcccccttgaggagcacagcggttggctgccaagggagtgtagatgggtcaaatgtgactaagaggagggcagggccagaagttgattcaaatttggcgataggattatgatgaggtttaaagatttccaaggagctaatctaatggtttttcttatatcctatgaaccaaatgccgattagttccagaaagctactttctaaggtagtatttagaatgtctgcttatttaccacttaattcaaattttatgaaatcactcactgagctaagtgtgacaattaccattgagcctgcagggacatttcagtgtgcacacagcaagtcaggaaaacaatgcccagcacgtgggtccacaggcaggtgccctgagcagagggggagggctcttcaaaggaggcctcagaaacaatgacagagcctcaaaagaaaatgccactggggctggcttgcatgttccatcaacaagatacttagagctggattactgaaagtatgaatttgcgtttcataagaaaaaaaggatctagttctacctgaagatttcagatacgtgagcaaccagaatgtttcaatggtttcgaggatgtagatgatgcagggatgataatcattttacagggggaggaagaaagaaaatcaacacacagcaaattctcacttaaatgagaacacacagcaaattctcacttaaaaggccaaatagatttttgtgcgatgtctatacagtgtgcctcttatttaaaatgccttttccaatgccatggaaataagcaattatcagggatttgatctaaaaagaaactttaaggttatgtcatatacatttgtatcccagtttcctttacactttactgccttggtattgtatttttggtaaataattcaaggcaggaggatcccttgagctcaagagttccagtccaacctgggcaacagagcaagactccacctttaaaaagagacttacgtttgtcaaatgcctactagaggataagggctgtgctgagaatttttgtatttatcatctcacctagtcctcatggcaggacagctagttaagtatgtccccaacagcgcagttaaggaaaggccagctcaggatcccctggctacagtgcagctgccattcctcggccttcccgttacttggtacccagtccccactccttatcccagccccagtatgtcatttagctgatctgtccttttgcttctagtgttgggatctctctagctacctacttgctagtggtatgtggagtggtaatggagcattctattttgagtatgtaacaaggatacgaatgtgaaaacgctagtgcttatgcagtccttatttatttatttatttttttgagacacgttctcactctgtcacccaggctggagtgcactggtgtgatcatggctcacttgcagcctcgatctcctgggctcaagcaatcctccctcctcagcctcctgagtagctgagaccacaggtgtgtgccaccacctctagctaatttttaaatcttttgtagagatgggggtctccctatgttgcccaagacagtcttgaactcctgaactcaagtggtcttcccgctttggcctcctgaagtaccaggatgacaggtgtgagctgctgcacctggccccagtcctcatttttatcagctggttgccttcctgctcagcaggggtaatagcagatgttgcttaacaagggtctgggatttgaagaaacctccactacccatatcttgtttgtctatcaaatagacaaacacaaatagtgttttaaaattttaattattattattattttttttgagacagggtctcgccctgtcacccaggctggagtgcaatggcgtgatctcagctcactgcaacctccgcctcccaggttcaagccattctcctgcctcaacctcctgagtagctgggattataggcacacaccaccatgcctggctaatattttgtatttttggtagagatggggtttcaccatgttgggcaggctggcctcaaactcctgacctcataatctgctcgcctcggcctcccaagttattatttttttaaagatggggtcttgctatgttgcccaggcttgtctcgaactgctgggctcaagggatcctcctgtgtcagcctcctgagtagctggggctacaggtgcactctactgcacctggcttcttgttttttgttgaatttagatgccttttggtggagcaggtgcttgccccatcacttcctactgtcctatatacaacctacttcactcatttatattatttgccaggcccctgaaggcgtctggtttgtgacttctgtgatttaatactggttgtaaccatcagcatcatatctgggtgatggggtctttggtttctcctaagatcactgtgaagagctgcttagtcaaacaccacacaactctagggaatctatttgcaaaaactatggatgtgagttgtactcctgggagttacaaagtacaaagcttgtgtaactgttggtggtggcccaagagatgcacaccgcgctggtggtacacagggaatgattctgcccgaacacaaagtattatccttagtcccataggaatgacggaagtcaggatgatgaaccaagaggtagtgtatatatggttcaaaggatgaccatttaatggtttgccattgtgaagcccatcttttggggtcctacaacttaaaccatccaattaaatgtcatctctggacagaccaggtccagctactagtgttcccaaagtgccaaaataaccgtattcactgatgtgattaagaaacctgagtgggctgttttcaacaacggtgagaaaagcaagtttacacttcttagaatcttactgaattaatggtgaaaattactagttgcttttatttttcccccaagcaaagaaggtgctgtgaatgctttcgatcttttactctcaagggaaatctagtgatccttacaccatctgaaagacagaaatcatagcaatgattcagatcccacatctaggactgtgccaaacttaggctgaaccactcaaaacctgaagggtaagtgaactagaaactacaagtgactgagccacaggtgaggttcagttcccttcaagaaagatattcacattctgtgcctctgagactttaagtgtatcaaatagaaactgactatgccacagacctaacatgtgacttggacatcaactcctgagtggggacatggcacctagtacatcttctagctcctagtcagccagttttctgtaagtcaataaacattcattaacaatcacacaaaccaaattactgtacctcctcaggcaagctgaccaccaaatcattttttgtctgtccaaccagcgcctgccaaaaatattcactgcatgcggccagcacagcccggtgggcccggaactccttcctctccacgatcaaagtcacgtcacagagaatatcctttttccgctggtcattgaggcccaggaggatgttggtgcagtggactgtggactcatacacatacatgggggagtcaggcttctcatccacagacatgccgttcacaccctgaaagaaagaaagaaacaaagaaagaaagaaagaaaggctgagtcaccacagctgtaggatcagagagaggaggtgagaaagaacatcatggttcctgtgtcccactgccatgagcatggcaggaaggaggggaattaccaatcagcatatttgtgcttactctgtacaatgagctcaggaaacatatctgtaaagtcaagttccacagctgacttttatgcttcctacttaccgcattcttttaccccatggtaacaaagccagatcttttaatagaacatttaaaacatttaaaacacattggtattttaaaacttggtggttctgattttgttagtaggctgaaaaagaaatttcacatgtaaatagcctctatgcaaggactaacttagatttgtgtgaagaggaaatgaatcattttgaagtatttgtaatgttgtcttgatgaagtatatgtaagttcctaaggtgaaatttggctgagatgccaagtagagtaaacatcaaatcacaatacatatttaacaagtgaaccaaactgtctgcacactgaagactcagtagagtcagctattgcatctgccctctgccacttcaaggcaaagcacaattgccataatgcaatagttgctcagctcttagaaagatgtggaattgtgctgtcgttatcccagctgaattgatgtacatcccctttaaggaaacacaatatatcacaatagcagtcatgaaaaaagatgcattcaacagtcaagattacttttacaaaaggttctttgctttaaaaaatatccattgaaatatttctttttcttttttttgagagggagttttgttcttgtcgcccaggctgaagtgcaatggtgcgattctcagctcactgcaacctccacctcctgggttcaagtgattctcctgcctccgcttcccaagtagctgggattacaggcatgtgccaccgtgcctaactaatttttgtatttttagtacagacgggatttcaccatcttggccaggctggttttgaactcctgacctcaggtgatccacccgcctcggcctcccaaagtgctgggattacaggcgtgagccactgtgcctggccccgctgaggtattttaaaatacagtatctgtaattaatttatatagttacatagtttttctgtaatgtttgctagagtagtaagaattccagtagcgagtcctactttctttttggctttcttatttttttaaaacagctttaacatacaataaactgtacatatttatagtgagcaatttgatgttttgattgtgtatgtaactgtgaaaccatcatcacaataaagatagtaaacaaatccatcatcaccaaaagtctccttaaggcccttgtaataatttttcccttgtacctctctgtaccccaccgctacaacgactgatcagctttctgacattctatattagcttgcattttctagagtttcatataaatggaatcataaactacatattcttttatatctggcttcttctattcagcataattatttcaccattcatccatgttgctgcatatatcaagtttgttcctttattacttagcatcctattgtataaatatagcgtaactttttttttatccattcatctattagtggatatttgggttgtttccagtatttatttacaaataaagctgctgtgaacattcacatacaattctttggatggacatatgctttcacttctcttgggtaaatacctgtgagtagaatgtattatatggtatgtgtaagcataacttttaaagagtctgccactgttttctaaagtggctgtaacattttacatttccaccagcagtgtatgagttccagttccttcacatccttgccaacatttggtatggtcactctttctagttttggacattgtaataggtctatcatatttctttttgggtttaatttgctttctctaatgcctgaagttgttgagaatcttccatgtgtttatttgacctctgtatattttctttgaagaaatgtctatttagattctttgcccatttttaattgggttgttttcttatttttcagttttaagagttcttcatatattctgaataaaagtcctttatcagatacatgacttgtaaaaattttttcccagtctgtagcttgtcttttgattctcttaaaagtgtctttcaaggaacagaaagtctttatttgatgaagccaaaaaaccatcttggtgtcacatctaaaaaactaaaccaaggtcataaagattttctcttgttttctgctagaagtgttatttttttagcccttacatttaggtctatggcccattttgagttaatttttgtgtaggtaacaggtatggattgaggttctttttttccttttgcataggaatatccaatcattcccgcagcattgttaaaaatactcttttctctcctgaattacctttgtatttttactgaaaatcagttgtttttacatgtatgaatctatttatggactctgtcttttactatttttatgtttgtctacttttgttttttttggagacaaaccttgcttatttgtacttttactgaaaatcagttgtttttacatttatgaatctatttatggactctgtcttttactatttttatgtttgtctacttttgttttgttttgttttggagacagggtatcactttggagtgcagtggcatggccatagctcacagcagtagctggcactacaggtgtgcatcaccgtatctggctaatttaaaaatattttttgtattcctgtaatcccagcactttgggaggctgaggcaggcaggttacgaggtcaggagttcgagaccagcctggccaacacagcgaaactgcgtctttactaaaaatacaaaaattagctgggtgtggtggtacgtgcctgtaatcccagctacttgggaggcggagacaggagaatcgcttgaacccagaaggcggaggttgcagtggccgagatcacaccactgcactccagcctgggtgacacagcaagactctgtctcaaaaaaaaaaatatgtgtgtgtgtgtgtgtgtgtgtgtgtgtgtgtgtgtgtgtgtatgagtgatgaggtctcgccatattgcccaggctagtctcaaactcctggcgtcaagtgatcctcctacctcagcctcctaaagtgctgggattacagatgtgagccactgtacccagcctctatatctacttttatgttactatcatagtgtcttgatttgctctttttcaaagttagtttgatcctttgcatttccatatacattttataatcagcttgccaatttctacaaaatagtctgctggaattttcactgagattgtactgaatctactgatgaatttaggaagaactgccatcttaacaataatgaatcttctgacccatgaacacagtctctttatttagatcatcttgaatttttctcagcagccgggcatggtggcttacgcctgtaatcacaagactttgggaggctgaggcaggtggataacttgaggtaaggagtgtgagaccagcctggccaacatgctgaaaccccatctctactaaaaacgcaaaaattagccaggcatggtagcgtgtgcctgtaatcccagctacttgggaggctgaggcaggagattgtgtgaacccagcaggaagaggttgcagtgagctgagattgcgccactgcactctagcctgggcgacagagcaagactccacctcaaaaaaaaaaaaaagaaaatttttttctcagcaatattttaattgaaaattttttttggagacagtctcactctgtcacccagatggagtgcagtggtgcgatcttggctcactgcaacctccacctcctgggttcaagtgattctcctgcctcagcctccggagtagctggaattaaagaggcatgtgccaccgtgcttggtcaatttttgtatttttagtagagacgggttttgccaggttggccagactggtctcgaactcttggtctctcctcggcctcccaaagtgctgggattacaggtgtgaaccaccacactgggccctcagcaacgttttatggtagtatataggtcttttatacctcttttgtcagatttatacctaagtatgaatatttttgatgccattgtaaatggcagtcttttaatttcaatttctaatttttcactgctagtatatacatacaaataatttttgtattttgatcttgtatctggaaaccttgcttattagttctcatagcctgttttttcttggtagattccacggtattttctacatagaagattatgttgtctgtgaataaagatctcttactttttttccaatttggataattttaatgtctttttcttaccttactgcattgtctagaagctctagttcaatgctgaatagaggtgatgagactaaatatccttgctttcctgatgttaggaagaaagtattcaaccattcaccattttgtatgacgttagctatagatgcttcataggtgctccttttgagctgaggaagttttatttctttctctccctctctcctccccttccttccctcccctcccctccccttgttttccctttctttttctttttcttttttttttttttgagatggagtctcgctctgtcgcccaggctggagtgcagtggcgcgatctcggctcactgcaagctctgcctcctgggttcacgccattctcctgcctcagcctcccaagtagctgggactacaggtgcccgccaccatgccaggctaattttttttgtatttttagtagagacagggtttcaccatgttagccaggatggtcttgatctcctgactttgtgatccccccgccttggcctctgaaagtgctgggattataggtgtgagtcactgtgcccggcctctttttctatctttctttctttttcttcagtggcactcatggctcactgcaaccttgaattcctgggctcaagcaatctcctgcctctgcctcctgagtagctaggactacaggtgtgcaccaccatacctggctaattatttcttatttttttttgtagagatgaggccttgctatgttgcccaggctgctcttgaattcctggcctcaagcaatcctcgtaccttggtctctcaaagtgttgggattacaggtgtaagccactgtgcccagccctgtgtttgccttcttatacattgttggattcaatttgctaacattttgttaataatttttcatctatgttcaatacggagatttgtctgtagttttcttacatagtttttctggcctggttttagcatcagggtaatgatgatctcataaaatgagctgggaagtatttcttcttctttaattttctaaaagcttttttttttttttctttttgtagaattggttttatttcttccttaaatgtttggtagaatgtacctgtgaagacttctgagctgggatagtctttaactataaattcatttttttaaattgtcaaatttattggcataaaattgtgtgtgtgtgtgtgtgtgtatatatatatatatatatatatatatatttttttttttttttttttttttttagacagattcttgctctgttgccaggttggagtgcagtggtgcaatcttggctcactgcaaactccacctcctggattcacaagtgattctcctgcctcagcctcccgagtagctgggactacaggtgtgcgctaccatgcccagctaatttttgtatttttagtagagacgggtttcaccacgttggccaggatggtctcaatctcttgacctcatgatccacccgccttggcctcgcaaagtcttgggattacaggcgtcagctaccgcccctggcctttttattttttttattttttaaagagacagtgtctcactttgttgccctggctggagtgcagtggcgtgatcatagctaactgcaacctcaaactcctggggctcatgtgaccttcctgtctcaggctcctgagtaactaggactataggccgtgccaccatgttcagctattttttttttttttttgtaagagatggagtcttactatgatacccaggctggtcttcaactcttggtgtcaagtgattctcctgctttggcccccacaaagcactgggattacaggcgtgagccaccacacccagcccatatatagtttttaaaaatattccttctaatatgggttgaatctgtactgatgccacctctcatattactgatactgaaaatttgtgtcttctctttctgatcagtctggctagaggcttaaccattttactgacattctcaaataactagtttttggttagtttttttaaattattctattttctagtttgctgatctctattctcattgttatatcctttattttgcttactttgggtttaattgggtctttttttcttttccagtttcctaaggtggtagttgagcccactaatctgagatcttttttgtcttttctaacacaggctttaatgctataaatttcactctgttttagcagtatcttgcaaattttgaaatgtttaatttttactcaattcttaatgctttaaaatttcccttttgatttattccttaatgcacaaatgatttacacacgtgttttttggcttccaaatatttgggggagtttttagttatctttttgttaatcctctctgatttaattccattgtggtcacagaacaaacttcatatgactttaatccttttaaatttatggagacttgttttgggtcccagaatgtgacccaccttggtaaatactacataagcacttgaaatgtatattctgttgttggctggaatgtcctgtaaatatcaattaggttaagttgtatgatgagtgttgttcaagtcttctaatatcttttctgatcttttgtctataggttccgtcatgtattgagaaggagtactaaaactttccggctacaattgtaggcttgtctgtcagttattgtaattctattagtttctgcctcatgcagtttgaaatcctattagatgcatatatatttagggtttttattttttcttgtagtatttattcctttatcactatgaagtcaccttttaattcctggaaatattctttgctctgaaatctactttgtctcatattaacatggtcactccatcttttgtttggtgttagcacagtatatctttttctactcttattcttttaacctttttgtgtttttatatttaaaatgtgattcttgtaagtaacatataattgggtcttgctttttaaaaaaatctaatctgaaaacgtctgagttttaattctggtgtttaaaacatgtatgtttaatgtgacaattgatttggctaggtttagatctgccattttgctacttgttttctatttgttctttattctcttttccttcatcttctgactctctgtgttaactatttttttatgattcaatttcatttcaattattggcatgttgttttgttatttcattggttgttttaggatttataatatgcttctttaagttatcacaatctgccttccagtgatatcataatatgcttctttaagttatcacaatctaccttccagtgatatcataccatgtcgtgtaaagcacagtagtatgcttccatttctcccttcctggccattgtattatacattttacttgttacttgttaaaacccctgtactatattgtcattacttttgtttagtcaattaccttttaaaaagatataaataatgaggtaacattacttgcagtgcaggtatactagtgataaattatttcaacttttctctgtaaaagcctgctgccttcatttttgaaagttatctttgaagggtatagattccaggttgacaggtgttttttttttttcttttcagtactttgaaaattgtcattccactgtcttttcacctgcattgtttccagtgaaaaatctgtcatcctcatctttgttcctctgtatgtaatgtcttttcttctcctctgttgcctttaggactttttcttgatcacttgttttgagcaatttgattatgatgtgcctttgtgtagttttcctcatgtttcttgagcttcttggatacgtggatagttttaaccaaatttggaaaaattttggccatcattttttcaaatatttttgccacaatttttttgtcttctcccctcttctcccttggggagttacatataatattagaccatctgcatttgtcccgtcgctcacaaatgcccattttttttttcttttggtactttaaagaaatctcttacattttacattggatagtttcttttcttttcttttttttgaggtggagttcagtggtgtgactttggctcactgcaaccactgtctcctgggttcgagtgattctcctgcttcagcctcccaagtagcagggattacaggtgtgtgccaccatacccagctaatttttttgtatttttagtatagacagggtttcaccatgttggccaagctggtcttgaactcctgacctcaaataatctgcgcacctcggcctcccaaaatgctgggatcacaggcttgagtcatcatgcctagccacattggttattttctattgctaacccttcgagttcactaatctcttcttctgcaaggtctaatctgccatcaatcttttccagcataattttcatctcagacactgtggtccttatctctaaaagtcccctttggtcttttataaaaaatcttccatgtctctacttaagatgttcaatctttcttctaactttttgaacacttggaatatagttataataactactgcaatgtccttgtctgttaattctaacatcttctggttcagtttttattgttatttatcttcattgtgagttatatttccttgcttctttgcataactgaacatttttgattggatgccagacagtgtaaaatttaccttgttaaatgctggatatttttgtgttcccataaataatcttgagctttgttctaagacacagttgagttacctggaagcagtttgatcctttcaggttttgcttttgagatttgttagataggaaaagcagcatttagtctagggttcattactccctactactgattcaagacacttctgagtactctatctaatgacccctgatatatgtgttttctagtctggctggtaggaaatgatgttattcccagttctctgagttccctttgttttgggtggctgtctctccatccttgggtagttttcttacctgcatctgctgatcagtactctgcagaatattaaagggaaactctctgaagatctctggagttctctctctgcagctctctcttctctgctaccttgctttctgaactctattatcatctttccagactcttagtgctgtctcttcaactgaagagtcagccagctcttccttggttcttccttcctgtgccatggcctagaaactctcaaagcagtatgctgagttcagtttgttttcctttcctggggattactatcttttggttcctgatgtcccatgtcttaaaaatcattatttcatatattttatctgtttctatagttgttttaggagaaagggtaaatctagaacctattactccatcttggctgaaagtaaaagccataggtttattttttatgctacagctactccaaacactttataaacaataacttatcacaatgcaaaccacatagtataaactttgctctgctatatataatggtttgtaatacccaattacaaagatgcctctgtgaagaattattagttctttggtattccaataaaagataaaatatttgtgaggtttgttatctggaatcattttttaaatggaattagaatagcattctaaataacacaattcagttataatgaccctaagccacggggtaagatcgagttcacctggcttctgtcaatgactaggaaattgctgctaaattctttattatctagtaagaagacaaatattttctattctggcttcttattagtccttcattttcgtggaatgttttcaggattttcttatctcccatatagggtctcaattctgatttgttttctccattcttagttttcaaattattattctttctcctaccacactgagtctcctcaattagtctatagaaattattgagttaaaaatcataatagcttgcatgtataaggaaacactcaaaacttggtggagcatttaatgttctaggtcacggatggtgtgttcaattcataaaaagtaggagatttataagggacatctcatttttccagttcatttatgggtaatacatattaatgtgcctacaccaagatagaagcttgtgttgaaagaaacaaagccataaattctttaatgaaacatgaaatgaaagaaaataaaaagagaaatgaaagtgaagtgcagtggaaacaggagtggaccaggcatgtttggggcttttggtttagctccagcattgaccaactttgtggatctggacaaactgcctaactgtttaggggcctgcttccatgtttgtaaaatgaaaagcatgaactagaagaccaatagtgttcttccagatctacaattctatgagtctataaaagaaatatacctgattgatcacaaagagcgggatactgtcttttttaactgagagaagctagttttctttgaccttctaaagaccattttgtgccgttatattgttgttgatgttgcatggcttaacaaaactgcccctgcagagctggttacagggaatggggtggacaacaaatatacaaggaaaccacagccttctgggagagtagaaactaggacccaaacccctgctctttctgggctctaagatggttgaagttctcaagagtagactccatattctgctaacagggcaggtttagaaaaacaaagatacagcaacataagcatcccaagttgatgaaataggctgtgacagtcacataaacatgggcatctgctttttgggctaaacttacttgagagctttggaaaacactgaaaaagtattagttttgttcatcaaatggtataatctaaaatatatcactttcgtggagctgttgttagactaacctgactgaagattttcttgaatatattacattatttctggataataattctttatgccatgtcagtattactttcttccccttggcctttacctacccctccttgttggttcctcttcaaacataatggaacatacctttctgctttctttaaaaatcagtcagcccttctcaacctccaattatcatgggtgcattgctatgggttgaatgtttgtcccctatgaaaatcatgttgaaacttaatccccaatgtggcagcattaagacatagggccttcaagagatgattgggacatgaaggccctgccctcatggattaatgaattaatgggttattgaaggagtgcattagttatcatgagagtgggtttgttacaaaagtcactttggccctctctcatgagctccctcaccatgtgatgccctgtgccaccttgggattctgcagacagtcctcatcagcaagaaggccctcaccagatgcggcccctagacctcgaacttgccagcctctagaactgtaagaaataattttctttatacattactcagtcttaggtattcagttagagtatcagaaaacaggctaagacaggtgctcttctatgaactccctccaatttgtctgcttttgactggccaatgccaaactgaattctgcttctcctgtttccactaggttttcttttttcacttgccttgctaatattaaacaacattcccctccgccccccactcctccatgcagcaaatcctgaaatctgcagcaggacccatgggatctaagaatgaaatggtttatagtgagtaacagaacccagaatagcatggaggagtatgacagccagtctttaagcattagacaacgtgttaaagtatgtagacattagctgaaatcagattgtaaggaagctttccaaaggttctgatttgggttttggctggatctcattcttccttttgcaggccaaaaaacccagctgcacatgtacatacacatataccccaatcatctcatcatatggttcagcagtaaaagtaaatcactattattttatcatagtatattcatccccttaagaagctacacagaccacaactcttattactcgaaggtatagtattaatgaatacagacttactcattaactcactcattgactcttcattcattatcgggtcatattcagaaatgaaaatgtctaatagttctgcaggtaaaagtataaagcaaaaaagtaaaaaaaaaaaaaaaaaaccaacaaaaaaatcacagtgggatctgaaaagctgcaattcacaaaaaagtagaatgttaagattttcagacaacctgtcatgtctagagtgcttcagatgaaaagaaatgaatatgccttgcaggtaatgaaaaagaccaaattataaaccatttcacttgaaattcaaactacatttctcccagaaacagtgcattaagtaaatacttctgtgaatcaaacactaaattatttagtaattgctgagtaaattcctgctcttataaaacatgcttttaaaaaaagttatttactgtaaaactgtaagggttagttcttataaaagaaagttttcaagtctatagacattttagagtgcacagtgctataaaaattacttacttattacttttggattggaaacactttctaatgcatcaagactaaaacttcttactttaagtgaaaagcaatccaatttcagtattttctaatggaaaactgcagtgcttgtcacttaatgtccctaatgccttagatagctaaagtaagggccctgactgacatggagcagctaaaacgttttgtgttccttatttactcaaacactccatctgcctgcatcctagttagtgccaagggaactgaaatttaaggctgttgttaggaggaagcacttgcaattgtatcatcaaatccttaatagctctgaatggttctcgtaattcagtataaacttctattttccttgaccttctaggggaaagttcaatgttcaaaaactgacaatggtttttactgcactgctgaaaaatataccaaaaactttaaaaaggaacagttgtaacaagtcccaattttttttgctaatttttgttattattgctgcttgtttattctttcaaataggccaaaataaaaaataacccaaatttccaaaatatctggtaataaacttgtggcaactactagcacttttcctatatttaaatgtaatcgacatcggtcaggcgcggtggctcatgcctgtaatcccagcactttgagaggccgaggtgggcagattgcttgaggccaggagttggagaccagcctggtcaacatggtgaaaccctgtctctactaaaaatacaaaaattagctgggtatattagtgcatgcctgtaatcccagctactcaggaggctgaggcacaagaattgcttgaacccaggaggcaaaggttgcagtgagccaagatcgtgccactgcactccagcctgggcgacagagcaagactccgtttcaaaaatgaatgaacgaatgaacgaatttaaccaaaatggagagtcacagtctgatacggaaactgaggtggaagaaatattagaatgttggtagcagactgtatgtattggtccaaaggtaataaagaattaaagatatatagccactaacctagaaacaataagaaagtttgacaatatcaagtgcattgatggtcagatcaacttctttggaaaacagtttggcattatctagcaaagttgaagatatgcatagattatgaccgaataattccatgcctaggttataccctagagatactcctggatatctgtaacagaaactctgtataaagagtgttcacagaattgttcagaataactcccaactggaaacaacatcatgtctatccgtagcagaatgcagaaatacactgagatatatttatatattcatataacggaacaaagcaaattagagccacatgcagcaacgtggaggagttgcacaaacctaatgctgaatactgagctacagaaacaagacacaggataataacatacaatctggtttcatgtatgtcaaattcaaaaatggataaaaaacatctagggatatatactgttatggagtgatatggtttggatctgtgtccctgtccaaatctcatgttcaattgtaatccccgatgctggaggtggggcctggtgggaggtgactggatcataggggaggtttctcgtggtttaacaccatcccccttggagctgttgcctcaatagtgagttatcataagacgtagttgtttaaaaagtgtgtggcactttccccctcctctcttccctcctcctgctctggccacatgaagacgcctgctccagctttgccttccactgtgattgtaagtttcctgaggcctccccacaagcagataccaccatgcttcctgtacagcctgcagaaccatgaaccaattaaacctcttttctttataaattactcagtctcaggtatttctttatagcagtgtgagaactaacacatggagtaaatgtgtcctctcaaaattcgtatgtggaaatcctaatccccagtataatggtatttggaggtggggcctttgggagtgattgggttataagggtagagccctcacgaatgggattaatgtccttataagagaacccctcttactctctttctgccatgtgaggacacaagaagatggctgtctgcaaacctggaagacagcccttaccaagaactggacaatgctggcatcctgatcttagacttctaacttccggaactgtgagaaataaatgtttgttgtttgagccacccagcctatggtactttgttatggcagcctgaattaagacatatacaaaggtggcaaaactataaagaaaagactcagaatagaggctccatttagagcgaggcagtgttcaccagaaagggacaccgtggggtttcaggggtgctgttgcatgctctatttcttgacatgagtgacaggtaaacatattcccactttaagttatacatttgttttatgcacttttctacatctactatatatatatatatcccagctcccccaaattaaagactgtaggagaatgttaacaactcaagtattgagcacctcctttaggttctgtgacttaatcacaaaggtcctagggtgcgctttgggcttcaaatgaaaaaaaacacacccacaccttaaatcctacaacttatggtcaggaaggtccttaaaggcaatcaaatctaaccaattccaagttgtacgttttcagtaataatctacaaaaatgggccaaatacagggatgaggccttttgggagatggtaagaaatctgagcccaggcctttgctttgcagtaaaacttttttcagagatctcgtgttttgtcttctctcttgttaaaaccaaatcacttcatgcacttctatttccttatctatgcaaggaggaaataaactaggtgactttttagttctagtttctatggttctatgaaagtataggaactttaggaaaatcctgaaacatgagcttttctaactgtggttcctgagaagactttttaaggaagctagagatgctcaaaagaacacaactggctggaagggaaaaatgccatcacataacttttgagagagatgaagaagaggggaagacccatccaataacagtgtgaactttcccccttataaacagagtcaacccaaaggatgaatcaaaggtcaactttcacacattaatggaacacagtgcccatcagtactgagcaatagttcggcattctctttccatggccaaaacagtgctctggtgtgcaggtcagcgtctccctcaaaagccgtcttaggtatgtggctctggaattaagcggggtgtccatcctctcctcttgtctccacccagcgatgtcagatgagactaccccgtttagcgggccagagagaaggctacaactgggatttaacaatagcatggtgcataaactgtcatctcaaaaaggagatgaaatcagcgggtgaaagggagcccatgtcaggccatccaaggggcatgattactgttagtggtggttggtggtggtggggcagtgggtgtgtggaccagggagaaaatgtgcaatttagccatgggcagatttggatatgcagctttgtgatcatcgcactggtcttttttatatgttgatgcttgcttttgcttcttttgtgtaaccccccagttaagagtaaagccaaagcctccatctattcttctgggataggtcattttctactcttggcaagccttcttttctatattgtcacttccagtttgtctctggtattacttctttgtgtctatgttctccatttatattcacttctcatacattaatctctgcttcctattagcatgtgcttcatgcctattaggagttagaggacagagaaaagtcatttcttttctgcatttctctttatcagggcatctgtgtgaaatattctctcccagtgtccccttccctccccttgtagccagagaaatattaccctagagcttcacgctgctaatgtgagaagaaattgtgaacagtgattaggaggctaaatgagggtggtggaacctatttacttcattaaagttccttcagggaaaatacgaggatgggaaactgagagataagggttaatactaaaagaataacagatccatttgactcagagcaatcttcagtctgcctggattctatcagacacccttctccatggggaaatcattacagagaaatgacatgcaaagtgcgccataaagcatctgagtcaaaccagagggaggatgactcaacggatcattttacattttaatagaaggcactgcagatttgtacctagtgcacagttcaacacagggctcataactcctccccaaaacttcttcatcgggtgggaggggagttcccagaacctgacagaaattattctgtcttagaaaaaaaccaagtcaaaactcacaacagagaatcaagactaagaaaagacaacagatagtcaaatgccgaaaagaggggagactgcaagtctaatttcaactttagcatttctgtcaaacctaagacacagcctgaaaattgagctcagtaattagtggacttcagatgtcataaaggagtggggaagatggaaggaggaatggagggagagagaggaaagaggagaacgctatcaaagtgctataattaaataattgtgtttcttaaattagttttgcaagattttccaatgataattactgtcagaagtttgcccaccaggtcagtgacaatgctgggcttgagtttccatgtgaagtcaagaagcaatatattagtcatgccattgttcctagtatgtttcccaggccaggtattgcttatagatgctaatatgtataacctgccaaagttagattcatctgaccagggattatgatgttaagagactggattgtcaaacctaactccttcttggaatgggggtgggggttacctccagacacacttttgtctgcctatacataaagaatatctatagtttcacagctgttcatccgcctgatctctactgttgcctgccccagctcctaagagggcacgcggtttacaggtaggaaaggaaacagaagtgaatactgaggcttggcagaaatacagctttcacagaaaagattcttaataaaaggaaacttgctcctttcatgcatgggggtcttttggacaaaatgattctgttctgaaacatcatctctgcagggatgcaggctagaacgaatgaagtttagattgcaagttggttcacccggtaactaagaaaatcgaaattcaagaccaaaggcaggcagcatctaatggggtgaaagtcatctagcttgagggtcattcaggtagtgttttgagaaaggtttgatttccactggagcctaggcacacctgaaacccactcctgtttttccatttaaaaatgatgaaaaccatgaggctaagaccactggttggcagtctgttaagtcccatatcaagtaacaaaagcatctggaccacctgtcaccaagcaggaggtcaaatggaactggaatgttaacacgcaggtcaaatgcccttcagagaacacggggaaaaggcagtgaaaaggaatgggagaaaaagaatgtgcttggagctttccaagtccctgtcctgtccttggcagcttctcagaatgacgattattgtgaccaaaaggtagtgacacacatgctacatgacacttagtatactgtttaagatacagacggtcttatatgcctataccactgccactcacacacgatttcacctcacagaatatgcttcagataaagccaagtatattaaggaagagatttttttttaattcactcattataaaaagtcagaattgtactgccatgggggcagacaataccccctctccaaacggtaaggaatgggtgccacaagggctcattggccaggtggtaccggagagacacagtgtttcgcactttcttgactctaaaatgcacctattttccatttctccttccatccttagatagaggggctccatttgaatccctgctctcctgcttcctagctgcatggctttggctttggggccattgttagactgtgtaatccttggtctttctatgtacaaaatacttatgtgaggattaaacgagatgaagcaataaagtatttaggatggtccttgttttacagtaaacacaaataaaagctattcttatgaaaagaaagttaatttctttgcacattatatacacttgtaattctacatatgctgaaaatttcttatattgaggcaaatctggactgcatgaagaataatgtatatttttgtttgccagattctcttgcttaaacctggggaagggccaatttgcttaatttccatccaagacctgcaagagaatgatgggataggtgtgcattctggtacttgctggcaacttcggccatgacactatgtagacttccttctgcaacatcccttgatgactgtgaaggtcaaataaggcaacagatctgagacctccctgagaagtgcagagtactctgctcgcatcaggaattatcctcaccactatttgactaatcctacacataattatataaagaatgtctgctcttatgggcacttagccctgatatagttcactctcatgccaaaagaaggcatctggcagatgggggacttgtattgattctcatctgataacatttcctaaaagattccattccttcagatttgttaaaagtgcgtgctttggatactctatcctcccattacgggcttttcctattttctctctctgctaccttttgcatgtatgttctgcccaaatcagaatcctctttcatcatgaggggcaggatcctgcagtggtgacaggtcaggctctggggccagcctgcctgcatctgaaccatgaccacaatgctacctcagacaaaccacgtgagctctctgtaaagatttctcatctgtaatccagtggtcacaaggcgtaagcaacttaaaacacaaacgtgggaaacagaatgactcctggagaatagtaagcacccattagatactgcatacaaagatggtctacagaggcaaggtagtgcagtggttgtggatggaggctctggtgccagcctacctggctttgaattctgactctgtcattcactagctgcaaaaccttgcacaagacacttaacttttccgtgcctcagtttcctgatctgtactaaaagtacctgataaagggcacctatctcatagaactgtgaggattaaaatattttacgtgtttgtttgttcattaattcaccaatttaacatatagtaactggtccatcaaattagctcctcttttccaaccatgccaattttccccattcacgtttcatttccagtttgacaatggcttgccttttcttcacgtaagtatttcctgcttttggccctgcccacctaacacccagactctcccggcctgcttcctatctctggaaataacaatagttctctaactgcatagatttagggtaaccacagcaggttcagcgatctgcattttaaccccatgacagctgatttcaaacaaccctacaaactaagactccccgccctgccattccaagaacgaggggacttgggcaatttatttaagtccttagagtctccttatgtgtgaaatgaagataaagactgtctcccgagagactgttaggagatgtaaatgtgatggctcaatccctggcctcctcaggtctctgtgcagacatcacattctcagtgaggcctccctaaccaccctgctccgtttaaaccacaaccccagcctcccacctcactctccatcctccctccctgtttatgtttctttataacgttttcacatctcacacacactatattttactcatattttgttaatgacctatttttctattgagggcaggaatttttacctgttttgctcaccattgaagccgcagaacttcaaagtgctacactcaatacatacttaataagaaagtgactaaaaaagacttttcctaatcccaacaggtccatatgtcacttctgtttctgctgaggtctccttccagcctgtttcttcacacatatccctacgctctccagagctgcttgtcttttctgggcctcaaggtcgccttgcctatccatttatccacagaaaacttactccattctaagcaatgcgaccgttagagaaaactaatgatataacctccaagacacacagccaagataatgggatggtacaaaagcaaaagaaaggcttagattgacacagtgaaggaaaagctcccatttgcagagatgctgagtagaaggtcttgagtgtgctttatttctgaagctctctgtgctcaaatactcacaaatccagaaacacattgcccattggctctatacaatgtggatccttgcagagtagaattaggctgttctctcctggtaaaagcttgtgtgctcttgcttctaagagatggctctgatcccacccccttatgtccacggcctatctcaaactgccaaacagaggaccaattatgcccttcctttccgcagccctcaggaaaacagccagcacacaggaccctcaatggcaccctcaggatgatgctttcagaatgtgacagcgaccacagcccaggcctctgctgccctgggagtagacgtggctctggaaggcctgggtttgagagaagatggtaggaggaaggtttctgattttcgaatgaaaatcagaccagcagggttttttgaaaagatcaacaacattgatagaccgctagcaagactaatcaagaagaaaagagagaagaatcaaatagacgcaataaaaaatgacaaaggggatatcaccaccgatgccacagaaatacaaactaccatcagagaatacgataaacacctctacgcaaataaactagaaaatctagaagaaatggataaattccttgacacatacaccctcccaagactaaaccaggaacaagttgaatctctgaatagaccaataacaggttctgaaattgaggcaataattaatagcttaccaaccaaaaaaagtccaggaccagatggattcacagccgaattctaccagaggtacaaggaggggctggtaccattccttctgaaactattccaatcaatagaaaaagagggaatcctccctgactcattttatgaggccagcatcatcctgataccaaagcctggcagagacacaacaaaaaaagagaattttagaccaatatccttgatgaacattgatgcaaaaatcctcaagaaaatactggcaaaacaaatccagcagcacatcaaaaagcttatccaccatgatcaagtgggcttcatccctgggatgcaaggctggttcaacatacgcaaatcaataaacataatccaacatataaacagaaccaatgacaaaaaccacatgattatctcaatagatgcagaaaaggcctttgacaaaattcaacaaccttcatgctaaaaattctcaataaattaggtattgatgggacatatctcaaaataataagagctatctatgacaaacccacagccaatatcatactgaatgggcaaaaactggaagcattccctttgaaaattggcacaagacagggatgccctctctcaccactcctattcaacatagtgttggaagttctggccagggcaaccaggcaggagaaggaaataaagggtattcaattaggaaaagaggaagtcaaattgtccctctttgcagatgacatgattgtatatctagaaaaccccatcttctcagcccaaaatctccttaagctgataggcaacttcagcaaagtctcaggatacaaaatcaatgtgcaaaaatcatgagcattcttatacaccaataacagacaaacagagagccaaatcatgagtgaactcccattcacaattgcttcaaagagaataaaatacttaggaatccaacatacaagggatgtgaaggacctcttcaaggagaactacaagccactgctcaatgaaataaaagaggatataaacaaatggaagaacattccatgctcatgggtaggaagaatcaatatcatgaaaatggccatactgcccaaagtaatttatagattcagtgccatccccatcaagctaccaatgactttcttcacagaattggaaaaaactactttaaagttcatacggaaacaaaaaaagagcccgcattgccaagtcaatcctaagccaaaagaacaaagctggaggcatcatgctacctgacttcaaactatactacaaggctacagtaaccaaaacagcatggtactggtaccaagacagacatatagaccaatggaacagaacagagtcctcagaaataatgccgcatatctacaaccatctgatctttgacaaacctgacaaaaacaagcaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctaaaagaaaacctaggcaataccattcaggacataggcatgggcaagtacttcatgtctaaaacaccaaaagcaatggcaacaaaagccaaaattgacaaacgggatctaattaaactaaagagcttctgcacagcaaaagaaactaccatcagagtgaacaggcaacctacagaattggaggaaatttttgtaatctactcatctgacaaaaggctaatatccagaatctataatgaactccaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacattggttagaatggccatcattaaaaagtcaggaaacaacaggtgctggagaggatgtggagaaacaggaacacttttacactgttggtgggactgtaaactagttcaatcattgtggaagtcagtgtggcgattcctcagggatccagaactagaaatactatttgacccagcaattccattactgggtatatacccgaaggattataaatcatgctgctattaagacacatgcacatgtatgtttattggggcactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctcagcaaactatcgcaaggacaaaaaaccaaacgctgcatgttctcactcataggtgcgaattgaacaatgagaacatatggacacaggaaggggaacatcacacactggggcctgttttggggaggagggaggggggaggaatagcattttgagatatacctaatgttaaatgacgtgttactggatgcagcacaccaacatggcacatgtatacatatgtaactaacctgcacgttgtgcacatgtaccctgaaacttaaataaaaaaaaaaaaaaaaaaagaaaatcagaccagcaggaaggccacagagcaacttttcctcacgcacaggaatgtgctttagttctactcacagtggtctgatgacaaagtcctctttaataacttataatttggaattgtaagacattggacccaacacaaccaatgtaaaaacaaaccactcatgatcttcctgggaaaatggaggtgcatttatataggaacagtcttctgtggatggttttctgagcagcttagcaaagaattgattaaataacagcatatgcgttgttaaattccctattacaatgctttcaaaattctttgaaagaaaaagatgctcacctgttaaaaaaaaacgtaagtttctaaaggagacacttgaaaaccagaaaggagcatcaccttcttaaaaaaaaatcaaaatggcacagcagaagttcacataaaatgcccgacaatgtttcttttcaatagaactcaagctgactaaaagacatgcttggattcagagcttttactggttacctaggttgcaaatgataccaaaagagacactaggaattcttagttagaatgccagtcaaggaaaagttcataatcctttcagattttaaatcctgtgtgtctgtgaggaggataaccatttagtattttagacaactggaaaagaagattagaccacactgtgtctataaagttgtgctacaccctgggttaccctcatcaaaggctgaaggaaatggctgttattctctttttgaaactgtagttatatggtgactgctggttatttagttagaatggaaaactgatacacagagaagcataccaaccgtatctaatgtattagcctgatattaacaactagcatctgattacttacaattgaccgtatttgaaatctattaaaatctcttaattattcttatatgcccatagtcactgctttctcttaaggcaacatgaaatgcttaatgattaatataacaatttcaaaagctttattgtacagactggactagactctgtagtcttcacagagtgatcattacttaatgaactcagcacactgtacattttccagccacctgaaactcccaagtattgtgtgagtttttggccaattaattatcaattacaacatcataaaacattagcacaaaaataggaataatgaaatttaattatacattattcttctgagttgctgaaaataatatacaagactgattctgattaataattcattcagcaataaagtatcaggaaagataattatgcagtgccacaattctcacactgatttctataattacagattacaacagtgttagcaatttaaaaggttagagagctgtggtaatttgctatgtcatcctcagctatattaatgtctctctttgagcaccaaagataactgaaaatataataatggaccaaatcagatggcttgcccatgctctcctcacctaaaacatctccaatctgagaacattagtaaagtccttgataattagcctcttatattatttaactagtcctactacacacatttggtttacagctaatcaaagaaagacaatatgtaggaatacatgccaaaatatgcaaacatagaaacataacctatagaaaagttacagggatacaatcacatttggtatgtgacatatctgaccatgaatacacatatatgtatacctgtataattaccccttagataattaaacaccaagtcaagggacacacataatgtaaatctctgtctctggcaacacagttgagtaaatagcacatgaaaaaatacaaagtttatctaactaccctctctgggttgttaacatattatgacacaccaaactactcttgcctttaagttctattacatcctgagaatgaaaatacactcagctgctagaaatactcactctgctctgcttgcattccatgggaaaaaacctagctagaaatttatggcctcttcccataaccagtatttaaatgagaattttcacctggggatgagcccaagtgaactaaacatacagttccacagatataaaaatcactttctcctctgctctttcttctcgctatttttagagaggagatttgtaagacatcttggctttactctcttgaatgccttaagtatctgactaacttcatgttcaactaatatggagaaacagatggaaaattcaccgggactaaaatcttaggcattatttaaatgagttccttgcagagtcttttgtgtgtcttgttgggaccgggggttcctcattctggagtatgccagggtttgaattcaagatttcattacagctggccccaacaagatgataaaggaagacagggtgaaaaaacagtttcatttcagtggtagaaagaacttgtagatcatctgattgaatatgctcttttaaaaattatagacgtttaggctcaaagatattaaacaatttactcaaggtcgcagaaccatttagtaacaataacagaagaaaaactcaagcatgtctgaatcccaggtttccactatattttattaaagaaaatacccaaggagaaggggcatgatgagcagcatatggagacaatttttgttctaaaattaagcccatttacttacatttcatttctacgaaggggttatgtgtaagattgggggtgggtagaggaagaaccattctaagagaacaccatagaactgtagctcttcatgtatttccttaagtgaaaataaaatgggtttcctttgagtcacaaaaataattctaaaacagggcattgcttctcatcagctttttttttctgggctacatgcaggcagttggcacaagatcatatggtaggacaccacactagatataaattcccttcaccttttttcacctacttccttttattcccagcagggcagtaaaacaggctccctgcatatccctgcaaatttgctcttggattcagaagtagacccctagcaggtgatattgttcccttgttaaagtagcagacattcaagcttgtaacaggggataaaaatggcaagtggactttggtcccacatttgcaaggtcctgtatcattttgtactttgaattttttctaacatattatgaacaatttcaaatttacagaaacatttaaagaattttacagtgaacacctacatacccatcacttagattccacgattaacattttattatgcttatttcattacacatccatccatctatatccatcagatttttttcaaagcatatcaaagtaaactgcagaaatcagcacactttcccctaaacatttcagcaggatattacttgctagagtttaagattagtttatagtttttttcttttgaggcaaaatttacatacaatgaaatgtacaaatcttaagtgtgtattcattgagttttgacaaatacatatacccatgtaaaccaaatcttatcaatctatagactataaccatcaccccagaaagatcccttatactccatcccagtcattcccctcctccaaaggcaatcagtgctccagtttgtctaacagactaattgtctgccctaaaacagttgaattttgaaactttaagtagctaagtgttctgtttttcttctttcagtcaacacaaactgagcacctaaaacgagacacacacttaaagccagtaacaacaaaataattattccattaaattaggaaaataccttccatggtggtgagaaccatgggattcattatacttcaagggcaatttagatgcacaaccaaaagggaagacacataccacaccctgcggctgttactcatttggaaacttgctgactcttcaatagtaaattaaaatccatacccatgcccagtgaaaaatggggctatgcaggatccttggattaagtgtgaaaaatgaggaggctttttaaaaaagcccatcttcaaaccaatatcatcgctttatgatgaagatgaactgttataacatgccaagcctgtaacctacaaagacacagccccgagttttacacaactataaaatcatgaaggaggctagtaaaggagccaaaaggctcttcatttattttctttaaacttaactacagtagtcagtgtggattaggccctcattttccagcagctgaattattgtcaaggtgctaacactcttggtggaaacagcattggattacctacctctttctgcaagagctcaacagcacgcttcacatatcagtcactaaaactgcattaaaaggctctcctacagcaactctgatactcttttaaaagttcattaacccctgttgtggattgaatcacaatattctccctccctccaaaagaaatgttgaagccctaacctcctgtagctcagaatgtggccttatttggaaataatatcattgcagatgtaattagttaagatggggtcatactggagtagggtaggcctctcatccaatatcatgggtgtccttttaaaatgaactccatatggagacagagacacagggagaacaacaccatgtgaagatggaggcagaggtgagagtgatgtggctacaagccaaggaatgccaaagatgaatggtcagcaccagaagctaggaagaaggaaggaagagttcttccctataggtttcagagggagcatgaccctgccaacatcctgattttggacttctaacctctagaactgtgaggcaatacatttctgttgtaaggcatccagtttgtggtactttgttatggaagccttaggaaactagaacaaccttaaagaagattttcccctttttggtaattgttttaaacaaaagtgtaatttacatgcagaaaagtataccaaccataagggcacaatcaatgattttctttcaagtagacgcattcatgtaaccaccacccaaatgaagactattatcagcaccccagaattctccttcatgccccatcccagttgttatttccaccaacagaactgctaattctaacttccttcaccttagttttctctttttgaactttaaagaaataatatataattttttgtgtgtctggcttcttgtgctcaacattatgtttgtgaggttcatccatgttgttgtgtataagagtggtttcttctaaagatggtttgaaaaatatcattaagtttttcttttgttttgctttggttggttcaaatttcctaaaatgaataaaatggtaaatactgaaattctccaaaaatctcccaatcccagcttcccagccatccagttccattttctagaggccacgagtgtctcttgtgtatccttccagagagaactgatgcctatttaagcaaagatatatatatttatagatagatctttgtccttttttttacacagaagtttacatatggcccgggcatggtggctcacacttgtaatcccagcactttgggaggctgaggtgggtggatcatgaggtcaggagttcaagaccagcctggccgacatggtgaaaccctgtctctctactaaaaatacaaaaaattagctgggtgtggtggtggacacttgtaatcccagctactcaggaggctgaggcaagagaatcacttgaacccaggagggagaggttgcagtgagctgagattgcaccactgcaccccagcctgggaaacaagagtgaaactccgtctccaaaaaaaaaaaaaaaagtttacatactaagccatgatctgcaccctgctttcacttaaaaatatagtttcttcattcttgttttatggtttcataatacttgactagaaggtcatagtacaatttatataaccaattctctattggcagctatccgggttgtagtcagtatgtgttattataaacaaggttgtaacgtgtaatcttgtaattttgtacacatatccatacattctcctaaatgtgaaattactggatcaaaggatataaactttgtagttttgatactgccaaattgtcctccattgggacagtaccaatttatactcctgccagcaatgtacaagagtacttttttttttgagatggagtctcactgtgtcgcccaggctggaatgcagaggcgcgatcttggctcagtgcaatgtccgcgtcccaggttcaagcgattctccagcctcagcctcctgagtagtcgggaccacaggtgcgtgctaccacggccggctaattttttgtattttcagtagagacggggtttcatcgtgttagccaggatggtctctatctcctgacctcgtgatctgctcgcctcggcctcccaaaatgctgggattacaggcataagccactgcgcctggccaagagtacttctttatccatagtcttgctaatagattatattaccaaacttaaaaacaaaacaaaacaaaaaacccctgcctgtttggcaagtaaaaaacagcgtttaattatagttttaatttgcattaatttttaataaatgacactgatatatttcatgtttatgaacagctatttatatttccacatctgtaaattgttaatagtcttactattcttttaatttttttcccctattgcattgttggtctttttctgccttggagaagctctttaaatattagggaaatcagttctatctctagatgagttgcaaaaatatttttccttctttgtcacttttttttttttttggccgtggtttatggtggtatttgctgctcagaaatttttgatttttgtgtcattgaattcattttatgactttccctttgtggtttctggatttttgtcatactttgaaaggccttcccaacttataaacaattttctcctgaatccttttagaacttttacggttaaatttttttcccaagtaagttttggaaccatttaggatttatcttggtgtaaatatgaaccaccaaactttctttttcccagaaggctatttaattgtcccagcaccatttattgaacatccttttttatcacactgatttgagatgcttccttaatgtaaactaaaatttcaaatgtatttgagattatttctggactctataaggtgccactgacttgcccattaatgccaattcaaatatatgagtacgtttgtagtatattttaatatctaaagagcaattttctctctttttattcttggctatttttgattttttttttttacatgaacttcagcatcagcttgtttggttacaaaatattctgttggtatttttactgcattcacattaaatttgtgatgttgaggttttctgtccaaggacatggattgtctttccatttattcacatctttgttttttctcttcatctcaggaggattttaaaacagtttcatttatttacaagaataaagatttacatcttaaggagttcttgagttcaattcctatatttatacacattacatatatatatatacacatgtgtatatattttatttgaacttttcttttttgctattgtaaataggatattaacttccattatatcttctaatcagctgttgatcacatatatgaagaatgtttagttttacataatccattagtacataatgggttgttattgttaccaccatcttccagctgattcacagaagaaagcatactatccaagtgtgcaatcatatcatctgcaaataacaaacattagtttaacctcgtccttttgactttttacacttctactttctttctcttgtactgcacaggctaagtacgttcagaacaatgttaaagaaataacaatgggcgcccttgtcttcattgtttctgacatggcttctggtgtttccctattactgggtatattcctttgggcatacacccagtaatgggactgctgggccaaatggtagctaatttgactctgcaatcccataaacactacatctactaaagcgtgatgctaattttataataaataatatatataataataattttatgttaaggaggtatccatcacttctgattttataaagtggtttttaatgaaaatagatgttgaattacatcaatgcctttgcagcatctatgaacatgatcaaataagtgttccttaaagatctattaatatgataaattatattaaaagatttttccaatatttatcactcctggaatgaacctcatttggttatggtacactgttctttcaaaatggtgctaggctctgtttgctaatattttatttagaattttacaattgtgttcttctatggtggttggtctgatggattatcctgctctttagaagtcagtgactaaattatattttcttagacaattatggatttttaaatttatctgtaaaaagttgagtaaaacaggctttatgattcctttgtaatcttttatttaccttatttttattatttcctctattttattaatcaagtcagctaaagtttccttgattgtgttgaggttttcaaacaacatgcttttgcatttattaattcttcaatttttcagtttttgaattcaggattttttgatatacttttatttccttcctgctatattttaagtttgttttattattcttttctaacgttttgagttagacacttaattcatttatttctatttttcttatttgccaaaataaatattttaggccacggcttctcttctgaccactgctttaagctgcagctcctggattctgctaaaaacacactgacacactgacacagatacttacctaaacattgcatataaataaactatgggaaactgatcatttaaaaagatgttagaaaagaccactaaaggaacccagcagtaagtctgttgtagggtgaagaataattctttttatttttatttttttgagacagggtcttgctctgtcacccaggctggagtgcagtggcgcaatcatgggtcactgcaacctccgccttttgggctcaagcagttctccctcctcagcttcccgaatagctgggactatgggtacgggacactgcactcagctagttttttgtattttttttttttggtagagacagggtttggccatgttgcccaggctggtattgactgaactcctgggctcatccactcacctcggcctcccaaagtgctggaattacaggcacgaccactgtgcccagccaagaataatccttttgctgccattcatggtgtattgaccaggtgcaccaggcacagtgtgggctactgtgagaataaacatgaaggggtctctgtctttccatcagtaaggaaaccacacatgagcacataaaaacacatactcacatatacaatatcacagaaacataaggacaagtcatacaaaccataaagagatacaaactttcacataaaataatttcccttcttctgctcaaaacatacatacctataatctttaataggcattcatttaatttatactgacctaagttgctcttccaacttaaaagcagttcacaataacaatatttgtttttgcatagaatatgggtcagaagagatgtagaaaggcttgttgggtagctcttgtaacagtctaggtgagtgatgatgatggcttggactagtgaggaagcataagagtggcaaccacggcctgatttggcatgaatttcaaaggtacagagaggtacagttgataggatttgctaatggactggatgtggggtgagagagaatgaaaagagttaagggtaactttgagaatttcagcttctgcaattacatgaatgagggtgtcatttactgtaagggaaaactccaggggaggatcatgtttgggggctggggttgaaataaattgttgcttcctggtagttcatctatccaagctcactgttatggtttgaatgtgtcccccaaaagttcatgtgttggcaacttaatccttgcgacagcagtgttgagaggtgggacctttaggaggtgattgggtcatgagggttctgtcttcattaatggattaatgagggagtgagtctgttataacaggagtgggtctttataaaagccattttggccatgtctcataacctccctcaccatgtgatgccagcctccagaactggaagaaaataccttacctttccttttcctcttccccctttcctttcctttcttcccttcctctctccctccctcccttcctccctcccttcctctctctcctccctcactccctttctttcttttcaaattactcagtttcagatattaacttacagcaacagaaaacaaactaagacactcatctcattcacctctcccataagttggttatattcaagtgtcactgacctttgtcctatcacagctccatgctgttgcatgttccgtttccacccaaagtgtcctgcctactcttctctgtctggcaaacacctgctcatccttcaagaataatctcaaatgtcagctcctttggttacctttctgactcctgcaggcacagttgggagattcatgctggagctttccagcctcccagccatctcagtctcacaaaattgcttatgtgtctgtctctgtcacctggttaagttccccaaggacagaagtcatgcttttttcttcttttttccctggagcacaatgcctgaaacaaagatggctactcaataagtgttttcattcattccatcaatattgatggagtgtctaccatgtataacacatgatgccatgtactgttctaggtacctgaggatatagcaatgaacaaagcaaagttgtgcttgtcatggagccttcattccattggagaaaagggcaatatacacacaaacgaatgaatctacaataatgtgctgtagaggaaaaaaataaggcagggcaagagcagtgaaggatgtgggcggtgaggtcctgttttaaatactgcagtcgtggaagatctcatttaggcagattctaaatgaagtgagggagtaaaccatgcagatatctgggaaaagagccttcctggcagaaataaacagctggttcaatggccctacagcaggagtaggcttgatgctctgatgactcaaaaggccagagtgcatggaggatagtggccagcgaaagctgcagaggtagtcaggaagtgaagggcatgcagttcgaggtaggagtttgggttttactctaagtgttatgagaagccagagtaggcaagtgataggatctgatttacactttaaaagattcctttggcttccatatggaaaatgggttgctgtagggtcagactggaagcaagaaagcatgttaggaggctcctgcagcagtcctggtaagcatgatgatggactgaactatggaaggagcagaaaagtggtgacaaagtgcctggatttgacaggtggagctgacgggatttgctagtggattggatgtggggtgagagaacggaaagagttaacgatggcaccaaggatttcagcttaagtgaccagatgaatgggggtgtcatttattgaaagaggaaaccccagaggaggatcaggtatgggggatgagggcagaacaagtgttggttttggatatgacaactttgaggagttgattagacagccctgtggaggtaagcaactgaacacagcctgattctagagagataaatttgggagccattagtatgcagatggtatttaaaagccacaagactggatgagatcaccagggagtaagcttatgtgggctgaatgaatgaataagcaagtttatgctcaggaaggaaactgttatcaggttgataacatctgactctacagagactggacaaatagataataaacacagggatgaaagggcacagaattaatttttttccatgtctagatggctaatccagacttttcccttacatgcgcagaaaagcctgcatcctaaattattgaggacaaagcagaccgcatgactctgtggagcagtttccactgcttggcttgtgtgcaaggtgtgtcagcctacttcaggcgtcttggtaactaagcacttttctgggtgagcatcttatcacagcatgttgtgcaggctggaacccatgagagtgagtccttcaggaaagaaacgacatcaacagatgtacacaacacgtttcaaattaataaaggtggggggaagatcacaaatacaacatctgtaacactgtacgtgcaacttgtcatctctattgaagaaacaggcaggtaagcttccacaactaagataaaataatctttgccgtaagtccgagataagttgcattgaatttggggtagttaagctgtatttctcaaaagtcaaaaccaagtcagtgggttcaccaaattcttttggttacttcaaatatcatattaccaataccaaaaacttctcaggcccacaggactctcatcccatgtaaaaacactaaaaggatggtgatgcaagaggtatcccactgtgaaaaattccttttgcatactttctaaaattaatatttctttccaagtacacagggttttgtctgccacttattttgctttttaatcatgaggcactaaaagttggcacatttttaaaggtgccagcttccatggacttttaaaatttccattcattcccatagtcttacaggcttctctcccctaaaaaccatgaggactctgttcatatctgctcccctgctccactatgatcaaagatattcctctgtatctctgtgtaatactcaaaacaggaaataaagaccccaaaatgaagcctcagtatctcatgtcttccccagtgtcccatccacgtctgaaagagtgaaagctctgttttagaatgactgctggctgccaatgagagctctggatacgttgacatggatgaacgaaaacacactcaaaaaagagcaaaattgtgtggaaacttggaaacatggaaagattcagtcatttaagcatctaagaaacatttagtatgtgtctaccacatgccagccactttgctaagtgctgggtcacaaacacaagcctctggagctcataatatagtggctaacgagacaaatgccatcaaggacagatgagactcttcccagcaatggcaatgcctaaactgaattctgaaggacaaaacagaaattatctaagggaaggcacagagggagaatcagttaatatttgtggatccctaactgcattctcccttgtaagcctggtactaggtatacaaagatgaatatggtacacctcctccccaaaagaagacaaaagacatagtagctattttgaaatttcaaaggagctagccagaagcagcatccgatttttctgggtgaacctgtgggtgatatcaatatggaaggtactaaggcaggagcacactggagagttgattccatgggctctttcagatgttttttccacagacctatagagacgcttttgtaaacaagttcaagtttacgagcattcaaaaatgaatgcatcagagctactagaatttggtgacttttttttttttaacactgtaattacaagaataaagggaaggatgaagctaaaccatattcttatgcccaagcaactcattaacagaggccaagcccaggccaattgcccatgtaatttctttctttctttctttctttttttgagacagagattcactactgtcacccaggctggagtgcaatggcatgatcttggctcactgcaacctctgcctccgggttcaagcgattctcctgcctcagcctcctgagtagctgggattacaggcatctgccattacgcaggctaatttttgtatttttaggggtttcaccatgttggccaggctggtctcgaactcctgacttcaggtgatctgcccgccttggcctcccaaagtgctgggattacaggcgtgagccactgtgcctgtcctgcccatgttatttctacaaacctttatcctcttggtgctttcaggaagttatcagggatggggggcagaggtggcaggggcctataatgtaactgttctgtgctgtacagccaggttcctttccggttgctggtgagaatccaatgtcagctagagttatactggcacgtccatggtcctggaaaggccttggaaaggctgaggcaggcaaatgcttctccacagatgccctaccccacctcgttcattctcttggatgtcagtgctcttctgctaacagaacctatacttcatgccccatttccccgaatcacttctttcctctactcatacagtatccttgatgaagctgagcaccttcgagtgtccgcagtttttgaaagccgtggctgtcttataataacccatcctgacgttcctaggagtatttatattctgagggtgagttaagttagtggataattgtggtaaagaaaggccttgtcagtgcctcctgtagagtcacaccatcaaaccctggggtatgctggggcctgagttctctccagcaaaccccaaaaccagaacttgggttggcactccactttattttccaagttatggatctcagggctggcaaacacaatcctagacaattgattctcaaaggtctcaaatcatctggtgtctaaagggctaatctaggggctcccctgaaagtctcttggtaaatctctccttaaagatttcaaataaaacctgaagcaaacagagcacctgtctagatgataagaggcctgattcatattccattctattgctgacttgtgacacctagaaattcagtcgtagcttttctgtggcatattctatgaagtgagggtataataaccgagattagtttcaggtctaggtctttctattttttttttatttatatatttagagacaggttctcactctgttgcacagactggtgtgcagtggtgtgatcatagctcactgcagccttgaattcctgggctcaaggaatcctcttgcctcagccacctgagttgctagaactacaggtgtgcataaccatgtgcagctaatttttgtgtttttcgtagagacagggtctcactatattgcccaggctggtcttgaactcctggcctcaagcaatcctcctgccttggtatcccttgggcctaagccttcatgctgccatggcatgtcatcagacatggtatttcacgcttgtttcaaccaggaaccagggcaaaggaaaggtctttggtgtcaatgcaatacaaaactttatgttaatttgccattgtggcagttcctaggaaagatcctaagaacttctgggcaaaaggctgaagaaatataatggtttcttgggaattgagggttgaggtaaacatttctaaaatgtgcaaaaaagttaattttgaaaatctgctgctcatttgttataacttcagagtttcaattttaattattttaaaaattccctctaacaagcacactttctgaatgactactgcctcatcatttggcagccaactcttgaaaccttggcactctgagcaataattatgagtatgtcttaatgtgtatccattgagttactgcttgcctgggaagaagctgaaggatgtaagttaaatttttggctctaacactcactagctctttagatttgtaacagctcttgttgaccttcagatactttttctgtaaaaaggggtaaacagaacccaacttgcagggttctagtgaggattgtgttaatgtaagcaaaatggggaactcaaaagttccttttgttgttatacagagaatccagagtaagcaaaaaatagctagttgcagctatgaggccatctgatgagaaatgatgaaaaaccaactccatatgcaccatctcaatctgatccaatcattccataaacttttattgagtgctcagatgccaagttattattttaagttttgtagacagttactatattgaacaggacagacaaagtccctacattcttaggtcttatattctagctgggaaaaacagacaataaatgtatgtaagtaaacaataaactactaagtagtgataagtgttataaaaacaaaatagggtgctatgataggaagtcactgggtgactacggatgacagacctctctgaggtcatgacatttaaactgagatctcaatgacgcgaagaagagagccacaggagggtctctggcaatgaatctctgtgtggtctgtggaacccctgggaatcccgagaccctttcagaatgccagtgaagtcaattttattttcatggtcatactaagatgctgtatgtctttttcacagtgttgacatgagcactgctggtgcaaacgtaatggtgggtaaaactgctggcatctcagcatgaaacaaagcagtggcaccaaactatcagttcttcactaccatatactcaccatagaacagggtgacagtttcacttataaagggacttgatcaagcagtaaaaattattatttgtactaaatctcaacacataacattttaacactctgtgtgacaaaatgagatgtgctcataaagtacttttgctgcaaaccaaagtaagattgtcatcccaaggaaaagcatttgtgggattcagcggcaagctgcacaagtaactgttttcagagaacaccatttttacttgaaagaatgactgacaaactaaggttactcagacttgggcatttgggagacattttcttgaaattgaacaaggtgagtgagctgtcacttcaaggaaaacaactgacagtatttgttgccactgataaaatctaagctttcaaataaaaacgtgatttttggaaaatgtgtatttcctactgtaagcttggcagcttccccaaatttgagaggcttttctgttaagaatgataataacattaataggtgattttttttgaacattaaaatagtgtcatcattttgaagatctgtgtaagctgataaagcaacatgttccaatcatacaaaatcatacttggtaaaagatttgatgtgcaaggcagagtaatgaattttaatataatggagtttgaaaagttcattgatatggctttagattccatattgcaactaacttttaagaagttaccacttgtcaaattttaacgtaatatcgaagaagaacacccacaatatttgaaaaacctattaactctatccttgtccaaatacacatctgtgaggctgaattttttcatataatgaaacaaaaatgacatatcacaagattgaacactaaaagagatattagaatctaaatgtcttctagtatgctggacattaaaggtattggggaaaatacaaaacaatgcaattcttttcacttttatcttgaaaaatatagttttttcataaagatatgttattcatgttaacatgtagtgagcttattactgtgattttaaaattaactaatagatactttaaatgttcagttttaatttctaataaggtaaatatagataaaacccaaataaacgaaagctctttggggttctcggtaatttttttttttttgagatggaatcttgctctgtcgcccagcctggagtgcaatggcgcgatctcggttcactgcaacctccatctcctgggttcaagcgattctctcctgcttcagcctcccaagtagttgggattacaggtgcctactaccatgcccagctaatttttgtagttttagtagagatggggtttcaccatgttggccaggctggtcttgaactcctgacctcaggtgatccatccacctcagcctcccaaagtgctgggattacaggcttttacaggctggtaatttttaagagtataaagggattctgaaaccaaaattttgagaacaattgacctgagcatattaaacaatacaattttagtttatttaggtcttgcataagttctgttagatttgttctgaggtacttaaatttttgttattatcattaataactttttaaacattacttttctgtgttactggtatataaggcaattaatttttattgatatatattgtatattgatcttatatccagtcactgtgctaaactttctcactggacttactcttttacatcagtcttactgttagtacaggactggcaaattatgatcctgtagactagatacagtctaccatgtttttaaaacaacaatttataggaacagagctctatccacccatttacgtattatctatagctgcttttgcactacagtggcagagttgagtagtagtgagagagactatggcccacaaagtcaaaaatatttactatatgcctttttacaaaaaaagtttaccaaaccctgtattatgaactccattcacagaaccaacttttggctctgttgataccctacatagtatttacaatttcaatttaattaattctgttctcatctttattcatccttcctttctcattcgtctttttttttaccttctcaaagttagcttcttaattttcactttttccttttctagtaacaaacctgcacgttcagcacatgtatcccagaacttaaaataaaaaataaaaataagaaaaacacttgagactataaattttcctccaagtacaacttttactgtatcccacaagttgatatatcatattttcattatcattcaattctaagtattttaaattttccattattacatctttgatcaatgaattattttaaaatgttaaaaaatttccacatataaggggaattttggggagtttatgttttagttaccgaattctaattaaattgtattatgatcagataatgtggtcattatactgattcttggaaatctgttgagacttgttttaggggcatagtatgagggcaagttttgtaattcttccatatgaagaacacatatattctatttgtttgatgcaagattctatgaatcaaactattcagttgtactgcttcaatgttatatttctttactaattatttgttatgtgcttgaccaagcaatatcttggagaaacatgaaatttctctatagttttattagtttttgttttacatgttttgatgcaatatagaaatgttatacctttccagtgaattaaaaccttatcaataggtagtgctctctctatcctgatttttttttgccttaaagtcttttatctatctatctatctatttatttttgagacagggtctttctctgttacccaggctggagttcagtggcatgatcttggctcactgcaacctccgtctcctgggttcaagcgattctcatgcctcagcctcccgagcagttgggattacaggtgcaggccagcatgcctggctaatttttcatatttttagtagagacagggtttcgccatgttggccaggctggtcttgaactcctggcctcaagtgatctgcctgcctcagtctcccaaagtgctggggttacaggcatgagccaccacacccagcccttaaagtctattttgactgatatcaacaaagctacatagctcctttttgattggtatttgctcgaatacgaattgttaaatgtgtatttctctaaacactgtatagctgaattggtattatattttttaaaaaatcttaatgtttactctattttttagccagaaagtttaggcaatttacatatattgtgattgctgatatatctgcatttgtttttataatattattttctatttgtcctactttcctatgctttatgtattttttctttcttttttgatttttaaaaatcaggcttagaagttatacactagttcttttcttttagcagttacccttgaaatccaaagttagtagtttaaccccttcagaacaacaaaaggaacttataatgcaaactctgattatctccttcctcatatatagggagttttacacagtattttaaaccagcaatatttgtttagatttgcctacatgtttaccaatttctttgcttacaatttctatttttcagaccttttgctatctcttttcttctttctgaagtatacgctttttttttcttttatttagagacagggttgtactttgtcatccaagctggagtacagtggtgtgatcaaggctcactgcagtcttcaactcctgtgctctagtgattctcccgcctcagcctcctgagtagctaggactacaggtatacaccacccatttggctaatttatttatttatttttgtagagctagggtctcactgtattgtgcagactggtcttgaactggcctcaagcaatcttcctggcttgacctcccaaaatgctgggattacaggtgtgtgtcaccatacccagcctgaagtatattctttcaagttccttcagtgtaagtctgctggtggtaaactcccttaggttttgtacgtctgaagaaaatacttcactctcattttgaaggttatttttgctgaaaacacaattttaagtcgaaaatcattttctctcagaactttgaaaatatttcatcatctcctggatttagtcattgctgttgagaagtctgctgtcagtctaagtattgttcctctgtggatgtggtctgttttccctatggctccttttaagagagctgtcttcagtgattcacagttttactacggtataaaaagttgtgaaggcctttttatttgtctgtttagatacactgcttcctatatctctggatcagtatttctcattgaaaaattctggaatgccggtggggaggagccaagatggccgaataggaacagctccggtctacagctcccagcgtgagcgatgcagaagatgggtgatttctgcatttccaactgaggtaccgggttcatctcactggggagtgccagatagtaggtgcaggacagtgggtgcagcgcaccgtgcacgagccaaagcagggggaggcatcgcctcactcgggaagtgcaaggggtcagggaattcccttttgtagtcaaagaaagcggtgacagacggcacctggaaaatcaggtcacttccaccctaatactgcgcttttcaaatgggcttaaaaaatggcacaccaggagattatatcccgcacgtggctcagagggtcctacgcccatggagtctcactcaccgctagcacagcagtctgagatcaaactgcaaggcggcagcgaggctgggggaggggcgcccaccactgccaagttagttgtttgattaggtaaacaaagcggcagggaagctcgaactgggtggagcccaccacagctcaaggaggcctgcctgcctctgtaggctccacctctgggggcagggcacagacaaacaaaaagacagcagtaacctctgcagacttaaatgtccctctctgacagctttgaagagagtagtggttctcccagcacacagcttgagatctgagaacgggcatactgcctccttaagtgggtccctgacccccgaggagcctaactgggaggcaccccccagtagaggcgggctgacacctcacacagccgggtactcctctgagacaaaacttccagaggaaccatcaggcagcagcatctgtggttcaccaatatctgctgttctgcagccaccgctgctgatacccaggcaaacaaggtctggagtggacctctagcaaactccaacagacctgcagctgagggtcctgtctgttagaaggaaaactaacaaacggaaaggacatccacaccaaaaacccatctgtaagtcaccatcattaaagaccaaaggtagataaaaccacaaagatgtgaaaaaaacagagcagaaaaactggaaactctaaaaatcagagtgcctctcctccttcaaaggaacacagctcctcaccagcaatggaacaaagctggatggagaatgactttgctgagttgagagaagaaggcttcagatgatcaaactactctgagctacaggaggagctttgaaccaatggcaaagaagttaaaagctttgaaaaaaaattagacgaacggataactagaataatcaatgcagagaagtccgtaaaggacccgatggagctgaaaaccaaggcacgagagctacatgtcgaatgcagaagcctcagtagccgattcgatcaactggaagaaagggtatcagtgatggaagacaaaatgaatgaaatgaagcaagaagagaagttcagagaaaaaagaataaaaagaaacgaacaaagccttcaagaaatatgggactatgtgaaaagaccaaatgtacatctgactggtatacctgaaagtgacggggagaatggaaccaagttggaaaacactctgcaggatattatccaggagaacttccccaatgtagcaaggcaggccaacattcagattcaggaaatacagagaacgccacaaagatactcctcgagaagagcaactccaagacacgtaattgtcaagattcaccaaagttgaaatgaaggaaaaaatgttaagggcagccagagagaaaggtcaggttacccacaaagggaagcccaacagactaacagctgatctctcggcagaaactctacaagccagaagagtggggaccaatattcaacattcttaaagaaagaattttcaacccagaatctcatatccagccaaactaagcttcataagtgaaggagaaataaaatactttacagacaagcaaatgctgagagattttgtcaccaccaggcctgccctaaaagagctcctgcaggaagcactaaacatggaaaggaacaactggtaccagccactgcaaaaacataccaaattgtaaagaccatcaaggctaggaagaaactgcatcaactaaccagcaaaagaaccagctaacatcataatgacaggatcaaattcacacataacaatattaactttaaatgtaaatgggctaaatgctccaattaaaagacacagactggcaaattggataaagagtcaagacctatcagtgtgctgtattcaggaaacccatctcacgtgcagagacacacataggctccaaataaagggatggaggaagatctaccaagcaaatggaaaacaaaaaaaggcaggggttgcaatcctagtctctgataaaacagactttaaacaaacaaagatcaaaagagacaaagaaggccattacataatggtaaagggatcaattcaacaagaagagctaactatcctaaatatatatgcacccaatacagcagcacccagattcataaagcaagtcctgagtgacctacaaagagacttagactcccacacaataataatgggagactttaacatcccactgtcaacatcagacagatcaacgagacagaaagttaacaaggatacccaggaattgaactcagctctgcaccaagcggacctaatagacatctacagaactctccaccccaaatcaacagaatatacattcttttcagcaccacaccacacctactccaaaattgaccacatagttggaagtaaagcactcctcagcaaatgtagaagaacagaaattataacaaactgtctctcagaccacagtgcaatcaaactagaaatcaggattaagaaactcactcaaaactgctcaactacatggaaactgaacaacctgctcctgaatgactactgggtaaataatgaaatgaaggcagaaataaagatgttctttgaaatcaacgaggacaaagacacaacataccagaatcgctgggacacattcaaagcagtgtgtagagggaaatttatagcactaaatgcccacaagagaaagcaggagagatctaaaattgacaccctaacgtcacaattaaaagaactagaaaagcaagagcaaacacattcaaaagctagcagaaggcaagaaataaccgagatcagagcagaactgaaggaaatagagacacaaaaaacccttcaaaaaatgaatgaatccaggagctggttttttgaaaagatcaacaacattgatagactgctagcaagactaatcaagaagaaaagagagaagaatcaaatagacgcaataaaaaatcataaaggggatatcaccaccaatcccacagaaatacaaactaccatcagagaatatgataaacacctctacgcaaataaactagaaaatctagaagaaacggataaattcctcgacacatacatcctcccaagactaaaccaggaacaagttgaatctctgaatagaccaataacaggagctgaaattgaggcaataatcaatagcttacgaaccaaaaaaagtccaggaaccaggtggattcacagccgaattctaccagaggtacaaagaggagctggtaccattccttctgaaactattccaatcaacagaaaaagagggaatcctccctaactcattttatgaggccagcatcatcctgacaccaaagcctggcagagacacaacaaaaaaagagaattttagaccaatatccttgatgaacattgatgcaaaaatcctcaagaaaatactggcaaactgaatccagcagcacatcaaaaagcttatccaccatgatcaagtgggcttcatccctgggatgcaaggctggttcaacatacacaaatcagtaaacgtaatccaacatataaacagaaccaaagacaaaaatcacgattatctcaatagatgcagaaaaggcctttgacaaaattcaacaatgcttcatgctaaaaactctcaataaattagggattgatgggacgtatctcaaaataataagagctatctatgacaaacccacagccaatatcatactgaatgggcaaaaactggaagcattccctttgaaaactggcacaagacagggatgcccgttctcaccactcctattcaacatagtgttggaagttctggccagggcaattaggcaggagaaggaaataaagggtattcaattaggaaaagaggaagtcaaattgtccctctttgcagatgacatgactgtatatctagaaaaccccactgtctcagcacaaaatctccttaagctgataagcaacttcagcaaagtctcaggatacaaaatcaatgtacaaaatccacaagcattcttatacaccaataacagacaaacagagagccaaatcatgagtgaactcccattcacaattgcttcaaagagaataaaatacctgggaatccaacttacaagggatatgaaggagctcttcaaggagaactacaaaccactgctcagtgaaataaaagaggatataaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttcaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaagacagacatatagatcaatggaacagaacagagtcctcagaaataatgccgcatatctacaactatctgatctttgacaaacctgacaaaaacaagaaatggggaaaggattccctatttaataaatggtgctgggaaaactggttagccatatgtagaaagctgaaactggatcccttccttacaccttatacaaaaattaattcaagatggattaaagacttaaatgttagacctaaaaccataaaaaccctagaagaaaacttaggcattaccattcaggacacaggcatgggcaaggacttcatgtctgaaacaccaaaagcaatggcaacaaaagacaaaattgacaaatgggatctaattaaactaaagagcttctgcacagcaaaagaaactaccatcagagtgaacaggcaacctacagaacgggagaaaagttttgcaagctactcatctgacaaagggctaatatccagaatctacaatgaactccaacaaatttacaagaaaaaaacaaacaaccccatcaacaagtgggcaaaggatatgaacagacacttctcaaaagaagacatttatgcagccaaaagacacacgaaaaaatgctcatcatcactggccatcagaggaatacaaatcaaaaccacaaggagataccatctcaaaccagttagaatggcgatcattaaaaagtcaggaaacaacaggtgctggagaggatgtggagaaataggaacacttttacactgttggtaggactgtaaactagttcaaccattgtggaagtcagtgtggtgattcctcagggatctaggactagaaataccatttgacccagccatcccattactgggtatatacccaaaggattataaatcatgctgctataaagacacatgcacacgtatgtttattgcagcactattcacaatagcaaagacttggtaccaacccaaatgtccaacaatgatagactggattaagaaaatgtggcacatatacaccatggaatactatgcagccataaaaaatgatgagttcatgtcctttgtagggacatggatcaagttggaaaccattattctcagcaaactatcacaaggacaaaaaaccaaacaccgcatgttctcactcataggtgggaatggaacaatgagaacacatggacacaggaaggggaacaacacacaccagggactgttgtggggtggggggaggggggagggatagcattaggagatatacctaatgctaaatgacgagttaatgggtgcagcacaccaacatggcacatgtatacgtatgtaacgaagctgcacgtcgtgcacatgtaccctaaaacttaaagtataataacagtaaaaaaaaaaacaaagaaaacaaacaaacaaaaaacacaaaagataaaactcttcacttaaaaaaaaagaaaaattctgagccacaatctctttaaacattgtctcatctccattctgcatatttttgttgcctttcacgctctaaataggctttagttaggcttgcttattctgccctccaaacttattaacctctcttccttatagttccatctctttgtctgtgctccattgcatgaaactattttagttttattttccagttcattaattagtccattacaaaaaagcttatccactaaattttttgataatttttttttattactgaaggttttctttagctctttttcagaagtgcctggtgattgtgagagaccattgttgttcaccattcaccatttttgtagtctatatttaagttaatttttctttatataaggtagtctagtttcttcttatctgatacttcaaacatctaaagcccttggtggggaaggagtaattaatatattaacgctagttttgctgattttcactcacggtggtttgtttccttgtttgataatcttttttgaaagctcaagatcccaatctgtgaaaaaaaactagaagcctaaattacatttgctttatctggaatttagtggtactaccaacctgggctattttatctcccttctagaatcccaggcttaaactgggagttgcagtacggtccccatttgcacccccacatgaccgtcacacacaaacacaagggatggccaattctgccttttctggcttgtttactgttgacatatatgcacttagctacttgtattttttttcttagatattttcattacttcctaggagttctaaaatgcaacagagatatcctttggagtacaaagtctgttatactggcagaagaagaggtcctctttaaaagtttttagaaagtaggagagtgacatctgattgttgcttttgaagagctttttctagattctctgtaagaatgaactgcagggaggcaggaatgaaagcagagccaggtaggaggctaatgtagtagttcaggtgagaaattgaagcaacatgtctgagagaagtagcagaggagacagaaagaggtgaaatgactcgatatctgattgggcataaaacaggaggagcttttgatagtttggatgtggaaggtgaggtacaggatccctggttgatggctggtggtgtcatttcatttattgagataagaataattgggagatggacagtttccagtgtttgtgtaggttagggcgtgggtagaaattaagagttctgttttgaatatgttaagtttgaaatgattatcaaacatccaagtggacatgtcaagtaccctgttgggtatctaagtctgatatttaggggagagagctgggctgaagatataaattggggagttgctgccataaaggtttgggagcagaggagataacaagtgagagtgcagagagaaaacatagggacagactgagcctcagggcacaccaattcagaaactaacagaggaggagacagcagtggtgattgagaaggaaaaaaaaatccacgagaggagctgtcatggaggctcagagaaaagtgggttccaggaagaagggagtgattgactgtgctggaagctattgagaagctgaggaagatgcggcaacaaggtggtcattggtagctttgatctgaacagttctggtgaagcagtggtgtcagagactttaatggagtgtgtcaaggataacaggagatgagtctagataatacctatagacaagaagttcgaagtgttttgtgtgaaagggagcagtaaagtggagtagaagctaaaggagaatgtgacacaagaagttttttcctggggcagtattaaagattttatatgccaatgggaaagatttagtacaaagggagaaactgatcatgcaggaaagaaagggaatattttcagggaaaatactcttcaaagattaagcacccacaagtctttaagaggtgacgtggaacatgtgtgtggcgtgagccatcatatgacctacaagacagaagggctaggacacctatattacataaggacttgggagctgagtaatctttatttgccaagttctcatgaggtctactccaccctagcttcaaatttacccatgtcacaacggctagtggtagaagctaaagaatatatctgataattatgatctgaaagttgtttgggtagttataaaagtaggtgattaactcaatatacagctaaagaggtcttagaggacttctagtttggtctcgtatccactttaggcaactgaatcctaaaggtcttagaatggacacctcactatcccttgggaattacttctaggatgctgtcacaatgccacgtatttagcacaaatagcaatttcctcttgttttgtgattaatggtcataggatacagctgaactgtaattttcttcacccaaagacctttatgtatttgaaattagaaattaactttactttttcttctctaagccaaacaacctctttctcttgattttcctttacagatcttatcttgtatcatttggctaatcttgcctctttcccttctctccaactgttttttttttttccctaaagtgtagtgaccagcaattgacaaactactcaaacaaagtctgaataatcctgagagcagtgtgggtatttcaacacgtctcctttagacagatgaaaggctgacctggctctgccaagacttgaacacattccagttcctgctgatctgagaagtctcttccacttgcgtttttcttcttttacctggcaatttgaataaaatgaaaatacaaccagatgtatagggaaaagagtttttagtgtacctattctttaaaatcagcttgagctttatgtaaaagtcaaaatgtgcacataccaattccttctaaaatgtaacaaatatctgaatataccaataaaatgttttgtctctcaactgcatattccacaaagtatttcttaaaatccaaaagcaagtattcagatgaggtaattaattaagtgaagtgttgggtttggaaagccttctactattttgaggctaatgatggttgagaaactcctatgggggtgtgtgtgtgacagagattctgcctgctaattacttcccaagaaaaatctaagcatccaacaatcattctaatttttcctaagaagcatgaaatatcacatcacattacattatgttatgccaagtaacaggatgttcttggggtaaacatgacaaaacaatacagctggaaaaaacaaattgaaaggccaaatgatgtgcatataattttgggtaggtagtgctataaaaagaaagaaaaaggtgcacactgataataagacttagaggtgacttacaggttttgatacccacaggtgattttaggaaggcagctttgttttaaccataagattaatgccataagctttggctcttttacttatatttgtttcactctgaacaagcattggagcccttttgaacttcaattttttcctctgtaaaatgggaatactactacccaccctacctctttcatatggctgttgtgagattctaatgcctggcatatttaggtgttttataaatgtctaattggataccgatagatatctgaactggatttaatattctgtatgtcacagattccagtctgtacattttttcatctaatgatatttcagaaataaggatatatcttatagttggtggcttatattttaattaactctttctttcttggtggtacataatatatttaaaccaatggcctcttagaaatatggcaaatgaaagagttgggaaatggcaaaagtgctatgcaaatatcagttatttattcataaaacgaaattttaccaaaagtctcccttatgcaaggcattcagaagaaaatgaaaatgaataagattgggtccttaatctccagaagagtgcaatgcacgaagtggatgactcaggataactcaaatgctaaacagaatgtgatatgtgccatttgagtagcattcacaacttggcaccttgtgaatgcagaagaggaaataactttcagtagggtcaaccaaggaagcagcatggagggggtggcacctggcctggccttgacagatgcgtagtatctcaacaggcacatatgggaaggggagataccctacgcagaaaggacaagtgaggcatggacataggatgcacagcaaatattctgaggaatatggtccagacaagaagcggtccagacaagaaggagcatggggaccatgatgggctgcttgctctaggatattagagatctgggctcaatttggtgaatgggttaggctcctgagcaaggagcagcctgatgaaagtggggcattaggagcctgtacagggggaccagttaagaagaggctggaagcaggggcatcctaaagcaggccttgtgcaggcttgaaaagtccagctaataagtgggtagtaggggtagacaggaaataacaaatggatggtagagccatagttaaacgctaaagatccttaatgagaatcctagagagaaagcccattccacaaatggatagaaaggatgcactgaattgatgtttgactgtgtgctccttgaggatgggaactgcatgctttgtacatcattgtatcccagcacctggtacatggtacttacacaataactatttaatatactcccttcctccaaaaattccatttatatttttaattcaattcagcaagcatgtacctatcacgtgcttgatgctggacactggggtcgggaagaatgggctgatgtggtggactgtttttcaaatggctgcaagaattccttccttacagagtcttgggtggtccctccaaagctgactcggggcttagccataggacttgcttttaccaaaggcataacagaaaacgtaaggtaagcagaaacttggagaaaaaaaaaaaagcctatacattgataaactaacgagttccagtctggacaggttgaatatgaaatccttgaggcatgtccagcaggcagtttggtgtaaagcagtaggtcctgctgccaccccaccccctgccgcccccactttttttttttttttttttttttttttttacccctgagggcatcatataaagaattccaggctagcctcctggaggatgagagaacatgtggaacagagatgagtcatcccaggggaggcctccccagaccaaccatcctagaatggggggtaacaacctttttcttaaaggaccagcaggaaatactttaggcctgtgggccatatgatcatctccattccaaatactcagctctgctgttgtagtgcagaagcagccatagacgatatgggagtggctgtgttccaataaaaccctatttataaaaacaggtggcaggcctgtgggctatggttcgcctacctctatcccagattattcagccccagtcgagccagtccaaactagaagaactgcccagccaactcacagaatcgtgagaaatagtaaatgcttgttgttttaagccactaaatttggaagtgttgttacacagctaatgctaactgatgaaaatggtataaaacacataaagcatacaccctgtttcaaggcacttaaaatccacctgtggaagcacgacacgtgtgggaaacatttaaataaccatagaaggcagtatgtgactaaatgtcaaaatgaatgatgcaggagaattagaattataaggatttataaaagggaaaaatcagtttggacacacaaaaaacttgggcagcatttcataaagaatgggtagaatatgacagttccctaaagattcctgtttccttttcactgcccttctttatgctgcctacttttatgtctatgtaccccagcagactgggagcctcctgagggaaggtcttattttctattttctaggttcccagagtccagtgcagtgcttggttcacagccaggctcagtatgtacttactgaagaaaccaataagtccacaggtggagaggagaaagagcatctatgtggaaaaaccaaacctcatgatcaaagaacactgcacaggaattcacgtggtgcattcaagagaggtgaccagtggctcagggagaagaatgagattggggtaagtagaagctatagctggccatgtgactctgggtcatggggtgggggtgatgaggcaaaatgaaggacactgactttcagggatttgaagctatatgttactggaatatgtgacctagctgacatttatgaagataagtttggtggcagacggtagggtggattccaggcaaggagaatagttaggacaatttactaatccaggaacgagggagcaactagcctgggagatggtgggaatatcaaggtgtcagctcctgataaacaccaaatagagctgatcatgtgcttcagcataaactacaaaagaaaagagagacatctcaggcattccttcatgccacctttactgagtacaaggtattattaagtcatgtgttctgagcccatgaagacactaagtagatctatgttacatttggaaccaagatacataaggtcaaggccaccactatactcatggagaagcacaagacaaccaggaattgtgagtgaggcaactgctagaatgggcagggcacaaggtttgcagtgacacacacagccttagagccgggctccattcttattagctgtgcgatgttggacagaccatgaacaccactgatgatggtattcatcttgcaggctggttgagaattatagaaaggatgggtgacgtgcatagcacagtccctgaatagagcaggcactcgtatgattcacaattacaataaaagcaacatgtaatagggaacacatgaatggtataatctgagtgctgtaatagggcagagaaagaaaaatcacttttggctgggacagtcactttggatttgagagtgagaatagcatgtggtctggtggcaaaaaatgaggacgattttgacaagtaggggaaggggaaggtcgttccaggaaaagaaaacgttctgtggaagggaacagagataaaagacggagcccctcttgtggagtgtggtggaatttagtttggctgttgcaaggtggaaggtgaggctgggaagcaggttagggtcagacagcagagtggcttgaatgccaggaaggggagctgggatgttacgcagtaagtagtgaggtgctgctgaaggatcctgagtgggccagtgacacgatcaaaccccaggtggcactgtgagtggtgtggaggcaggagacactcatgcaaggagggcaggaacaaggtgaggcatgccccttccagggattggccacagcaacggcaggagagggcatgtgagagaggatgcagaggacgagctggccacattgggaaacagtgaaggtcgggaaggagagggtggaggtgaagttcactatgaaatgagaacatagactgactggttgactcattggttcattcagttaagctgccattgagctttgtttgttatgtgctcaacacttctaaatggtggtaatcggctgtgcacaagacatggttgcttctccccaggccagggagtgtcaccaaacacacacgttctttctaaaagactatgcatgcagtgtggtcacagtgtatttatcattgtagctagtccccagagtataccacaggacttgacatatactagatgctcaatgtttattaaactcattcattcactcaacaaatatttattaagcacccattccatgttgggcatagttctaggcaatggggatatatcagtgaatataacaaatatttctgaggttccttgagatctctgtgcattcagtttacacccaaagcataaacaaaatcactgcacttattctaattatgttgtagaattgaagtcagcatttctttgtattttttcctccagagttaaaagatacttattgtgaaagtatcaaacatcccattatggaattaagttcagagcttttaaaaaattgtggtattgattttgagattgaaattaaacatgacatggtacagaatatattcactcaagcaaccatttaggaagacctaatttgtaagctcatctcaggcaccactgagtacagtagtgatgaatcagaaaatccctgtcctcaaaggtctttatattttacaataaaagtccttacatagttagcaccttggttttcaaagtgcttttgcatatgtctcttctcatgtgaatgtcaggacaatgcgggggtgtacacaaggcaagcatttctcttcctgtacctcccatggagacgctgaggcccagggctgctggtgagtcataagctgacccaagagtcaagagccatgctctttccagtagtcagtggctcccagagaaacaccatgctccataaaaggtggggagaaacaggttgttgttgttttttttttttgttttcttggaagggaagaaattcagttttctgacctaaaaattagaaatgactggagcggtaaagttattctgctaagtaaaaagcaacatagctgagtgggagaaaaaccagaagaaattcaacatgttctaagggatgcacctggagagtgtgtggcttctgttctgacttttatatggacaaggataattagcatcgttttcctgtaaactgtattcaaatttccacatgcagcaatgctcccctggattcgcgccgtaatcattacatcacacttacagcatgtaccagtttacaccccggcactaagtaaaatacaatttcctttcttcctttgattattttgccttccttccttctttgcttccctctgtctttctgcttttactgttactcccacatttactgaactagatctcataaggattcctgggcatccacagatgaatgagccacagttcctgatgcttgagtagcagactaggatgggaggaagcctgaagacgggatcctatcattcacttcagtatctgccccacagtccgctgctgggtctgagacaaggacttggttcctgaacactgagtggatggatggaaggatggatgagatgcctgtatccggatggcagtgttccaatttctgactcagtaaaacagttgaaatttatcctccccttcccgttgctttttctgtttcagcaaccccctttcaatgagagaggatgtgaacaagagaatcaaattggcattctgaagctctttatttaaaggcacgtatttagcaatttgctatgtctgagttaatatatgggttaagttccctgtgaatgacactctcctaactttagcaacgtcataaagacaatcagttgctgtgtgtctggcaagttaatgactacaagcccaagggatgcaagaatgggaaaatgttaacgtagaaaaaaagactttaagcaaattcagaggaaaatggaaaaggactcaccactccctccccaaaatgctacacataacatcttgttttgaacaaggaagttatggagaatattattctaaactttgtattcattagaacaatcctttacagaatgcagacaagaaggcgattagggaaattagtaggagataaagaagaaaagagttttaggaaaagatggaagcagaggaggaaggaagaagaaaaagcagagaagaagactccatgctaaggtgacagggaagcaggagaggaatgtgagcatgaggtcaggtctgggggcaggtaaaagagaaccttcggagaacttgactggcagaggtgggtgagaaaggacactcctctcctgtcttcctcagctccagagggtggaatgaggctgacaacacgatcattgtggcagttactctgctgggggcttttatatataacattttatttaatcatccagttcaaagccacctgcaaggaaggaaattatgtccattgtactggtgacaaaactgagtttagaggttgttggtcaaggagcaggggttctggacaagcacccacctacggacagcacactgccatccacaaaggactccttcatcttccttaaacctcaggcaattctgtgaagtgaacaatatcatttccattttgcatggcaagaaatgcaggctttgagggagccactcgcacagctagcaagagaccaggaagcacatggactgggacttgatccagtgctccttctgtttcactaaacagcctccttgaggaagtagctggttcccttcttttcaccccatcctcagctttatcctgtagcctgtggccagatgagtgctgagtaccaggccaagcagacacagcatggcggttggggttgatgtcccacggtcctcctgactgtaattctgcatggagtgaggactctgattctttaaaatcttagggctatctggttcgtgctcccacacagtgcagcagtcttgtctacagcagcccccaaacatagcctaaaaagacaatgactctcattccagtagcagaggttcactgttactaaatgaagccacaggttccactgtgggctagctgtatctggaagaaaattcttgttttgagcccaaatctctttctctataatttcttttagttctgcttttgctagaataacaaatgtctttcagatatctaaatgcagcttttgtgtctccccttgtttttctcttctccaggctaacctttctctgttccttcaaccactggttacaagacagtctctgacaccctctccattcctcatgctgtgttcataaagcactcaagtttgtttgttttccttttctttcctttgttttttgtttgtttttttggggggaagtcagagtcttgctctgtcacccatgctgcagtgcaatgacatgatcatagctcactgcagcctccaactcctggtctcaagcaatcccaccgtcttggctgcccaaagcattggaattacaggcaagagccaccacgtccagtttatgttccttttcaaatgtactggtataatactcctaatgtgatctaagtactgcagagtctaatgaaatcatgactcttccttctgtgggcatgagacctcttttgtcacagttaggataatgttaactttttcagcagccactttgtggaggagaaagctaagtcaccaagctcttgcagtacagcataataagttctgcgaaggaggcagccagtgggctatggcatcacagaggagggacagcaaattttgccagaaaggaacaaagaagccttcttggagatgacacttgaagaacaactcaaagtgagagtaaaccaggtggagagagtggaaggtctttccaggcagatggaaaagattttacaaagatgagctggtgtgagagaacatggcagtacagccttttcttccccattgcttctcttttcaattcctttcttcagcctttctctgacttagcttcactttcggatgttcttttcagttaaggcttgggaagacccttgcataacacaggggttggggcgccgatccccgacgcagtcgaaaatctacatatcacttctgactcttccaaaacttaatagccggctgttggctgaaagcctcactgataacataaatagtccattaacacatattttgtatgttatatgtattatatacctgcaataaagtgagctggaaaaaacaaaatgttattaagaaaatcataagagaaaatacatttcctaagtgagagtggatcatcataaagggcttcatcctcacggtattcacattgagcagactgaggaggaggaagaagagggattggtcttgctgtctcaggggtggcagaggcagaaggggtggaggaggtggaagggaggcagaagaggcaggtacactcagtgtaacttctatcgagaaaaaaatccacgtatatgtggacccacgcacttcaaacctgtgttgtttaagggttaattgtactatgttctcctgttttaagaagtatctgttgcatggagttgaaagttcttcaacttgtttactgtattaagtgagcatcaaatagccaaagcactggcaatgttactataataagtagttttggaggttgtgcctctacttgagtgaactgtttgattaggttagaaaagcaaatggtaccctaagtatcaaaaggcagccaaaggtcactcagggccacaggctggaccacagtgctccagggtctttgccccattatgagctgatctgtttttcccttcaatgcctccagccagcagtgttgaaatgagatattttaggatttccaaactatttctaaggctgttagtcacaaactcttatcaaggcagttttctcaggttggttagcagacaggctcagagcctcacctttgcaggtcaaagctcgagaaaccctccacatgataattcacgcatctgttatttttttacctgtcccttctctgcctttagcttctcagtcatccaaccccgcctctgtgaaaagtgcacaatgactcaaggcttttcttaggcctctgacaggtgaacaaagaaaaacacctttcacaaatccattctatcaagggatagaagaagagagaacagagccttcagtaaagaaccctaaacatcccaccagaaagtcccaaacaaccctgaaaagtgagaataaaactaccaaaagctgacagagggtaacaagcattatttccaacccacacttgtccttctaaaaaaaaccaacccgctactgaaaaaacccctgaaatgtatgaaatctaacatcgttaacatatttcctgtcctcacatagcttataaaaatgtttctgagcttttccctggctcatttacaacgatgagaaggagcaaaaaggaaatgcaacagatggtactgagggaggaggtactaccatcctcgctcacagtcatccatcttcgcagtaagttatccccgcttgggcgaggtttcaaacgtttttcagatgtaccaatggcgtattcttgctcgagaacaatgaagatgaggctcctttaaaaagcttcaggttagaaggcatgtttactactgtctatttttgttgtttctaaaagagatcacctcagctttccctctgaacctccccaaactgactctgcgagaatctaatctggtactgatttagagctgacaggtggtacatgcataattaaagatgacctaacacagaatgctctcattcctggcatattatcagacacttaaggaaagcaattatcagtaggcaatcttttctgtcaacagagatcgagatgaaacatttcttcaattaagagaattctgcaaggatgctgtacatatccatctgcaaatacttgaaaacctttagaggttaatactaagtcagctcaatgaaacacctttggccagttaacacatgctctcctctcctcccacttttcctgggaggtcacatttcaaacatcaaaatcggaacaattttaaggtgctgccagacaccctgacatgagcggacaaggaaatctctgcatttttctgccttgctgaggtctgaaaatataacaagttttccttaaaggttcaaagcaaaaaaggatagggttcacattaaagcaaattcaattaaaatttcccttcagagcaggattattccctctccatgctccacccatgtcagaagtatttagagaattattatcaagccttaaaacttcgtcttgaatctaagtgatttaaaggatttttttctttcattttgaagaaatcaatattactcaaagaaaaaagggacttgacaaaaacggaggaatttcccatttcaggtgaaggagggaagaggtgccgcatttcctgatagaatactgtgctttttataaattatagtgcatgcactttgtataaatgaatgcatttaagctttccttagaacagaaattgctttaatgttatagtgagacaagtgattttcttttcttttttaaaagggtagtttataagttaatggttttttgaagcccatgtaaaaactgccttccacaagacagagaacttcacaatgtttgtggtgcatattttgccacatttcacaagaggtcttattgtttaaattcttatagccttatgtcatatgtgaacaaatgactttattgttcatttgaacatgtctttataggatctctggtggtagagctagtgttgttgtttgcatttttcccctcaacaagccagaacaaaagtctcttttactgaagcgctgggaactcagggacgatggcagtgtggcagcagttgtcagttggaaacaccataatgataatgtaagtgaagtgctcacattaaggggttgacttctgacaagtcaaggtctacagaaaagtttccgctacagcagacattatggtaatgcaaaaacagaagtacttaatagaataattaagaatcatccagtacactattactgcagtagggctcaattcctttcgagatatgctttccttggaagagactccattcagaatattaggggaaaaatatcagtagcctttggggagaacataatcagatgggaggtggaagcgatggcgggatcattaatgggagattcagtaggactcaaagctcaagttcattatattccttagaactaagaatagcttctgaatgagtactcacaattctccacagacctatttctcctaaggagctccccctttctccctttccaattttaatctaagaaaaagaatagaatacagacagacatgggtaggtaagcaggaacaaaggaacctctacagaatggaagagaatctaagctagttccgttttagatgttgttaaatccctttgaccaggattcaatttagaacaactcaaaagatacagtttgacagcatgctgcatcaagaggacaggagaaagaaagaagtcacaggtgtaatgttgtggcaaacaacaaaatgttatttcccagtgcatgtcatggacgaaaagaacatataagatataaggcacatactaccattaaagtaaacagaatacaaaaaggaaagattttagtgagtttatgtagggagagaccctcatttctcacacaactcagagtccctgacttttgtaggacttcagtgaataaagcaaagtctgtaagcacagcctttctatgctgaggatgatatatggcacaaaaacattttacatgatgccttttacacttagatattattttagaatcataaactaaaagcgtttttaaggtggaggtacccggcataaaatagatgtatcttctttttaaccaaggcttctcctgtccacactcaaacctggctttccaagtgtgttggctttactattttatgattggatgaataaaataagactgttaactatggctacaaaataaattacgataccctgaccccaacagagtattattttggaaagaaaaaaagtcaaatccaagatattattatcgtaactgcaatctacttgtgaccctgtttcagaaaacctgccatttggaagccttatggagacatttttcagaatcttatgtattctctctgttaactgatcagagatacttctcaggtttctttcaccaaggacaaaatatgacatatacttaagaaaggatggatattgtttcaggatctctatccattcaggagaagacacttgctttttagttaaaaaatgactgtgactaattccagagcacctggtattggctttttcaagaatgagcatttgaagtcaaactggaaaatggtgactggcacatctgcaatgatctagatgatggtaagagacgatccagagatggtaagagacagataaacccaaaaaggctggcctcactttgctgcagagggataaaagaaaatagaagaagcgaaaaaaatgatttttctctacaagtcccactctaggaatcacctttgttaactttgagttctttcacaaaatgaaatgttatgtgacaatacaatctgtttcccttagggatggaaggtgatgaggggagaccagtgataggtgagatttaaagacacgtaaaggaagggtggaaaagaaatgcattatgttaccgagcgaatgaggattaaatcttcataatgcatgtcagattctcacaaaaagaaaataaaacaagggcaagcttttactgaacacctaatatcacccagctgtgaataaaagaaaaagaatctcactctgaccaattcatacaaattgactaatacttattcccttatggtccatggtaacccatactccaagcacacatgatgttctttcacatgtacacatttgtaactttctgtaaactaattagcgaaggagaatacaaaataggcaggtataatggaaactagtgaattccatccctgaagctagttgtactgtaatatcttctgcatggtgccaacagccccctttccctttgcttgttccgacacaatgccttcaggtctgtctaagtaatgtaatttactagagtggaattccctcggtaccctgtgcagtacttggtgacagtatcatttatactccaccgtgtcgtggcctgacactgatccatccgccttcatccctcattcagaggagagcatgcaatttcaccttcctccgtgcccttctctggtgtgcacgtacacattcactccactcagccctaattacaaacctgggttaaaatactctcattagatttatatttcacactccaaatgtcaatcttgttgaaaattcccgttttccggaggattcatccattagcaataaactttaaagcattctgtgactgagtgcattaaaccagcaatgcggacatgcacttaaaatacatcattagagaaaatctccattgcaaatactttacactattcaaccaaaggaataatgagccccgcctggccagtaccctcaaactgcacatgaaggataagttaaaactggcagttttgcaggaaggagcacacagtgtatccacaggatgcatttcagaatctgtcattccttatgaaagcgtgggagggaatcacagccagagtctaatttatcaccttctctcacctattatttttacagaaacttcggtctatggcaaagggcaagagggacggcgaagataatggggaatatatgagtgtgtacagggaacagaagctgtatctgcaatgccaggaactttgaaagtcacctagaatgatttgctcggcctgaaaagcattcttccatttcgttaacagagaaaagtggagaaagcagcattgtctggagacactggagaagcgggtatcattttaatacaagacagatttccctggcagagttgacctgagaaatgtctttattccagactgatggttcctaacacaaaaaccaaaaatctgatgagaatactaatatataaattataagtcacaagttgtatctgggacagggatggtaggacagactaagaaaaggaaaatttgaagaggattgaaaaacaacccagcaaaatacaacaattaagaaaactaagccaccactgttttatatctgtcctgtattttaattccttagcttataggtttaattcatcacttcttgtcaggtctcaggtgaggcaaagttaagatacagtcataacttctctttaactttgataaatgaagaaacagcattctaggaaagtcctggaggaggttaaagggagactgatttgaagtctcagcatctaatcctgaaggctaacaaaaaagttatgtccacaattatgactttgtactgtgaaatacacaatacactttataatgcaaaactttggtgggtggaaaaggactctagaaggacaggtatacattgtattaaacagaaaataacttgcaaagcataaaaaataaaaataaaagcaacagcaattgttttctacctgtcagcatctggtcaatctgtcagattgttcagtaaccagaattataacagatgcaatattttctgtggggaattacaccaccatggaagctattgctcctgaagttttgcccatttccacctgaaatatttttttagccttacttgattacaacattagcactctctttcataacgtacaccagcaggtactacaattaacatgcacagatgttagaactgaacatccatgtttaaataaaaaacagggagaaggtaaaaattactgaatatgctcaacacagcactaatcttaaaaggaaagagaggcttacattgtgctaacttaacagcaaaataaaaaaaacaacaatcccccagttggcattagtaacctaagaagaagcaaaccactctataaatgcctgtattcttctgaaacactgaaccagaggctgatcttttgtccatttaattccaaaatttgtactccaagaatagaggagaactcccaaatgctctcaaattctccaacacattttatgatgcaactgcacaaatgacgataacaccaacatcattttgtggagtgctggctttgtgctttatgtacgtcatctcactgaatccccacaaccaccctctcattcaggcaggcagtactacttctgttcccattttcaaataaagacacccaggcctaggagaggttaacagatcaaggtcaacaagtagctaagctaagatttgatccggagtctttttttcctcctaaagctctcaactcattgtaaccactgtgccacactgtctgccacagttggggatgccaaagaaaaatgtgatttgcagtcttcatttttcagaatcttctggaactgccctcttgactcatccattttacaaagctcatcagactgaaaggctcagaacacttgcagacattctcattctttggaaatgccacaaccactcagtcagtggaatgggacagcaccatcaatgggattgcgaaggcacaaatttccctgtgaatgctggcgccgcctctctttggtgtttcttctagccacaaacggacacgttatcacttactgtggttgcattcgactcagcagccagatgcaggggagtttttacttggttaactgtccctccaacatctgtgtctacagaagatactacagggcaggcgtgtgctcatccttgtcccttctccctcctccaaccaaacacacaaaaagttttccaatctctagggcaacaccattaagatatcctttccttgctgtgctatgagtttacaagaaataactttctaacaataagccaagaagatggatgttgtaaaactgcatttcaaataaggcaattcctttttaaaaaagattcaagggtttcacgcttctttcttccttccatcaacacaatttgtttatgtatgagttggatctttcttccttcggaagagaaaagtgctgataaactatcatgtgtagacacacaacgcaaaaacttggttgccttttgctatttaaacagagacaaattatttcccaatataccacttaccagacagatgcaaagatgtgggcaaaccagtcatcagaattaacagagtgattttgcttgcactacatattctgatttgtatgactcttatttttagccatgcacaaagggcaataaatggaaaatcttattctaaccgctactttttctgggccacccacactgccccacctaccacacaacttcaaaatgtaaaaaaacccagaccagggtttgtcctaacaagggatgcaaagtggctaaaatgtgtgacattttttccagttagtgtttgtactttcattttttttttttttctgtctcaggactttcagggaaaacaatgttgacttaccaatgggcattttcaaagactctaagttggtatgtcagtcagtgtacagacaacgtgatccgcaaggcacgggcaccaccctgccgtgaaccacatctcagccaatcttccgcaaagaaatgtacccaaaaacttttctgtaaattcaggaaggtgatccacaccttccacattttgttttgaaacaatgatggtattttaaaagttcttcaaattaacaaaagtgatatcagaaatataaacatttctaaaacagagcgggctgtgaggagtgattttgccaaacttaagtcagtagcacttgacttatatctgcttttagtctgcggtggcaccacgcttaccaaggcacagtatccccttgctatccctttccttctgtgcattttttctttctgtatgccttaaccacacttctccacctgataacctgaagcttatcaagcattaattcacacatggttatcactgtggattgaagcatctgatatttagagataaccatcttgacggcaaataataaaaacaaaattgatgaagaggatatttgccaggggcacagagaagatagagatgagagtctatttttgattactatctttccagacttttaataaaaagttattacagtcccaggataccaattaaaatgcttgttcctctgagccctctgcaaaccacaacagcaaacatatgcaggtaacaattaatatttaaaagtctagttcaacaaaatcatcagaatcattaggaaacaaaaggcgtcaaccctgagaaaggcatctttacctgtgtgcctgctcattatccagaaactagaggaaatgttctttcatcgtctggtagttagcacatgccctgcagagctaacaccgtcttcatgcgcggtactcgagcagctctgatgagatgtctcagaaaatcttttttgggtgatagtccactatcgccagaacttctgacttgtgttgtaaaaacacaggcaattaagtattacacaaagtgggtcatacgccactgagacaaccacaccgcccccaaatcagactccaaatgactgtgctgtgacaaggtaggaggggtctgaacgcagcgaaagcaaaacttttatgtggtgaggagcattttagttttcactggtttaggttagagaaagttaatctcaatgtcaactacaaagccaacaaacttttagtgtgttcttgaatttatatgacaaatgctggctgttcatctaatgggaaattcagatccaatgtcataaacagtctgagggacagtctcaggcttaaatgacatgcccatcactaaacaagtgagcactgtgactcagtgaaggaaggcggccaaatcgaaactaaagataaagaaccaaattctcattatccacattagcatctccttctccaaaggaggatcaaagtactgtataccacttccccacacccgtaaccaaccagggcattcaacacaatcgcagatgctacccaaacacccttcaattgctgtaggaaaaaggtcaaatgtagttacctgaattgagcacattcattcatctgtcactgaagagccacagaaatattaatccaatatacactgagttcctattacatacaaggacacagaggacatgaagggatgctctcaaagtcactgctttcaaggaacttaagaatcctttacacgggatgataaaacctagatataaccaatgtcaaagacagactttttcttttttttttaaacaaacaaaatcccttctagcagctagctgcttactaaatacttcctattctacggacataaagtttgtggattacaattctacatttctcagatgaatcttctaacaattccttaaattttaccttggttttctttcagtgctcaaagcccttcctaaccttggccaagtgttaggattcatcctaacctgaaggcctagtactctccaaagggaagcacagagataccagcacaactcaaggagctataaaatcacaccacagcaatcggaagagatgcatctttaaagggggataaaggatgcaaagttaaaggaaaactctgttcacagcacaagaaggcatatatttgaatgaaattttgttaccaaaattataaaatcagaatttgattggagttcatattgtttggattgtgaatgcggaatgggaagatctggctaactcaacctttcccatttctgccaaattgccttatagtacagtgattactaatttctaaataatcagaacacaatcagttgacctaacaccaaagccatcttgtacataactgaatcttcctttatgattccagaggcccactaggatcttacagggccactcactatcattttgactgacagaaggtagaaatgaaaatactggttgacaggaatttccacctgataaagatactagtgagtccacacagctatctgttcttataagagctgattaatataattagaaggaagaaaaaaaaagtaacaaggagatcactgtcctataagatgacacttaaaggcatcattcctaagtgccaccagcttgtaggatgtaatcagtctagagcactgcttgtaaatttggaattagttaattagtttcttgaaaaaagtctggaaaaatacataaaagtatgagttaacaggtaggttatatttgggcagccagattataggtaatttatctctacctttattcaattttctgctattttataaattatgtagaatacatgtatcactttgataataaggaaaacaaagctacttctgttcagataaaaggaaacaattattttctgattgtggttctgtctagaaatcaagaacacttcatcaataagtttctgacactttctgtcaagaaatcaaggacccagcatactaatctgaactgaactgatgacaagtaaggcacagaatacaggaaaaacatgctagaaataacagattatagcttctaattaagcaccgcaaggactctaaaaatcttgctatcctgcaaagctttgtaaatactgttctggggcagaagagcagaagtgcttttcctcctcatgacgcacagtctgtgcaacttccagctgccacaaggctgcaggcacacactcttacaagatctagctaatgggacatccttggaaaaacatgctgcaatgccctgggttaaatctgggctcacagagaggcatcatttcactagtgacaggtgcatccaaaaaagagcacacaaaccatttcttaaaaatcaacagattggaaactattagaataaattgataaacaatttgtactacaactgatgtcactgggcaggcagctttataataaaacatagattatttggagactcacgactcagagaattatcttttgaaatttttgatttatatattaatgtttacaaccatgctggtaacatcactcctctctgtaccattagcagagaatgaaaattaattttgatgatctcttgagcagaacataatctgaatctgaaatggaatattacaaataatcatatcataggttctttttattttttaaaaagaaacagaattggcttcaaaagtatgccgttggttcccaatgactataggagctaaatacataggttcataaaatgatttcatatattagttttaaaaccagtaatatcacaacttttagagtgcttaacataaacagaacattcaacatttaacctctggcactggaaaggtggtaaaagccaaaacttgcagtttctcgagaaggataaaaatgaatggtatattgttctgtcctcagtcaaaatttttagattattattaaagcatggaaataggtatactaaaacctcagttaattagactatttgaggacaagaatattttttattattttgattttctggttaattgacaactacaaaatgctttttgttgaagtttttccaaagcagtttcttttcctctttataaaacatctaaccattctcaatgattcagcaggtcaatgtcatcagctacaagtatcctccagggtttacaccccacctttactcaaaaccaaagctatcttgttttcttcatcgctgaaaaagggaagtgtggtgtgtgcggtagggtggggtgtgtgggagggaaggggagggggtggggaagtatgaaggttagctaattcagggttctggctagttgggttccaggtagcaaaaccgtcagtaaacacaaattcaatgtctggaaccaggcacatctgattcctgcgaatgatgagacaaggacacaaggagatcccactagggtctgtctttgttggtcttctctactttatgtcattttgtctcggtgactgctggtttgatgctcttctctgtggaaaatgtgtcagtgtgtctatctaaaaattctggtctatgaactcatggggggggaatttattttgattagattccatatccatgccctttcaactcaagcttagggtggatgtcaaagatgaataagcccttactttcctctcccttagacttgctgacctgaattttctcctctacaaaaatctttaattccagtttttttttttttttggtatctcagcggctccccatagcaactgactcagaaacctcttttcctttgccctgttttccaatacctaagtgaaaatcatgaagagtttctttctaagcaggtttggaaagtctggcgtgagaatgagtggactaatttatatatattgtactttaacaaattcattttacctcttttcagttacaccttttccttaagcaaaattatatataatggttctgctatagggcctctgtaacagactatatatatactggtatcttaaggagatagtaggataatttaggatagcagtttgtgaactttttgaaaccatggatccttatagatgactcttcaggaattctaacccctggtcagccctaggggtagagggtaaaggtagtgaagacgacctgaataaagtatggctactgggccccataaaactgttgattgttcttcaaagccaaatttctagaaatgtagaataaaacacaaaagccaaaaaaagtagggtacaatggactaacctagtgagttccatcctgtgtgttcctcacaggactaccggccactcactaacctgtctgtgacttacgggtacaataatacccataagtacagagatttggtgatgggggataaatcttgcttcacttggagaatgtaaaacaggcatcataataatcataggccctacagcgggagaactatctgctgtggatttcctctcacagctttcattttctactgcgctggaatctacgggaagtctgcattccctggttcctgcctccatgtccacctccgctgattaagacctttcagaagccacagtgaggcacacagctctgggactctctctgtgctctgtgcatggactggtttacaaacacccatctggaggaactggagcagccccactgctggagcatgggtggctcacgctttccttcgccccagtgaagcaggtcttctagatgtgtaaatggcattttagtagagaccacagttgtttaaggcaaattcccttgatggcttctgacaactgtgtctttactctgataggaaactcattcctgggactgaagtatataccattcagtggatcccttacctttgttggcttctaaaggctgcccaaagggtaacaggaatgagggaggtgtgagagacataatgatctgttcttcctgcaccctcacaaactgcagcatccctatcaagcactagctagtgattctgcacagcactcttaggaggaaagctttaaaaaattatgtaaaatatatacaacataaaatttaccattttacccattttaagtgtgcatttcggtggcattaaatacattcacattgttgtgcaactgtcatcatcattcatctccggaactctccaatcttcccaaactgatacttaatatccattgaacaacaactttcaatttttccatcctcccatcccctggcaaccaccattctactttctgactctgtaaatctgacagttctaggtatctcatataaatgagatatttaatatttgcctttttgtgtctggattatttcacttagcatcttcagggttcctccatgtcgttagcatgtgtcagaatttcatctttttaaaggctgaataatattccattgtatgtattaatatacaccacattttgtttatccattcacctgtagatggacacctgggttgcatccacctctggctactgtgaataatgctgctatgaacatggttgtacacacatctatctgctcaattccctactttcactttttttggtatatacccagaagtggaattgctggatcacttggtaatcctgtttaattttttttgaggaactgtcgtactgtttagtatttaattttttaaatatatgcactttatcataaagagcagttttaggttcacagtaaaactgaccagaaagtacagaagtttcccacatgccccctgtcgccctctgccccacaagattcagttttataggcaccctactcactcggtgactgaacgctcgtccaaagacatggggagtgatccaggcaggtcctgccagatccagcaggagcctgaagccatgattcacctaaggagtcatgacaacttctttccttcctgacctgtagacaggaaactgactgacagcaaaggtcatcccacaggaacactggatgtgtaaacgtggagatctgcggagtggcagagcaggagagggcgctaaggggcatttgatccaacctccttctttcactttatggtgaagatgtctcataaactgataaccttccttccaggaatgcagtgcagaataaactagtgcttgttggagatggtatatttttgagggtggagtaataataattacatcactcacaactctatcagccctaatcccagccctgttaccctttgggcagcccccagaaggcacctctgggttaattccattatagatcacttttaacacttactggtttttgtcttatttttctgatattgggggttttattttaaacattttaacatatacctactgtacatttaagtctatctccaggatttttgactctattaatgttgaggcaatacatatgttctttctttgcttggcaattgctttattaacagtgattattctcaactccagagagttataataagagaactgtaaatcctaagtgctactctgaatgataacatctaccatatccaagtaaaatgttataaatcacagtgcttatccacagatttaaaatgcccagaaatttctcaaatgtttcctggacagtatcactcatactatttttacactcacatcgactcaatgaaacaaaagaaaaaatgctgtttcaaattcctacagtcaaagctcagaaatatacaatgcatatatctattcacaggtacacatgtacatttgtatgtatgcttacatgtgtccaaatgtacatttgtttagtcaaactcttctacttttttctattaacgtggaataaattgttcttgtcctcagcagttaggcaacgggcctgttcgaaagctaacaccacaacatgatgattcacaaagtttttcagtcttgagaacttagaatctcacaaaacctggacttgctggcttgagttactcattggaggtgtgcttcccttcccatgtgtgtgttttttttttatttttaacttttgtgggtatacagtaggtgtgtatatttgtggagtacatgagatgttttgatacaggcatgcaatatgaaatgagcacgtcatggagaatggggtatccaccccctcaagcatttatcctttgagttacaaacaatccaattacacattttactataaaatgtaagttattattgactatagtcactctactgtactatcaaatagtgggccatattcattctttctatttttttttttttgtacctattaactatcccacctccatgccctgcccccaacccccactacccttcctggcctatggtagctatccctcctactctctatgtccaggagttcaagtgttttgacttttagatcccatgagtaagtgagaacatgtgatgtttgcctttctgtcccacatgtgttttgtaaatcaaatcacatttaagtgtgtgaggggagggataatgctatgatgactcactctgaaagggaacaatgtatttcccaactcaggggaaaaaagattttctcttttgagtgtgtctaaaagcatgatgagcacacctgcaaaaggactgtagctgttgttttagcctaataacagcactattagtcacacttgttgaaaaccaggggcaaagaatggctggtactagcagctctggggtaaagctggcacagaataatggcatcaactgggctggacttccaaatgtgaaggtgctaagtgaaccttaaaactcttttctgagacataagtcagtgtattaagcaaagcattaaatttcttaatttaatgctatttattactcaagtatatacagttttctacctttttcattatttcaagcacatgagttaaagcagtgattctcaaattggggtccctggaccagctgcatcagcctcacttggaaacttcttagaaaagcaaattcctagcctgtaccaaatctactgaatcagaaatctgagcttgaggcccagcaagctgtacttcaacaagccctccaggtgattctgattcaagctgaaatttaagagccactgagttaaggaaccaccaatatacagattccaacctttgctcaatgataactctccagctcctttgttaaaaaaaaaaagtaattcatgtgtgcttgggctatttgttactatcacctaagaaaatatttatcattgtttaattaaggaaaataaaccctggtcaaaacttacatgtaatttttccaggtcctgtgctgccttcgagtcttaggatgcagggaactgggcgaagggagagatgagaaggctctggcaatccattcagacatggaccccaaagttttgtggggcaaccttgtgacaggtcagtgagtgtccacctaattgggaaggaaaagttgtccattagcagatgaaagtatgcatgtgaatgtttccccctctctcctgctatctcgccatactccgttctgcttgttatgatctcacacaactgtctgtgtctctggctgtcggcctcttgaccaatcctcatgaacagaataagacaccatagcccgtggtagaaacgcctgggctctgcctactagaagccctattccttgaggtatctcctttaggtgagcagccctcacgaggggctctcctgaatccaaatgcagcctaggagataggtccatgtccagtaagttatcaccttctatatttcatctcacgttttctgtcagcaaatcagaacaccttggtttaaaagacacatgtggccattgtaaatagaagagatttgggaagcaaatgatttaagaattctgaccgaaatgagatgattccctgatgcctcaaatgtgtttcgttttaaaattaatatttattttttcagataacttaatacatgcttattgtagaacatttgaaacatacagaaaaataaagaaaaaaataaagatcaatggtaaccttgacaccgataaatcactaatgatgttttgttgtatgggtctgaaactccttcaccgaaactcttggggccagatatatttcagaattcagaatttttggattttagagatgcagctaccatttattacattagtatcttgtgagagtatggagcagcaccctataatattaaatattaaacattaaatatttgtgcacaaaaatagatgcatattcttattaagtgggggtaaaatagagcctcacatttgttcaggccaggttttcctaccaaagaagttactaaaaatagaacaaaacaaaaccccttttgatttctgaaaacttttagatttagaattagagataagggattgtgggccagtattcttttcagatacatgcacatactcaaagtattgcttctactttttcattcaattctgaaataaaatgtgagttatatgaatatgagtatttccccaagttattaaaaattattcaaaacatgcttttgaatgttcatgtgtattataccccatagaaatacatcttatgtatttatttccctcatttttggagttgcagattgtttttttctttgttattgtaaataacactttaggggatatttctgaatatcagattgtcttgaatttctgaacattttcttacgcaggttcccagaaaaggaattattgcatgaaagggcataaactttgagagtcttgattttctagaaagattgcaccaatttatattttttttcagcagcatgaatgcctggttaattatgaaccttatcacagacagagaaaaatacacttgctcctcacgcaacttaacaaaattctaatcaatgatgatcaaatgtaagatattttatttttgttttccttacacagaagatagtgaacagcttgctgtttttgacatagcaagagagaaatggagttaattttagtttaccatcaaatgaccctcattaggccagactgagttagatgtggacagtgggggagctgtgacttgtccatggggtctccacatggaaaagcatgtgagagaattcagaaataattcccataatatcgtgagaagaaaaaccactgattatttgtgggttgataattcatcttctagagtagtgaggccttgtattttccttccttctggggttttcctatttcttggacattttgctcttcctcaggatggcatcaaaaagcagaaaaagatgcaaagacaaaatcaaatcagaatagctaataataatggctaacccttatgcatgattacagtgtgtccactccaatgccaggtccttgtatgtattatctcatttaacgccaagtgcattggtaacaaaactggtggctggcaagtttgaaagtatgtgcccactcattggtcctccttattccccaataagtttgtaggaatttgggcttcagaattccaaagatgtattcaagcctagtgtctcattactatgttgactcattgcctagctatatatcacaagcttgatctttccactctttggtcagtaccatctatagcatctaaacgaagcagagaaagtctaagaaaattctagacaatagtaaaccctttgaaagtcctatattgacacggggaaggctatagctctttgagcacaatagagaagtgtgaggtaagagtgttatataacacaaaacaggttatacatggagaaagacatgaagacacagataaaatacacacttgaaaaaagaaacatacaaacacattcttcccaaatgtggctacgaattaggaatgctaaagcaggtcttacagccccaggttcttttagatttatagctttttctaataatctctctttctctttcccctttatgtatatttaaccttacaggataactggtatagagaatgccacaattttcatatgctaataaaagcaaactgaagtgacgtttgtttgttatattaaatgaaataacctcactctttcacttatgtataaactcaaatttctgcacccactaatactataagatggttatggtttgaggagtggggggtgcaaaaaatttcaatcctattttgggagtgatttaaattgatctttcccaacaatcttatctaaaaataaggattgtttctatcaaaatgatcaaaagaccaaagagaagtggaccatttccttcactgtggctttacttcataatttaagcatcattttcctgataattaggtgtcaacgcagatagaatagcttataaatgatttttctttgccacattcaggtatatgcctaagtttctaagcagaccagagctacagggagtgaaaaataaaatggtaatagaagaaataaaccctcaaagagtatactttgttttttccaaagggcctaactgcttcaggggaaatacaaaaaacaaaccaccattaataacgcaaacgattaccagacactccttggatactcaaactgtacaactatcattgcaaagctaattacaaatttggattctctcattttaaaaatatacttcgaagcaacccacttctgtttcaatgctgaaccaaagtctgtgcaattggcacactgtcaaagtaaaaaaaaaaaatatatatatatatatatatatatacacacacacacattgcatcacttgcacttgaacaaagttattactttcaatgtcactaaatcctgaactgcaaaacaccgcaagctaaaagcaagtaatgccacatggtatattatcttacatttacaaaagagtttatagttttccaagccacagagatacagactttcccactcacagtagctttgttatgctgggcaccccactcactgcctcggagcctactacctctcacaggttcttgtggggatcacatgagaatgtatacagaattttttttgcagattataagacatacataaaatattaggtatcttttttttaaactaaacaactttgtgaggcataaagatattaatcgccatttcatagtttggaaaagaacacaagaagatgtaacaaaaaaagtactaagttagaagatctgagttttatttctaaattggctacgaactagctgcctgactctctgggacttgatttcttcagtaaaacaagggggttggatgaaatgactgtaaggtcttttggaagccaatggatctgtgatgtaggacgtggccatggtagtgatgggagtgccttaggaagtaatccctcctggaggccaaggaaccatgaggccaaaggtagcatccatcaatctgaggcctgcagtgctggcgcagagtccttgagcagcccccaactcccagagatgagacagacattaactaactcattttgctggactgaggggaggttggtggaatcctaaaggaatggccagggtgtcttgggcattggaaagaaataccgaagaaacttaggacagcaggtctttattaactggtacaggtattttataactttaacaactggtatagccaagtaagtatataccagctgtcagtcttgctaacagttttactgttgtttgtctatcagtctcaaagagacggccaccactgagggccaaccaccttgcttggctaagttcctacagcatggggggagatgtgtaagagggctctttttggtattatgagtgcacatcagggtcacatgggaatttgactttaaaaagacactaacttaggcctctactaatgctattctactaacactgtttaacacaactttctgtaatgatggaaatattcaatatctctgctgtccaatatggcagccacatgaggatactgagcacttgaaaagtacctagtgagagtgaggaactgaatttttaactttagtcaatttaaatcaactgaaatttaaatagccacatattgttagtggttagctgattggacagtgcagccctaggtggcttcacatattagttttcttggacctatttcagactccagaagcccacaggacaatacccaatatagtccttcaataggtattcactgcccttctcctaggtgctgggccatgtttaggtgtctcagaacaatggtgaataagagtaccatggacacttcctgccttgtggcattttgcggctagattgatttccgaagacctcacaaaatcttgaagtagctcaccagactgctcttaggaaaaggtgggtgaggagatatggtaatgctacactaagcatgaaagcactgctttttcatttcttcgtatttactgttagagaagttgggggaaagtttaaaaagaggtatctgaatggttactattcattctcttacaagtaaagtaacatatcccagatatgggaaattatctgtaggtaactacctcttgcataatcttaaccttacttaaaaagaaaagtccgaggaaccgcattctgaagctaagaaaagtaaatggtattcaattacagcaacagccgtagaaaaagtacaagtgggtctccagctgcaaatggtgggcaagggagtgttcttaccaattagttgtgaaatgatcaggttttctagaaggtactttttgtataagtaaggctgattgaattctttatcccaactcaactcttagctaggattttcttagtggctttaatgggatttgatgaggaaagccccatttgcctgtccccaggaaactacaggtgaaaatatttctatttacattacaaatctaataccaagaacataatttctaagaaacacaaaagtggtttaatgatctgatttccagtgttgctctcaatgtcctcctgttgtcaattctctcctatcctaatcacctcttcctaccttattgggatctggagtgacagaaaaaacacaaaacatgatattcaggtttgaactgaatccaggtttgcctaaacttcaaggacgggacactgcatgttgggatacagaatttttaagctaattctctccattgtattaatattatcactggaggtaaaaaatttaccaaataaaacaatctgattttgctcagcatcccaaggggatcatgttcagcatctcaatgggaatgacaccagtcagccaatctttcgagcttcaccatgccacttctggttcccctgccctaagtcagacttttgatttttagggctaataagtgactcttccacaactatacacacacacacacacacttttttcccctctggattgagtagaaagacaatttaatacaatggttagaaaacaaaataagacttcaaaacttagttctaaaaatacaaattgcatttagataccattatcttctttttaaaaaggtcaaatctcaaacgttcagctggttccaggctatataaaaatattactgaaaatctgatgacagctttggtaacaaacatcttgagagtggccctgaaatccttatttatattcagaaacactaagtggagtagtcgcacgccattttatggctgaaggggttcaaaaggaaagaggtcaattgatgttaattgttaattttttggaaattcagagatgaagttttttttttttttaaactcttatctttcaaacagaatttaaacagacacttgtataaggcagaacccctttgaaccacagatcttgtggcttttgtgttttattctactggcatggaaaggtgatgaaagaaagtgggcttttttgctgcaacagagaaagaagtggggagggagatgcagttatttcagacaggatggcgaacattaattgagattaaacagctctgaaagtttccacttcaacatttcaggttctgggactctagctgaagaaccaaagctagaaaattcacttatttgacattcaaggtgtttaagttcccaaatacaacaaagaggttatcagattttcacttctatcataaaaggatggtgcaggcagaactacttgccactaacaagccagaaaaataaaaagtgtgatagaaatgtgttgaaagtacataatttgaaataattcttggatttctgcagactttatacataaaaattggaatactagcctgtattgatacatcatcaccatcaccatcatcatcatcatcatctccaccaccaccaccactgccgccttcatcatctccatttactgaaaatatctatttgctaggaactgtgctagaaattttacaggaattattagcctctctggtacatgagagaaccctgactcagagaggcaacgtgttttgcttaaggtcatactgctggagacaggacaacatgcaatctgaatccaagctggcctgtcaaggctacctcctttcctgtacaacactgccttcctctacaatgtggggagactacatccttcttctgcgaaggaaacatgaccactttcccatgtgccaccagtaaaacatgaaagtaaactgacaaggctgcaggtcccacagcaatttaactatttgtatgaagagttttagtgctaaaatggttatagttcatgaagcataatttcttacttgttatatatttcagtgtcgtttctgtcccttgactatgcaaagcccttgcctggccttgccacctgcttctctctctgcctagaattccctcccacaacccttagccatgctggttacttctccttcactaggtctagttcaaatatgtcacttgcagagacactgtccttaatgtgctctgtcctctcccaaacagctaggcattgccctgcttgtttccatcaagggataaccaaaatccacatgtttatttactgtataattacctatcttctctcttggtccatgtaagacccacagcagcagggacctagcttctcttgctaaccattgatacctgacacttggaatagtgcctggcacaaacttgaatgaatggctacaccaatacatgaatgaagatcagtgtttgcagagtacagtgacaggtacacatagaggaaccagaggagagacattgccctggggatctgcctttgccagccctcgagtcctaggccagagttcatctgctctcagcttgaaccctgcctggagactgagcatacacctgcacttggcccttggccctcttctcctgctgcacctcctgacatagcctcttcttccccaacagaggctcttcctcacacgatgagctcagcttctctccctggatctaatctctacattcccaccaccatccacctcgtataaaaatcaatcgtgcttacttctcctgtggtcacatacccttcagataatctggggccacggccttgggttccatcacacccataaccatgtggcactgtcagggctgactcctggcttgttgcatgcatccctagtccagcctgacatccagcaccaggctctttcccagccttctgtcctgagccacctcacttctttctcctgtctgccctctcttcccaggtccaagctcatggatgactcttggcaggctggggaagagaaagaatgtggaacagaggagagagaaagtcagaagcagcaaaagctgctgtgtgtccacatgggaagcccgtggactacatctgtccacgagaattttcatagtgttctatagattttttttaaaaatagtgagtttaaactatggatcagcagagctgaaagggaccttggagatcactgagtcccactgtctcactgtactgttgaaaaaccaacatgtgagtaatggaccgaggaggaagaaggcagcatttgtggagggcttaacatctgctttgggatatagggtcccaggtcccatagccagtgagtggcagagtggggaccatgcaatgcttaaatgagcacttctaccccatacacactttgccctacgacttacatattcataccacgtgtgggaaagggtgtggcatttaccacataaagatacttggaattcttgcctcaaagggtaagtgggttttccttctgtattagccgatatactttttaaaaattatggtaaaatatccaaaacgtacaatttaccactttaatcatttttaagtatacggttcagtggcaccaagtacatttgtttcgttgtacagccttcaccactatccatccaatacatttttaaagtgagtattttctaaaactatacatccaaaacaagagtgaaggaaacaaaaaagaagtagaaagaaaagacaggtagaaaataaacttttgggcatgcatttcagctgacaaaaacctttcatacgaattagcttctctgtgacatattcattattttcctagtaatgaaacgggaactgtgagacaccatgtgaaaaggcggcttttattgtttctctaggttctatactagctgtatccgcttacaaaaatgttatacaacccagtacatcacagccttccacgcctcctccataaaaggacaagtaaaatagtatttcttggaaagacaggcatttaccaatgcactgcatctagatggagctgtctccatcattctagtctgtttctaaacagggttttaaagtcttggcacagaacacaaagaatgtcccttagctattcagcatttagttcagctccacaatatatttagcaagatttctttgccccccccgcaacccccacccttcccttcttggtttaatgacctcaaatgtaccaacatcctgtcttacctaatcccctaacaagttctatcaaatgccaggacagaatcagacagcactgcaggctgtgagatcattcactaagaattcatttttattccaaaaattaggagtgccagaccatttaacacaatctatcacacagccagaaaattagcctagcgctttaagagaaacatttaaataacttttaaatatcttcttcctgacatagattctttaaaaacctgaagactctctccccagaaccagacgcatagacacaaaacatttccacatgatagcaagagctcaaggaccctttgaagacgatgtaggccccctaagaatccataaacctcaggttaaaatctcttgtaaaagaactccagtacttctctttgtctacaagcccctgtactggatcctgatccatggagcatccagggtaacttcttctggggccacttttgtctctggatgagaaacgacttgtttcagcttccggaacacccctacgtggcttctggtccaactgactgtcaacacggctaggcctctccccaattcagctggctactctgggaacgttcatttctcttactggtccatgacatgctggctctaccccagtgttaggttttgcttttcaattggcaatcttggatcctgtggtcccttctgtcttcctgtcactttccttgtggtccttgtggaacttttgttttaaaaattaaacctgttttttttttctttatcataaaagcaacggcctcccgtttgcacttaattcctttgttttttctccaaaagcatacttcagccttcatacctttgttcttgggaagactttgcccacctctctaagtggcaggtcgtgccactctctgttcagttcgggacagggtttctcctccaggagaagtgtggggcagtgaattaggaataagcctaaagtcagagagacccaggtctagtcccaacatagctgactttggccaagcaatttgaacaaaggctcagtttcctgatgtgaacaaacaaggaagattaaagccaacatatgcttttgttttattttttttagacagggtcttgctctgtcacccaggctggagtacagtggcgtgatcatagctcactgcatcctcgaactcttgggctcaagcgatcctccggcctcagcctcctgagtagctgggactacaggtgtgtgcccttaaaactggctatgttttttgtttttgttttttaaggaagactaagagagctgatatgttcacagcttctgaaacacagaaggtatctagtaaatggtgatgatcatttcattcccttctaactcttcacatatgggattcagcatacattctatattttagaagcaactcctgctgctttctattaggtggccaggaccacttacgtttggaggcttaggcattttttaacaggtttattgagatataatcagcatatcatacaattcacacctttaaaatatacaattcaatgttttttagtatattcacagagttgtgcgaccatcaccactatctaatatcagaacatttccatcatccaaaaaagaaaacctacacccatagtagttactcttcatttcctttccccttcaacccttggcaaccaccaatctactttctgtctctgtggattttcctattctacacattttgtataaatggaatcatctattatgaggccttttgtgtctagcttctttcactttaccatattttcagggttcacacttgatgtagcaaatgtcaatatttcatccctttttatggctgcataataatcaattatattcatctaccacatcctgtttatccatttatatcagttgatggatatttggattgtttccacattttagctattatgaataatgctgccaagaacatttttgtatggttagacatatttggacatgttttcaatttacttggatatatacctggaagtgaaatcgctaggtaggatggttaattttatgtgttaatttggctaagtcaccataccaagacttgtggtcaaacatgtttgggtgtcgttacaaaggtgttttttagatgagattaacatttacatcagtagtctttgaataaagcagattactcttcatgaggtgggcctcatccaatcagttgaaggccttaagaaaaaaggctgacctctcccaggaagaaggaatactgacagcagactccctttggactctaactgcaacatcgatgcttctctgggtctacagcctgctggcctaccctgcaaattttgaacttgctagtctcctcaatcatgtaagccaattctttaaaataaatctgtccctttcctctctctctctacacacacacacacagacacacacacacacacacacacacagacacacacacacacacacacaccctctattggttctattctctgcagaaccctaactaatatactgggacaaatggtaactctgtatttaacattttgaggaactgttttccaaaatggctgtagcaggacaatcccaccagcaatgtataagggttccaatttctccacatcctcaccaacacttattactgtcttttagactttaaccatcctagtgggggtaaagtggtaactcactataattttgatttgcatttccctaatgaccaatgatgctgaacatcttttcattcacttactggccatttgtatatctttttctgagaaatgcatattttagttgtccattacttgtctgggttgtcttttgagcattgagctgtaagaattctttatatattctggatacacatcctttgtcagatacatgatttgtaagtattttctcccatctgtggaccatcttttcactttcttaatggtttcctttaagcatgaagtttttaattttatgaagtcccatttatctaatttttcttttgtcttttgtacttgtggtgttatatctaagaatccactgcctaacgcaaggtcacaaaaatgtatccctatattttcttctaagagttttagaatttttgcttgcatttatttttgtgatccattttgagttaatttttgtatatggtgtaaggtataagtccaagttcattcttctgtgtgtgaatatcctgttgtcctggcactatatgttgaaaagactgttctttcctcatcaaattgttctggaacccttgttgaaaactttgagcatacgtgtactgtattcaagactacactatcttataggatgttttgaaaaaaggaagtgtgagtcctccaattttgttcctcttttgcaagattgttttagctattctgggtcccttgcatttccatatgaattttaaaatcagcctgtcaatttctgcaaaaatgctgcaattttgatagggattgtgttgactatataggtttggatagttttgccatcttaacaagtcttctgatctatgaacattggatgtctttccatttatttatgtttccttaatttctttctatagtattctgtaattttcagtgttcaagtcttgcacttcttttcttaaatttattcctgaatatttaattatttttgatgctatgtaaatggaattgtttttgtaatttcatttttcttgctagggtacagaaattgatttttgtagactgaactttcatcctgcaaaactgatgatcttattattcattctaataggttttttcgtgtgtggtttattttttcttctaatgaattgcagtcaagtatttttaagtattctgaatcacaggaatatcctggcacaaaaacccatgacttaaaacttcactataaatataaggagctcatactattatttgtccccttcctgtggcattgggtaatgatcctgcttttgggttatggtcttggtggcattcctactgctgctgacagcccatataatgatttgaaaagttcctgggactccaggatacatggtgagacacgaatctattttccatagaagtggtattataaaaagaggtcaggtttccagcctatccctaaagtctgtttaaaggggtatcattcattgaggatgccacagggtctggcctcgccattctcaaagggaatctaaagggtttgtttcaatgaaaaaccacattctaaaggagttttgaatgaacctttcaaaaagtgccctcctgggctgggcgtggtgactcatgcctgtaatcccagcactttgggaggccaaggctggtggatcacttgaggtcaggagttcaagaccagcctggccaacatggtgaaaccctgtctctactaaaaatacaaacaattagctgggcatgatggcgggtgcctgtaatcccagctactcgggaggacgaggcaggagaatcacttgaaccgaggaggcagaggttacagtgagccgagattgcgccattgcactctggcctgggcaacaagagcgaaactccatttcaaataataataataataataataataataataataataataataataataaaaataaaaggaccttccattcagttaggacttcttatgggcttttatgtagacacctctgctaacctacttcttctttccaactcagggctgactcctaatatacaatactttgaggggcagtggtagttaccttgcacaaaaactgctaaatttgacacaatacatatatatatatatatatatatattttttttttttttttttttttaccagactatattttgcttcaggttcaaaaactgatttctagccagcattcagagacctactttgcatcttgatccatgagtcactgatttgagcatgcatttgcccagaatacccaggcatgtgaaaggatcaaaatatcacactttgattgatttagaaagttattttctaccaccatgcagtctgagagtttctatgctgcatctgactaattggggaggtgtgggagcagagagagccaggagctgctgtgtggaagaccttgtccctcctcccaggcaccaagatcccagggagtagcaaccctgctctccatggcgaagtgtgtccgtgtgatgctcatctcagcattatctggttatcggagtcatcttttgaagagatcctggtatttcggtttgacaaaaatcgagaaacaatttagaaagaaaatcggatttgtgtgtaaatgaagaatattcctgaaaagaaactctgttacgaaactgaaatctggagaccgcggtggtgctaagttgagtcatcagttccctttacgccctaataattgacggcactttgatcacgatgactgctctgggtgatgcttttttgtttgctttttaaagtacttccttgtgtaaacaggttgtctcactatcatcttgaaaacatgtttacgtttgggggatcatggggaacatctgttagaaacagatttcatgcttttctgtcaacttagggaagtctgaatcctatttcttggtaatatacaaaagctcttggagagttaaatgaagttctactggaaaaaggactgactggatattttgattgttcttcatatatgtatttacaaatttgtcctgaaaacatccatttgaaatagaaacaggcatgaattattgttcactttttgtagatgcagacaatgaagtgtagagaagtgaagtggcctggtcagtgaccgacaaagtggcaaagagggggccaaatgcatcacagggacatactgacccttaatcagcaccaaataaaatccgcaggtatcaagggtcccctgatattatttccaaaaagatgttacaatccttcacaattttattgagatcactgattctggagaaggcaaatattagggctgagtgatgtatcccccaaaagagcagtttctttgtccaggtctcaagttagagatctaggtgtgtgtggagaggtggggtgttcagagggaacaggaacaaagcttgaaggagaggctgaaccaacaagaggacttcaggcaaaatactttactgaaacctcaacagtgaggctgctcctgctgtgcccagaagcgaggtgctcctcttggagggtgtgccaactcgctctggcccttggagttgaggcaggagcggtttctgtgtgaagagaaagaactgctgtcatgaaaaaatgggagatgctgcagattttatttaaatgcccacagacagcacagcccctagacccaggcaaggaaggactctgttctccttcagttaggccagggaggcattgttccccatcttgccttatgatctctcccttaaactcttccagaatttcccacccaaatggttccaagtgagctcccagggtcagtgtatgccctttccctcggtccttcctccctttggtgggctacaccacctgaagggtgagagaatggccaagggcagctatttacagagatatgcatgtatcttggacatgtgggctggggtgtccatgtgcatgtttcaagacccctgtaggatgggggactgggggagtgggaggagaaggagcaggaaagaaggaagcaggtaggtgtatgctggtttcccccatactaccatgttcccatttggaactctaaggagaccgataattctaaatttaaatctggccttccgaaaggtcattacatcaaggcagaaggacagaatgtattttatacaaccagtttgttagcctgattcataaattttaatatttaagcatacagcatatgagcttcaattgtgcctttgtctggagccctacaaatattacagccagacctgtccagagccatgtggatcagggctgggaaggcttcagattgcagatgtgcagttatgcattacacaagccccatgttgcattcactgaccctctggatgataaagtggaggtggctgcaaggcatttccagaatatcaaggtgctcacacaacaaaggtttccttcacttgttttgggaacactgtgctgaagacagcttagccaaatatttctctgtttggctgcagccaaatacatcagggtcttgctacaggccaactaagcaaaccataatttttacaaaaaataattacctaacactttcatctcttgtggtttctttattccatacatactttgtaatgtgtttatcagcagctagttgaacaacttggtgtaccagtgggagacaaaccagcagtagttatacacggcaagtaaggaccaaaacataggcaggaaaataaaaataccaatgaacattaggctgaactgtaagacataattaagtagctgtatatcaaatgcataaatatgattcttttttaaaggcccacacatattacacccactttcaggagtttcccaaagtaatttaaaactatttgatgttgcttcctgtttttcagtacttttatctgtttatgggggtggcaattctactgctaaccaaatgaacaagaagaaaagtgaaggatggggccattttcctggttttagtcaccaaaatctgctttaaaagactgaatttttagaccttaaattttaaaatttggggttctaagcttcaaagtaattatttaagacttatcccacattacaactacagattgcaccaacagttttcttagagttagtgagcctcttgcatcaactttgtttcctgttctctccaaagctcctttctaaagcaactgagcttcagaagagggaagaaggaaacagggcagaggggtttgctgacctcagtctgcattcaatacatttttctttttctctttgagacaaggactgctaagaaagggccttttcatattttaaagctgaagtttcaaaaaagctagaacaattcaaagatatttattccataaaattatcctcaggtaccaaaagtagctctggaaaagtggccacctctttttatttggccttcatagctcattattttaatcaagtagatggttaatgaaaagcaaacttacactttccatgaagtaaataaagtaatgtgctgaataatgacatttcagttgataatagactgcatatataatggtggtcccatagattctaacatcatatttttactgtaccttttctatgtttagatacacaaatacctcccactgtattacaactgcttatagtattttgtagagtaatatgctgtacaggtttgtggcctaggagcagtagactataccatacagcctagctgtgcagtaggctataccatctaggtttgcattaggtacactctatgatgtttgcacaatgatgagactgcctaatgacgtacttctcagaatgcatcctatcgttaagcaatgaatgactgtgctattatgaggtgacaggcattttggggatcagctagttcaatgtgtcatcaaagtcttgaccaccaagtgggtggcgctgattaaatacctctaatgagaagaaaggtactgccaagtcaattttggaaaattattatgtaccacatcactgcatacatcattacacagttctctctcaggccaatctgcctccttgtagcctaaaaacactggtttgccctacagggcaaccagaggaaggataacacctacatacatggtagggagtaagtggtggctccgcctcctctctttcctcaagtcttctcgctggatagttgtttctagttccttcaaatgttatttgacatggtttcaggttctctatcactgtcttgggccactgtcctttaaaaatatttaagttctaaatttaaaaatcatcatttcaatttaaaatcacattataggccgggtgtggtggctcactcccataatcccagcactttgggaggccgaggcgggtggatcacgaggtcaagagatcaagaccatcctggccaacatcatgaaaccccgtctctactaaaaatacaaaaattagctgggtgtggtggcgtgcgcctgtagtcccagctacttgggggactgaggcaggagaattgcttgaatccaggaagcggaggttgcagtgagctgagatcgtgccactacattccagcctggagacagagcaagactctgtctcaaaaaaaaacaaaaaaacaaaacaaaacaaaaaaaacaccccatgttatagccaacaatacatttgccaatatatctatcaaatgtgatctcaaataaagcacaattttattactgaagagtacatagaactatctttcaccttcttagtcctacaatgcagaccatgatttcattaatgctttgggcagctacatcacatctctggctaggattgagcttacagaaatgaaacccccaaggagtcttcacatattgctattgtgttttatttcccacattctctatttgtgatttttttttttttttttttagtgggggtgtgggatacaactgcaggtcttggcacttattcctattactaaatgtcaactcacttgggtctcgtcccttgttttcttcttctttcttctgtctattcactcggtggcaaaggagcacatgaaagagaactgtgctcaagggaatttctttttatcatggaactgtacaaggcttacaaagcagtgggcagtcagggtgaaaactaactcagtaaacaataccctttaggaattggctcagtgtgtatgctgtgtcaaatcctgcttggtaaattccaagaggaaactctgaataaatatttaccatatctatttatttctcctactgagaactatataagacaagaggatgttaaatgatgaaacagatttcaggatttttgctctccgctgagtcttgcccatggggcgtgaggactgatacaagtcccagtctcataatgaaaccagacacagttcacttccttttgtttcttaaaccaccccctcacctgggagatgtcttgaaatgacacagacttagttatgtatcactaacctgagatctcaagggaatgattggtattaattatcattagtaataataatatttaatataccctcctgggaaggtggacagcatgtgcttgggatggaatacagccctgactaagcttacctgctcaagctgtcaatccctattgtctcaaaaggcgaaaagagacattttaactccagagccatctcctcttccaattgacataataaggagaggtcaagaagaatctagttagagattagtggacgctgcattacacttccatggcttcctactgaaagtgaactaccaaagaaatcacaaagcactttctgtctaattcttcccttcttccttcccagcttgggaaacagcctgagatcagcctgagatcagacagaggatgctacctcacaagctggttatcaggtgggctctttgcttactgcagcccagaggaagagaaccaaatggttggggcagtggagaatgtctatcattgctctagacttaagatagtgaaaaccaaccaacaacccaaatacagaatctacgcccttcttgtcttacatcctctggaactttcttcaattttagctattccccagttaacctttttattgaggacagagggatgacctgccccattcttgggctttctgtttgctctttcccctcctcaggaatcaatcactattcttgagctctggatcccatcccctctctctcacttagagaatctgtttctgaatttaccttcactgtccctgggacatcaatttctctctcctggaccatttccactggcatatcttaaatcccttcttgatgccatcgcttcctccagaaccaatccctttctctgcccctgttctgaaggaagaccctcaaaatagttgtctttacttgctgccattatttcctcatttctctttctttccttaacctgttgtagatttttttttgtcactccagagaaactgcttttatgaaggttagtgatgatctccgtcttgccaagtccatgctcaactctctattctcatcttacaagacttctcaccatcacttgactcagtcgtcaacttcctccatgaaaccacttcttcttgtggcttcaggggcaccacactgtcctggcttctcatcagcttcacctgtggctccctcctctgcagagtcctcctctgctcctcctcctctgctccccatctaaatgctggcgttatcttggagctccatccacggactttctctttcctctaactatactcactcccaggcctgtggtttttgtcacctatatgctgaagtctctcaaatttattatatgttgcccctgacctcttcctgaatttccatatccaatttcctactcagcacctgaacttgtatattcaacatgcatctcaagtataacatggccaaaaaaacaattattgtttccatcctccctccaaacctgcttctttccagtctttttcatcacagctgcttgggacaaatatctgaagatgaatcaaagagaatatatagacttccatctgccctgcctccataatacatcttgaaatgaaccactttcattagctcagtgtttagacatgttggtctgaggactcctttacaaccttaaaaattaataaaatctccaaagagttcttgattatgtgggttatagctattgatatgtgccatattagaaattaaaacaaaactttaaaaaaatagaattcattgtatttgaaatacaataaaacattgtatattaacacaaatcacatattttatgaaaattaatacattttacaaaacataagtgagagaattaacacttttacatttttgcaaatctctctagtatctggcttaacagaggactgctggattctcatatctggtactaccttcaatatgttgctctatggtgttttgatggaaggacatgaagaaaatctagctcacacagatacatagttggaaatgggtgaagtattttcatcatcttttgataactgtggatattctctgattctacaccagaaatcaacaagtggtagcttttaaatgtggagtctgaaatgtggtacctgaaaatctgtcaataaactttttttactttgttaatattaaaatctattggtctatcttgcgctttgaatggatttttcacctgtgcataattttataacattacccatttggtcatttggaaatacttgttcactaagttcggagatctttgagatcttttgaatgtttcacatttcatgatccaataccaaattctccacattcattaatatcaccatcaatctcgtcagaaaaagtccttaatgtattgggaagttatcaagctctacagtagcagctatgtgttttccaaaatcctaatttttgtctcaagctcaaattttgtcattggcaacaaatactgtcagttgtttttcttgaagtatcagggcacttcattcatttttgataaaagatctgtcaaacaaatacccaaattggagtaactagagtttgtctgttagttgttcttttaagtcatattggcattccatgaaaaaagcagccagttcagcttgcgactcaaacaactgcacacgggtttttcctggagataaccagtacactctggtatacggtagaagggcttatgtgtccttcccattttgtcacacagaatattaaaaagacatcactcaagagttgagatttaataaaaacagtaattgttactgcttcatacaggatattctgaagtgaaattggcattctgttctattgtaagcatgtgctggtgaagaactagcagtttggtaccactatcttgtttcgtgctgaggtgccagcagttttccccaccattacatttcactagcagtgcacgtcaatactgcgaaaaagacagacagcatcttggtattactgtgaaaatagttttaaccttgcattccctgataagatcttgcgggcccccaggaacccacagaccacactttgagaactgtggcactagcttgccatcttctgtccaggccaccaccatctctctcccgggcttgcaaaaaagcctccttgatggtctctatgcttttacttttgcctctgtagaagcccttctccacagagcagccagataatcttttaaaaatgtatgtcagatcacatcgctctcctgcttaaaactcccacttcagatgtcccattgctcatagaatagcatctgaggtgcaggcccaagcctgcaaggccctggctgcccctattttctcattcatgcctgtactccttttctttccccttctccagtcacttgacctgtggatctctttaaacctatcctgtgtgctccagcctggaaggctcctcccccaggttttagcaggtagggttctcctcatttaggtctcatctcctgtgttaggcattactcaacctgcccatacacatcttcctatacactgccctcctctggattacatagctccatttattaccctgattgctctcatcgttctctgaaatgatattgttcactaatttgacagctggtttgttgtctgtatttctaaaacagaaagtgagtttccacaagggtaggaatcttgaatcttgtgctatgccatatccttaccatctaagacaatacttggaacacatcaggtgattaattagtatttgctgaatggatgcttctgtgagtgacaatgggtggtaggataccatgcaggaaagctctctgcatactgcaaaatatacacatgtaaggtaagggaaatgatgtgttacaacttgtaattctccgtcactagtacatactttgccatgtcaaatttaagtcatagataacattatcaggctattagtgttaccttcttgactatttttctgcagatcaaacaagataagagtccaagatctctttgtctctccccaaactggtctccctgttgttaatccttttcttctccaggccatcttctgcaatgtatgtcatttatttatttatttttttgagagaatcatatagtggctcctgcaagattgtacacaaaaagatcatccccaagacacataattgtcagattttccaaggttgaaatgaaagaaagaatgttaaaggcaactagagagaaagggcaggtcaactacaaagggatccccatcaggctaacagtgaacctctaaggctgaaaccctataagccagaagagattcacggcctatattcaacattcttacagaaaaaagtcttcaaccaagaatttcataactagccaaactaagcttcctaagtgaaggagaaattagatccttttcagataaacaaaggttgaggaacttcattatcaccagacctgccttacaagagatcttgaaaggtgcacaaaatatagaaaggaaagactgctatcagctaatacaaaaacacacttaaacacacagaccagtgttacttgcaaagcaaccacacaaacaagacaacaaaataatcagctaacagcacaatgacataaccaaattcatacatacaatactaaccttgaatgtaaacgagctaaatgccccacttaaaaggcacagagtggcaagctggatagaaaagcaagacccaatggtatgtggtcttcaagagacccatctcacacttaatgacactcataggctcaaaataaaaggatggagaaaaatctaccaagcaaatggaaaacagaaaaaaagcaggggttacaatcctaatttcagacaaagctgatttcaaaccaacaaagatcaaaaaagacaaggaagggcattacataatggtaaaatgttcaattcaacaagaacatcctaatatcctaaatataaatgcactcaacacaggagcactcagatttataaagcaagttcttagagacctacaaagagatacagattcccacacaatagttgtgggagacttcaacactccactgacagtattagacagatcattgaggtgaaaaattaacaaagatattcaggacctaaacttagcactggaccaaacagatctgataaacctttacaaacatctccaccccgaaacaacagaatatacattcttctcatctccacaaggcacatactctaaaatagaccacataattggacataaaacaatcctcaacaaatgttaaataaccacatactctcagaccacagcacaataaaaatagaagtcaacacaatgaaaactgctcaaaaccatacaatcacatggaaatgaaacaacatgttcctgaatgacttttgggtaaataatgaaatgaaggcagaaatcaagaagtttattgaaaataatgagaacaaagatataccagaatctctgggacacagctaaggcagtgttaagagggaaattcatagcactaaatgttcacatcaaaaagttagaaagaacaaccccaaagctagcaggagatgagaaataacaaaaatcagagctgaactgaagaatattgagacatgaaaattcaaaatatcaatgaatccaggattttttttttaaattaatcaaatggataggccatcagctagactaagaataaaagaaagaagatccaaataaacgcaattagaaatgatgaagagaatgttactactgaccacacagaaataaaacaaccatcagaaacgattacaaacacgtctacacacacaaactagaaaacctagacaagatggataaattcctggacacatacaccctcctaagactgagtcaggaagaaattgattccctgaacagaccaacagtgagctctgaaattgaatcagcaataaatagcttagcaaccgaaaaagcgcaagacctgatggattcacagctgaatcccaccagatgtacaaagtagagctggtaccattcctacagaaattattccaaaaaattaggagaggaaatgtctccccaactcactctatgagtccagcatcatcttgataccaaaacctggcagagatacactaaaaaagaaaacgtcaggccaatatccttgatgaatatccatgcaaaaatcctcaacaaaatacttgcaaaccaaatccagcagcacatcaaaaaatgaatccaccataaccaagtaggcttcatccctcggatgcagggttggttcaacatacaaaaatcaatacatgtgattcatcccataaacaaaactaaagacaaaaaccacatgattatctcagtagatgcagaacaggcttttgataaaattcaacatctcttcatgttaaaaactctgaataaactaggtagtgaaggaacatacctcaaaagaataagagccatctatgataaacccacagccaacatattactgaatgggcaaatgctggaagcatttcccttgaaaactggcacaagacaagggtgccctctctcaccactttattcaacatagcactggaattcctagccagctcaatcaggcaagagaaagaaataaagcgtatccaaataggaagagaggaagtcaaacgatctctgtttgcaaacaacatgattctacacctagaaaaccctatagtctcggcccaaaagctccttcagctcataaacaacttcaacgaagttgcaggatacaaaatcaaggtacaaaaatcactagcattcctatacaccaacaataaccaaactgagggccaaatcagaaaggcaatcccattcataattgctacacacacacacaccaaaaatacccaggaatacagctaatcagtgaggtgaaagatctctacaataagaattacaaaacactactcaaagaaattagagaagacacaaacaaatggaaaaacatcccatgcgcgtggataggaataatcaatatcattaaaatggctatactgcccgaagcaatttacagattcagtgctattcctatcaagctaccaatgatattcttcacagaactagaaaaaattattttaaaatttatgtggaacgaaaaaagagcccaaatagccaatgcaatcctaaacaaaaagaacaaagcctgaggaatcacgttacctgacttcaaactacaatataaggctatagtgaccaaaacagcatggtactggtacaaaaacaaacacataaaccaatggaacagaatagagagctcagaaataaggccacacatctatgaccatctgatctttgacaaagctgacaaaaacaagcaacgggaaaaagactctattcaataaatggtgctgggataactggctagctatatgcagaagattgaagctggaccccttttttacaccacgtacaaaaatcaattcaagatggattaaacacttaaatgtaaaactccaaactataaaaaccctggaagacaacctgggcaataccatcctggacataggaacgggcaaagatttcatgaaaaagacaccaagagcaattgcaacaaaagcaaatattgacaaattggatctaattaaacttaagagcttctgcacagcaaaataaattatcaatagagtaaacagataacttacagaatggaagacaatatttgcaaactacccatccaaccaaggtctaatatccagtatctgtaaggaacttaaacaaatttacaagagaaaaataaacaaccctgttcaaaagggggcaaaggacacgaacaaacacttctcaaaagacatacatgcagtcaacaagcatgtgaaaaaaaggtcaatatcactgattatagaaatgcaaatcaaaaccacaagagaccatctcacaccagtcagaatggttgttattaaaaagtcaataacattctggcaaagttgcagagaaaagggaacccttacacactgttggtggtattgtaaatgagttcaaccattgtggaaagctgtatggcaattcctcaaagagcaaaaagcagaattaccatttgatccagcaatcccattaataggattatagagcattctcccataaagacacacgcatgcaaatgttcactgcagcactgttcacaatagcaaagacatggaatcaacctaaatgcccgtcaatgacagactggataaagaaaatgtggtacatatacatcatggaatattatgcagccataaaaaagaacaagatcatgtctttggcaggaacatggatggagctggaggctatcacccttagcaaacttatgcaggaacagaaaaccaaatatggcatgttctcacttataagtgggagctacgtgataagaacttatgaacacaaagaaggaaacaatgaacactggggtctacttgaggaaggagggtgggagagaaagtagcataactgggtgatgcaataatatgtacaacaaatccctgtgacacatgtttatctatataacaaaccttcacatttacccccaaacctaaaataaaaattaaaaaaagagaatcatacagtggtgttattcttgctacttaaaaaaaggtgatgtgatggcagtgatggtcaataccatatggggaagaccaggtccacactttgtctacaatcaactgctaccacataagtcttcttggttaagtaatttgcgcctacagtgacagaataggtccctggatacacttctatgtagaggtgttctcactaggctgggatgcctctggagcacgctttgatatttgatagatgcctccaggaccaagggatgtcttttttctgtcttttctctgaccattccctatgtccaagtacatgtgcagcttcaacttccctctgtgaaaatgatagacatgggttgctccttctttctctggcacagatgaataatatttcccacactaacttgaagtactgtctatgaattcagccattgttcagaagaaagcactaagggttgggtgtttctcgtctctctggccaacttctcaaggtgcatgcgcccagcactctcaataatctttcaacatggaaatctgatcatgtcacttcccttcatcccactgatcttgggatgaagctcaaatatggcttccaaggctgtttatgagtaggacgctgctccctctacagcttcatctttcaccactcctcctaccctgctctctgctccagccatcttgaatttcaattcttttctcatctgggattgacaggctcattccttcttccctcttccctctctctggctaacgcaacctttaggtgtaagattagagagcacttctcctcagaacctttctgactcttcctgtctcatttacttctttactgttagcttgacttttttttttttttgtaattctatagcatcctatacttctgcaatcacagcatttgtcattcctatgatgaatgctcatttatagcctcctccactcaactgtaagctccttaagggcaagaactctgctcccctgtgcatcactgagccctagcacctagactgctacctaagacacaacaggtgctcaaaaataattatggaattatgaacaaaggaactaatccatgaatcccatcaaagacaaaacaggtaattctagagagtgtatatgtggttagcttttcctttttctttaatgtctttgcttcttcctagttcctgtgcttgattttcagcattcttgtttagcttttacttatgttttggatcaatatacatttctccattattttgtgtttttcgtaccaagcgagaataaactttaccttacctaagtttaggcccttttcctctaaagtctttttcaccttctctgctttcactattttctacttcatcccatattaacaagcatctaacttataaagtattctgcagtgtttattgactataatatttttcatttatgactcattatagtttcatttatgtggctatgttaaagacacttaagtctaatagagaatgtaagggtccttaaagttgaagttccaaaagcaattaaaatttaagataataagctttaaagcaaagccgtctcctatggacatccttcaggaatgtcatactaaccaagaaatctgaaggggaaccatctattattcatactaagggaacagggacaatggcttcacacagctgacttctctttgctactgactagctttttctgctctgtggataatacaaacaggatgaaaggatcttgatactccacaagtaaatatcctttttaagcagatggcttgcaagttaggaaaaaaagttgctctccagtgattaaaacagctctctggaagcccactttattgcatctaagtacattgctagtctcactgggagagtttattcctttcaaagatccagcctctcagctggtaagagttttgataaataattttgttctatctatatgtacctcttgttaatacaggcatatcaatgatcagtactcatgagctagaattgacttgttcatgttcatattgtctcagtaattcaagagacatgcatttgatgaatgaaaatgccttagtcatggaaagaccaagatgcgctcttaagaaaagttgaccatattaagccaacagggtcattgtaagtatctgatgtcaaagtggaataaacaaaggaacatctgttatttgcagttatccaagaaggtggcagcacagtacagtacagtacagtcattaaggcgtgggagctggggtctaaccagacctgggtttggttctaagctctgccattcactacctatatctagaaaatgttcctgacctcctttaaacccaataccataaaatggagataatagtacttaccaagtaagatttttatgatgattaaaggagacaatacatataaagtaaaatttgagcccagtctcaactatctatcaaatgttcagaatattttacctaaattaaatatatgttatcatccaccttcctttgcacaaacatgtgacatgatatcatataaaatgaagactttatttatatgcaagtctttaggtggcacttgcaagcttccatgtgcctatgacatttgggaacttctatctgcatgttgtaggaactgttcatatttatacctctcatgcccatgtggctacattttaaaatgattcagtcatgattcttccagggtctcctgtgggcccagctctgtctttacctaattatgttagtttcaatcgacaactataatacgaagacttaatgaggaacacaaatgagagtaattcacatataccaaaaatcaacttaaacacacactaatataatgttgagaaatgcattatttaaaataccctgtacattatagagaaatgcttatcttcaatcttccacttgctttgtggtgtcagtttactgagctattaatttaaacttaaaagcctgaaatttgaatatacagaatagctgaacagctgcagaaacaaacttataaaaatatatactgttacccagcacataaaaaagcaattatttattgaaaaaaatcagaatttaatattacccagtaactgcaaaagttgttgaaaggatataattaacatttactgaagattcttagggggtaaaaatattttaaataaaacaaatatttagaagttcttagttactagtaaaaacaatctctttaaacataacgttcatccaccttgaaaaaaaatctgctgactgggacatttctagataattttgaagctcaaaaacgccaaatctatcaaaatcagagagttgctcttggtttgtgttgtcacaatctgtgacgagacaatgggtcttgctcaggtcaggggaccattaaggacccaggaaagccagcaaaggactaggagattttgatgtactagaaagacacaggatcaagagtcagaagacctggctctcaccccaactttagctcttgctagcagtgtgactggtctcattcattcattcatctattcatgccagctgctggggacatcaatgaacaagacagacatatcacatatcacatatcacaaagcttattcattaaggcctcaccagcaccctaaaaatggggagaggaccgtagagttgagaagaagtttaaatcaaacatcataggaagaggtccatgatggtcaccactctcatgggatgaaatgtctttggcttcgtttctttattcatagaacatgagtacaacacctgctttctctatttcagcaggtaccaaactctgtgggcatttaacaatgtgttaaacaaatttgaaataaaaaaccctactttattaaaataaaccattaggaaaatcaaataagtacaaggttatcagagcaaagcttgcctagttcacaaacatcttcatggatatgtttaatggcccttcagaggaagccaaatatttgcataaccataagcctccttcaaatatcttgagacttgtcatgatcttaatttgccaaagtgggtccctatctatgtttggcagaaccgttcaaatcatctgaaagctacctgctttttgaacgggtttttactgatgaatttttgggaggagttcagaacctatccaatagaaagtcttttaaccaatgggccctaatcaactggatggatcaatcagcattctccatcccctgtataaaatatactgaccaatactgtggtcaaacgaatactgaatgttctctctcgaactctggagcacatcagctctctctgcataaactgttaatgtcagctatacttgctttgtaattacagaaattaaatattatgttggcccataaaatatgagtgtgaaaatagttatttgtatgaaaatttagtaaaattaaagaaatgaaagtaagtcactagaggaaatctgccattgaattagatatgattgagacaactgtgaaagattggggaaataataaaaatttaaaatgactttgcagtcagactgtgttgcaagtgtcttaaaaaattcctcacttaaagagactgaaaatggaaatcatgcaataatgtgcatgaaagattacatgaagttccaatcagcagacccaaactcgaagaaaaggcctcgagcccacatcaaaagattggcaaataactgttcatttgcaactttaggttaaatacatgatttaggctatgtagtatctttttaaaaaatgattcactgtttaattgatttttcaactaatgagaaaacacccagtcaggttagctaagagggctctgactctgtaaccagcctggaaccctgggaagctctaggtagatagggttccttcttgttgttttttctgatttttaaaattttctaacttttcttaacggttattatttgcttatttaaataaaaactattttaataaaaagatatatatctaaatttcagctatcttggagcaaaaagcctttgcattttattaattaattaattaatttattttgagacgagtcttactctgttgtgcccaggctggagtgcagtggcacaatcttggctcactgcaacctccaccttccgggctcaagcaattctcctgcctcagcctcccgagtagctgggatcttacaggcgtccaccaccatacccagctaattttttgtatttttagtagagatggggtttcaccatgttggtcaggctggtctcgaactcctgacctcaggtaattcgcccacctcggcctcccaaagtgctgggattacatgtgtgagccaccgtgcccggccacctttgcatattttaaacaaagaaaaaaagaggccaaatatttttactcatgtgttgcttaaatgtttagtgattctgccttttgccccccatttctggtgtgaggctacctatctattggtaagactgttttaactgcagttcaatgaatatgacccttccaagtaagaaaggctgaacctttccagctgtaaaggttgattctggggcagcagaaccctaccatgtgtgacaaggtttccttttactaatctggttctcctcctgtatattttgggaaatgacacacgtccaggcaaagcacaccatgggccaaatgcacatcctctctgcccttaaggggccatgactcaaagcacttcactggggatgcccaggggttgtgcatgaccagacatcggcaaagtatttttgagaaacctcctcctcaactaaaaatacccactgtgagaaatctgtagcgtgaagcaaggatcgagtcagtacaacacaaaaaaagagacaggcttgtggcagtctcagaatcaaacccagttcgccctcccttaccagaacaacaagaacaatcaaaaaaaaggtttacaggaaaggacttcttgaaggcagtaagatgggatacatggccacactcattttagtcttgtcttttctctttctccttgagggctgggatggggaaagtggccccaaatctgctcaaagtccaactgaacacaatcaataatagacttactatgacattttaaaaaaatttctactgagacattagttttattcctcagtaaacacctccctgatttctgcatcccaggagagcctgggcaaagaagagcacaggcaagaagtgtgaatgtgttcagagaaagtgttggcgaggcctggctctcccagcccctctgatggctgagaaaactgcttgacaagagggagacccaccaggacagaagcctgagcttcacagggcagacacattgctagtgtagctactgactgcccatggcaatggttctatttttttcatgggagaccttcctatagttacacataaaaaagagacataaaaccggagaacttaacggcagagaaaagtaaaatggtaaatctagaatgttttgcttaacttcaaaactgttgttgaatagtttagaaggagtagggggttgaattgaggtccccaacaatacaggtgtcctaacttctagaacctggaaatgaaactttatgttggaaaaggaccttcgcagatgtaattaagttgagaatctcgagatgaaatcatcctggattacctgagtaggccctaaatccaaggggaggtgtccttagaagacacagaagagaagacagaggagaaggccaagagaagagaagaagacagaagtggaggcagagattggagtcatttagccatgagctgaggaacacctggagcctccccagaagctgggacaggcaagggatgattctgccctgaagcctttggaggaagtgtggccctgaaacaccttgattttggacttcaggccaccagaactgtgagagaataaacattgttttaaattgtccagtttgtgataatttgttaagcagacctaggacactaacactgaaggctaggacagcttataagaagaccggtgggggccgggcgcggtggctcacgcctgtaatcccagcactttgggaggccgaggcgggcggatcacgaggtcaggagatcgagaccatcccagctaaaacggtgaaaccccgtctctactaaaaatacataaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaccggtgggaaaacataaagaaatttctattagaaatagaaatcttatgtgagaacaccaaaatcgcctcctgatgccccaaagcacaatgattctgaggggagcaggagggagggtgcgactctcctccgaatgcaggcctgggccccaaagctgatgaagaaacccgatggctgcatggggccagacctagtgtgagtcagagtcgccaggggaacttttgtcaaaaactgatatctccacttaagggtggctgagtcagaatttctagaggtcaggttggagaatccatgtttttcaaagtctcccatgtgattctaatgatcttccatccttaaaaatgatgggcccaggtggtctgctccctcccgctttcagtgtttgagaagcagatctgcagctgcagccaacttttaaaaaaacgtgtccaacaggctatttattatttaaaacccagctttattgtttatgtaaagcttgatacagatgcattatgaagtattaaacaatacagaaaagcacaaagacaaaagtaaatatccagattcaccatctcaggaaactttccacgtgtatttccaagtgtttattcacacagagatgtctgtgtacactttaacctgctactcagagtgtggtccacagaccagcagcattgacaacactaaggaaattgttaacaattcagaatttcgggccctgacacagcaggatgtactaaaactgcaaatatgttatatcccttgttttgtaacttgctttttccacactgtaatgtattgtaacctctgtccttggtaataaatacaaaccttatgatctttcttaatatatgtacggtattcttttatgtaccagaatttacttaatgagctctcatttgatgatcatttctagtttcccatttttcccaccattgtaaacaatgctcacctaaaaatccttgagaaagtatctttctgttttgtcattattatttttgggtaaatccctagaagtcaaccagtgtgcaattttacgcacactgatcattctgatacctaatgccagaacaccagcaagaatgcccagtgaccttgcacacgaatgcttgttccctcacactcttgccaacactggaatttttctaataattttaacctttgtctatctgatacttaaaaatgacacttcattgatttttttccttgcatttttccaaaagcaataaaaaagcttctcatacatttatcggccatctgtatttctcattttgtgaactgtccaaagttattttggttgtttaaaataacagttataaaagaatctgtggaattacagagtttagaaatatggtttagtcacaatgaaaagacacggagaagaaaaaaaaggaagagagaagaaaatgtgccataaaaaaagataatcaaaagattagtttgtgtgtttatttatagacaccagttacagcaatccagtgattaggcaaattaatgcagctgtgtatgatcacagctctgggatcagcccctacatccttttcaaatgatgccacctgtcatttaagtattttgcatttgcctttcatgttacatatatttcatgatgatttccattttaaaaaccttcttggttaaccctttgaaggttctcatgatatggattatcctctgccgtcaggaatggggtgagctaaccaccctcccaggtaggcaagagaaacagcacgtttgcctctgaaaaagaccaatcctctccaaacgttcacatcttaggaaagagaacagttgcatccttttcactgggtgtaaaactgcttctctgctcagaaccaatggaaaaaaatgggggacgggtcagatgctgtgtactggttgacttcagtggcatgtgcagaccatgcccattccaccgggcacatgcatccctcacacccccagggtgacctcaggcctgctttgtcacacaggcacccaccttgggctccatacccagcacacgcaacttctctactgaacaagtggcaggggtcttctcacagggcccctggaactctttcaacccataagacaacgccaaatgggtgaaaacccacctcatccacccctgccaccctctagttgctgctttatttgtgaattgagacaaatcagtcatcctcatttgctgaccattctctgcatacagtacagcaagagcactatgccaggtggccaggagggccggctgcagggaaacagaggaaagcgtggagagagaaagtctctaggctccactttgcgatctgtgggatatgaacaggtggaataaggtctttaataaacatattttaggatgttagaacaagcaggtcccattacaaaacctgaaggaaggaatttgaggacaaaaggagaagcatgactttatagaacaggttctatgtaaacacacaaagcacatataccttaaggattgtgcatgctaaaacgtatttcagtagctgctagaatgggaacaatagattattaacatgtttgaaagggatagggactcgggaacacatctcaaaaatgtgggtcagagtcaaggaagcttgctgctacagtgtcaacaatgctctcagtgctactggcagatacggcacgggcagaagagaaagctttgggtctgccacagttacaaagagttgtagacttcaatatttagttacgggatgaagaggggagaaggaacaaagacctttaaataaaaagaaacaaaagagtgaacatgaacatagagctacatgaagtgtcaaccctagtgaagtgattatgttttaactgtgtaaataaagttcaattaaatattcaacataacagcaataaaatgtaaaacactgagaagcatctctctctagtcagtgtttggcagatgtgttgtgtttttgcatcttgctctttatggtggtatctctaacaaatttaagggcaaaagtgatgtagaccatacattctagaaccaattctaaaacagcaagaagtggccagatgcccagtggcttaatcagattcttaattctacacactacatttatcctccagtctcactgaaaatctaacagccgagtggtcaaaagaaaagataaaactgcaaaatgggagtgccacaaatttctgctcctcctactccagccaacttaacttgacagggaggaggcagcctctgtttccttcctccctttaaaggggggatggcaagctgttgacaactcctactgtacaaaagagttgttcacactgcaaaagtgtttactgctcacaagtgacgctcaaaattaattcacagcagcaacaccagcagaaagctttgacagactgtcttatgtgttgacacagttatacgttgttgcataaaaaaaagtaacacacttaccctcttttccagcccatacacactgaagttgctccaaagagagactgtgaaatgcgtctgagattgtaaatgccaccctccaggtaaggatttcccgctccgctccggggttgatggctgcaggcatgagaagacgtggaccccctttttgaggtgaagcaaggctgcgagcctctcccccggcctctgttacaactggccttgctggtggtttttccttcaaaggcatttccctctagggcaagcctcaggcaccagggtgggaagtggggtagagctgtttattataccgccttggcagaaaaggagacgccaggataacagctttctgagacacaaataattcatcttcctcttcctttaaaaaacaataaccctgcacttaaaatggctttgggaggctgggaagatgtgactttcttgctcagaaatgatttacattaaaaaatcagaaagaatgtagtgtgatttaattatctcaagttacctgagatgtttagagttaaaaaagaagccaggtgggacagctagtatttggcctcatgtggaagatgttgtacagactctttggctcagctcggcgatctgctgtggtgtgaggctcttgcgtttgaacagttcctgctgagcagcgtcctctctgagaagtcacgggacttgaaaaatgaagaccgttgacactttaaaggtgcttctggcaattggaagtagccacatgtgtaaaaactacgcagtgcaaggactttctttagatggtgatatgtaagtatctattgaaagtaaggtttgcatggagctaaccccaaggaaaactgtggaccaggattcacagccttcccatgcacttttcccttatgcccccccatctccatttccccagccatggtccacaggtgcccaaagagctcttctggctttgccccttaccccatcctggcctatgcttctccttccctcttattcctcctcagcaccaaactctcctttcttttggtcttgggaaggaagtggaggaaagaatccatatcaagatgcaaatgactgacaatttaaggtattcatcctactaggctttggggattttttttccctcagttttaatttgtttggtggtaagagtctataggccaggcgccgtggctcatgcctgtaatcccagcactttgggaggccgaggcgggtggatcacgaggtaaagagatccagaccattctggccaacatggtgaaaccctgtttctactaaaaatataaaaattagctgggtgtgatggcgggcgcctgtagtcccagctactcaggaggctgaggcaggagaattgcttgaacctggggggcggaggttgcagtgagccaagatcgtgccactgcactccagcctggtggcagggcgagactctgtctcaacaacaacaacaaaaaattttacactgttggtgggactgtaaactagttcaaccattgtggaagtcagtgtggtgattgctcagggatctagaactagaaataccatttgacccagcaatcccattactgggtatatacccaaagtattataaaccatgctgctataaagacacatgcacacatatgtttattgcagtactactcacaatagcaaagactttgaaccaacccaaatgtccaacaatggtagactggattaagaaaatgtggcacatatacaccatggaatactatgcagccataaaaaatgatgagttcatgtcctttgtggggacatgaatgaagctggaaaccatcattctcagcaaactatcgcaagggcaaaaaaccaaacaccgcatgttctcactcataggtgggaattgaacaatgagaacacttggacacaggaaggggaacatcacacactggggcctgttgtggggtggggatgggggaagggtgaagggatagcattaggagatatacctaatgctaaatgacgagttaatgggtgcagcacaccaatatggcacatgtatacatatgtaacaaacctgcacgttgcgcacatgtaccctaaaacttaaagtataataacaaaaaatctataaagggttctggatatcaaatagttttagaaccactgtcccagactactggagccctaaaaacttcattaagtggtttcctacttctctgtcacatatttctttttcttctaaaaaaacggggtacatgtgcagaatgtgcaggtttgttacacaggtgtacacgtgccatggcggtttgctgcacctactgacatgtcctctaagttccctcccctcacctcccaacaggccatggtgtgtgttgttcccctctctgtgtccatgtggtttctttctttttttttattattatactttaagttctagggtacatgtgcagaatgtgtggccattttcacaatactgattcttcctatccatgaggatggaatgtttttccatttgtttgtgtcctctcttacttcctggagcagtggtttgtagttatccttgaagaggtccttcacatcccttgttagctgtattcctaggtattttattctctttgtagcaattgtgaatgggagttcattcatgatttggctctctgcttgcctactgttggtgtaaaggaatgcttgtgatttttgcacattgattttgtatcctgagactttgctgaagttgcttatcagttcaagaagttttttttttgttgttgttgtttgttttttgagacagagtctcgttctgtcacccagtctggaatgcagtggcgcgatctcagctcactgcaacctccacctccagggttcaagcaattcccctgcctcagcctcccgagtagctgggattacaggtgctcaccactgtgcctggctaatttttatattttttagtagagacggggtttcaccatgttggtcaggctggtctcaaacccctgacctcatgtgatctgcctgctttgccctctccaagtgttgggattacaggagtaagccacggtgcctggccagcttttgggatttgttagagtacaccgttgactggtggaattcctgctggtgtgatgagatgcagtgagaagtcgtaagacatcctccaagatagaggaggtctccttgatcagtataggcccatgcccaggatacaggtgacctaggatacaggtgttaatgcagccaccagctaggatgcactggtcctacctgattagggtgatgctgacacaggagctaacaccgaaggagcattttctcttttgcctggcactgtaacatatgtaccacatgcttttacaaatgtggttatcattcagtagagtatgaccctgagcgtgagtacttttagcattctcatttaccaaggtggaaattgaggcttgaagaggttagataacttgcttatggttatcatgctaacagaatagcagaactggaattgaaagccagctgtctggagctcatggacttctatctacctccagtggtttcatcccaataggaaccatcaattgtgaacagctggtacaggccagcaccccctgcttcaccatgggacaatactaagacagctagaggccatactgcagatgcagaggctttgcttacgcgaaggtggtgaagttagaagagcatgaaatctgaaggcaaacaatctggttaaaatcctggccctgtttgttgctttgctttaagacctgcggttaatctgtgaactttagttttttccatctataaaattcatctgatactacctgctttacagagttgtttgtgagaactgaataaggtaatacacatgcaaaatgttttgggaagcataaactcttagatgttattagtgttaatatggtcttttagtgggaagagtcactcctgagagcggaagattgactttcacatcagtatcacctaccccacctgacaaatccaggagtgggctctctggaggaccactggggaaaagggagtagaagcatgtaccagttatcagaggcatttactagtaatagtgaagtttgaccctaaaaaacaacacaagatgaattctgtgacatgtggatgagaaacatgaactttcaatgaattcagaaattccacactcacagcctgcttcaagtcctgtgtcagctgctgaatcagagtaggaggcatcattttcttgttggtgattacacttatgcctttgtacactgccggctggcttcaaaagaaagggtcacctttgtgtagttgactcctcattttgtaataattccaaaatgcagtagcttctcccaaagtagttcaaagacaccaacctgctgagaaccaggggaggccatcaggataccaaacttcctgcttctaatggcccaaatctcagcgaaagcctctgaatagataggcaagctccagaaggacagactgtggtcattaacgtaaccctttattatggcgaatctcaattctttttctacacatgagctcacccttcaaataccacatttatgtccatttttgggcgggctgaactaaagtttaaagcattatgtcattgtaaacaaacaatcacatgtagcgtgactctgtggaaaatacagcatttcaattttgtggtattggttccaccataagaaagggaacccaaatgatgaggtcagtgggccagctgccacggcaaagagaatgccaagctgagcaagctgctttcactcacaactaaaaaattaagctcaccattgttatgccagccaatgaaagtgattgcattcctaaattaagtggaaacagagcttcagagactgctcctccttagtattacatgttcatgccaggaggtcaagaggctgttacttttgctgatgatggacataaccacatccaggcttatcccatttagaagccactgctggctaataaaaagtaaatgaaaacacacactactgtgaatcaggtagcagtaaaaatggatacaacaatgtggtagatgttaagagaggaagctatctaagtcctagagactcatccaaagagtgtaaaccacgctcttctgccaagtggctacgacttctacttgcaagcaatgtagcattacgtaagtcaacctgacttggtcttcgtctattttttcctaaggcagaacattatccttccagcatgcaacagggctggtcataccccctaaacagctttgatcaaatctgggttatataccaagcatcagaaccagcctgggttacataccagccacccctcccaccttcctatgtctaccaatcatacttccaggctcctagacttggagcctcagggtcttctctgattttatctttctggttcctctgttgtcctggccccaccaatattcatattcagttttcaccaacatctcacagattactcctttgatatgtgcccagagtccatctctgtctctttactcttacagtcatcatttttgtgcaggttcctcctcccacccctaccgtggctacaccattacaagaacctctcactggtcttccatctctggtttgtgccccagcaacctgtcagggacaccaccattaagccactgtaatggttttcctgggcttacaaaagggcagtccacaactcagcttgtattcatggcccccaacaacttggtgccagcctgtctttccaatcctatttcccctttctgcctggctgaaccacttcttgagccctgcactgtacccactccctgtatttgcatatcatcttttcccacccaaagtgcccacttctgtccagttacgctccaagacccagttaaaccacatctcctccaggaagacagctctggtcattcctgagaacgtgcagcccagatctggatcactcacttggtgataagtagagtacttccttttgatctcttttatagcacttactgctttgatggctattcaaatgcaaattagttaatttcttgtctcttcaactagatttatcatagctcccagaagattatattttctacttttttatattttctctgcccacctcatcctttgtccttctcctcctccttcaaaacccatgtagcaatcataatattaaataaggacttatttttatctgtgtcctaaggagaaaccaggaaggaaattgaagtgaaatgcaagagtaaactcagcagagatgtaactggcccctctgggtggaagacacagcagaattgaataaacccagaattgagtacatctgctgccagcacatcttcaatgctgccaaatgccctcacctacgttaaatcaggtaatcttaaactcaggctttgagatataattcagtatgtaaggaagggagaagaagaaagaaaataattcctctttagaaaagcattttctttttattttattttatttatttatttatttattttttattgtactttaagttttagggtacatgtgcacaacgtgcaggtttgttacatatgtatacatgtgccatgttggtgtgctgcactgattaagtcgtcatttaacattaggtatatctcctaatgctatccctccaccctccccacaccccacaacaggccccagtgtgtgatgttccccttcctgtgtccaagtgttctcattgttcaattcccacctatgagtgagaacatgcggtgtttggttttttgcccttgcgatagtttgctgagaatgatggtttccagcttcattcatgtccctacaaaggacatgaactcatcattttttatggctgcatagtattccatggtgtatatgtgccacgttttcttaattcagtctatcactgttggacatttgggttggttcaaagtctttgctattgtgaatagtgctgcaataaacatgtgtgcatgtgtctttatagcagcatgatttataatcctttgggtatatacccagtaatgggatggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcattagaaatgcatttttgcccaaacacttcaaacacatgacttcgcttttaatccattttaatttagaaatatttctgtaatacagtatagaaatattttgatgatgtacatcagtgccctgtttgtagtatcaacctaggcatgaagagtgatgaaggctgacattttacaagaggatggatgagaagagtccttcctggtcggatggggttagtgaggcaggagtagcctggagcacctggtagagctggaatcatgggatgtatagttcaggtggtcaggggcctatgggcaagtttcactgggatggtaataattatgcagcagaaacaggcagtgcatagaataatctgaatggtgaccatctccagaatggcagcctccagagtgaggcttttcacagtgcccagtcttcttgaccaaaagtcagggtatttgctagaggagctggtatttatgtctaaatggagagctgtatggtctggttgaattgaagccttgtgcaaataactggcatgtgctttggtcagggcaggtagcctctgtgggagagggtctgacagggctggggcaattccttcccatcaacttaggagggtcatgcctccctgtctctggggccttgagtctttaacagttattgagatctacatggcagatacaggcagagcagatggcaggaaacatgggatgaacagatccagccttagcagtggccctgagatttatactcctggaataattttcagttgcctccttgagtaatttttctcctgccccaatggagtgatgaccgtgcaacagtatcacctccctggcagcatgctaaagccattttcttccgaatggagaatgaaactgaggcagccttgtcctccttcttcaaagtagttttcacatcctacaaacattttctgtacttgttgctaccattgtcctccctcctgacacagccaactaaaaccttatctctagcttcatcataacatgttccctccttgttacctacaccttgccatctatcgctcacattttgagaatctgcaccaagactttagattatgatgcttctgcaccagtaaccctcggctacacttctcgcctaagttttactgaatgcttgacattgatcagaattctgttcacaaacaacctttaaagtaaagcattaggctgggcacagtagctcgcacctgtaatcccggcactttgggaagctgaggtggatggatcgcttgagaccagcctaggcaacagggcaaaaccctgtctctaccccaaaacacaaaaaattagccaggcatggtggtacacgcctgtggtctcagatactcgagagctgagtaggaggactgctggagcccaggaggttgaggctacagtgagctgtgatcatgccactgcactccagcctgggcaacagagcaagactccgtctaataagagcagaccctactatgatcaagattactaggagccttgtattctctttgcattagccctcctcccacttatttcctcactcaccagacattcactgggcacacatcatatgctgactcaggtctcatggctggcggaatgtggatgatacactgagcctctatcatcgtctctgaccctttccactgccgccaggtctgtggccacctccactgctgtttctcaactctgccacggccagctcatcatccctacttcttatcttggctgcttcttgttttctactgctctgcctctttccttctttctcttttgtcacttcacccaagcttcctgaatttctccaaggccagttacccttcctcagacatcacctagccaccagggttctccttcctgtgatcagtcagtcccacgagcacaatcctgtgctgtgactctgcgctgttttgttgttgctcactgctacggctgagtttctttatctccagagatacctacataattgactttcttcttctttttataaacttcagggtcagttctattatggataaataggactattaacactggtggctgctttgtgaatgtaacattatggaaagagcctggttttggagtcagagagatctgatttcaaatccttgccaactgcagcagtagctgcggaatctctgacaaatcatttaagttcttctcagcctcagctgccacactggcaaaatgggactgataattattacctcatatgtttattttgataaggattcaatatataaaatgccttacacatagaaggcaccctagaaacacccctcccctggcccactatttaccttctccttataaatgtgatgcagaaaatggctatagtgaactgttaggaaggagaggggatatcaccggcaaaattaagcaaagctaataataatgaacagattaactacaaatgctacttaatattaccagggctggtgtatcataaaattgcacagattaagatgaaaaaaaggcaaaaattaattccacaggagcagcaaaaagcagtggtcaccaaatgtgaacataacagccaggccctacaataatgagcactaaaccatgctatttttcttttctttctttttttttttttaaatcctacaaagaaataggatacaaggaaattagcatgtgagaaagacttggacttatgtgaagaagctaacagatgtgcaaaaatctagaccagattcccatttcaaaaaggaacttgtagagtcactggacccatcctgacagtgaggcagtcctggtagcatgtcatgtcatcctgtgacactagcactgtgcacatacataaaaaaaaatgtctgttccagtgaagccaggaagagaacagacggcaaagcctgacacagacagaaagagggacaggcttgtcttgactccatctgccatttttaaacccaagacacaataacacctaaggaatactcacactaacatttcattcaacaatccctccactgcatgtcacatgaaataagttagacaagagcagttctgcctaaagtatatgctatctgagaggcatactagttctttgcaaatacctaaacagaactttcagatgtttctgctggagtgagaaaaaacatgtgcatttgagtgtaatgtgatggttttcaactgcttaaagaggccataaatctattagcttgaacttcaaagaaacaaattctgagaacatcaaaaattagggtggggcaaggagaattggatctaactagtttctccgttctttcccagaaaaacaatgagaaccaaaccaggctccagtctctttcttctcccaatttttactacttgccacacttttgaaaacatcttctacatacttctagctctggacaaacacattcttattcaagtttgtggttaactccatgagctcatttttctatgatttgttggacatttttatgtggcttttacggagaacagtttaaagtgaattatctttgagaagcctgtgggattctataattctctggtgctctccccaaccaggatgatttattccaagacaattctaaaccaagaaggaggactcgatgcccagacttctaataagattcggctgctgtcttgcaaagccaggcagtgtgggacagctggatgaagtgagtgggactaggcttagattgactctgtgtgatcagagcaagtgatttcacctctttgggactctgggtttgcaacaataaaacataagaagtggtgacagcgatgacttcgcagattctcccagccctaatactctatgagatcatgactattctaatcataaaacacacacacacacacacacacacacacacacacacagtctctctctctctccctctctgatatgttttctcataaccaaaggctcattctagatttaatcaaagatacaaatgggagaaacatggacacgaactggacagtgagagtccatttaaaccagcagggaggctgggcacggtggctcacgcctgtaatcccagcactttgggaggtcgaggcgggtggatcacccaaggtcaggagttcgagaccagtctggccaacatggtgaagccccgtctctactaaaaatacaaaaattagccatgcgtggtggcgtgtgcctgtagtctcacctacttggtaggctgaggcagaagaatcgcctgtgggaggcagaggctgtagtcagctgagatggtgccattgcactccagcctgggtgacagagtgagatccatctcaaaaaaataaataaaaaataaaataaaccagcagggggatacagacaaatctaatagtgggtagaaaaaggatccatgtaagtcttctccttaaaaaaaaaatcattgaaaaaaatcactataatagcttggagatgacaagccaatatgaattactgaggcgaattcattaaatccaccgaaggacacatcctaggagatagaacatattaaactgagaagacatcttccaggcccacctctccagctctaccgatttcttgccactaaataataactcccaacagctctatcaggaatggaaacaaacacaatgagctggggcatagtaaactcaataccaagaccccactttaatgtctgtatgtatgtattaattcacgtaccacatggttttgtaacaagaaagcggaatgggaaggagactggggtgaagttaaacctgcgggcctcaagtaggacacatcagaatgggagccaggttcatctttttgaaggattgtcctttccgcctcatcatcttcccgtacacatgcactttagcaagaagaataaacaggatatgcctacttgacttccttgtttgctctcagggtgacttcactaaaaaaaaaggcatcaaaggcctttatgaatccatcaccagatttttaaaaagtctgtttacagtgattctatatgcccatggctaaaatctggaatttttctctttttatcctttctccacccttttcttctttctctacgtcttctagtcatcctctgccatgttcctcatgattatgttttataatatttaatgttccatgtaaaaagtggtgtgccttgagctgtttgctggaagagccagacagacctaacacgtgatcataatttagtaagaaaagtgagggagaaggtggggaaaggtcccctgcaggctgtgtgcatgcacagtgactggctccctgaagacactcaagctgactacgtggagctgtcttcgcttatagaccagctgctgcctcatcacctctaggttgccacgccccacttactttctgatagagcagagttcatttgttagttctttatgcaataatctccctcccttttttttctggggaggaggggtaggggttggggatattcaacaaaccaacagtccttcaacagtatttgtgaatgaacacggtaagcgtgattgtgtaacagtgttcggatgtgtccttatcttccatttgaacactaccagttgtacttccacacaggtgggggtggaggtcctctaattcaactaagaaatcccttttagctaatgagactagagaagtaaaatgtaggaaagggaacaggaagataagtggccataaaatctacaagatcattgtttcagacggttaagccagactccagctaatagacaccctccccaaatcagggcttaaataacatggaagtttatttttctcatgtaaaataagtcaggggcaagcagtccaggatgatacggagcttcctcattcatcaggacccaagctcctgccagttttccttcctaccagttctaggatacagtcctcctcctcttccaagtctaaaatgatgctggtgctccagccatcacactcatgttccaaggaaccccatggaaaagggctgaagaagggtgcagtccatccctttaagacttcctagaactctgacgcacacttcttacatctcattggccataacttagtcgcatggccagtgaggctgggaaacacaattttggttagcagctcaactatacaagggattctgctaattggtagacaaagagaagaaagctacttggtgtcaaactagcagtgtctcccataatgaaggctttgcaagcttccttatcttctgaggctgtataatgggaagattagcaacatatgcaacaaatgggaataaaaagaacacaattacagtaaactatagtaatagtattccattgaattgaaggaaaatgatagatttttccacctcaaaagacacagggatactttctaatgatttaatgtcattcacaggaaaagggtaatataccacatggtactacagaaacactttggctgagcccaggtggtagcaaatattttcaatcaataggtttggacagtgaaatagacatgaaatcctctaacttgtatttaatactaattcagacatatgaggtggaggaagaagggagataaaacaaacatattctacagcaataaaatgatcatgctaaagagttactttgaattaattaagacactgtcacaagggaatgataattgaataattccctaagatacaatgaaagtattcctggttggtgcgacctggcaacttatattaaatactttaaaattctgcaagttcctgactcagcaattctatttctagaaatttaacttaagaaaaatagccatagatacacttagagacttatctatgcagatattcatcaaggttacttatcatagtaaggaaatgaaaaaaccttcaatatctaacaagaaaggactggctaaatagatgctagtccacaaattctagtgcagccattacaaatgataaggatgataaggttaagaaacttaaggcatggaaaatagtcataattttataaaatgtacaaagtaggttataaaataaaatgtattgcgtgatacatttttttttccaactgctcccccacccagggatggagtcttgctctgtcctccaggctggagtgcaggggcgtgatctcggctcactgcaacctccacctcctgggttcaggcgattctcctgcctcagcctcctgagtagctgggattacaggcgcatgccaccatatccagctaatttttgtattttcagtagagacggggtttcaccatgttgaccgggctagtcacgaactcctgacctcaagtgatccgcctgcctcggcatcccaaagtgctgggattacaggtgtaagccaccataccccgccccgatcccgtttttttttttttttttaaaccaatgaatctatattaccatatatacctgaatataaggtagcctcaataaatgatctcccattttaccaatgagaatacaaaataacaaaacaaaacaacaataacaaagacaaacagctttgctaacttgagtatataaactctgaggaatgtgataaaataatcatcttcttatgatacctaatttatttagttgtatatacatacttcaaattagattttacacatgataataggttgatttgtaagtgttttctgaaatcatattttattaaaaattctattcaggctgtgtgcagtggctcacgcctgtaatcccagcactttgggaggccaaggagggcagaccacttaaggccaggagttcgagaccaacctggccaacatggcaaaaccctgtctctattaaaaatacaaaaactagctgggtgtggtggcttatgcctataatcccagctatttggtggctgaggtacgagaatcacttgaacccatgaggtcgaggttataagtgagctgagattgcaccactgcacttcatcctgggtgacagaactagactctgtctcaaaaaaaatttttttttaattcaaatgtttcacattcatcttcaatgtcttcatcattgttagaacgtctttcgagtcatctaacacctctcattgtctgagatagaatctttgacttagtatgtgatgctgtcactggatatttgatcctgagtgggaaacatccatttccatcatattaagaaagctggtgttatcatttgggctgtatgtgatctctgccattgcatcacttattgtgttgttcttaaaagtgctctatataaaaaagacttgctcagcatggcatccaatcctaggctatggggtcacatctttagctataatggccaagtttctgttgaatttcaacacttatttttacagcaattctatcaagtgacctctataagcacccaaaactcaagctgattgaggtgatttcaggataatttcaggactatttgcccaaacagtactttgttattcaaaataaaataatagaggagtgtccataatctgagacttacagggagttgattataagatgatgcccactttaaggataatgtttggccaaacaaaacccccttcttgccttatattcagacatatttcatgtatacacaatgaaaaaaagattatagacataaaatctctataaagtctacagtggttactgctgggtaggaagatcattataaaagatttaaattttcttctgtttgcttctattttctaaagtttcaatgagtaagagtgactgtgataattagggaaatagtattaagaataataaaaaaaaggaagagacattatacaaataatacattggacatgattagaggcaggctaagctagccttgggtgtgatttaaggtattccagctaaaaagaattccctattggcatgaaatttgtcactcttctgggtgacagccagttgcaagttagttaaaatgtagatgtgtttcttagaaggctaactcatttatccactatcctccattcactgcagattcctttatcaaattcgtttccagcctcagacagggtctggagggaacgagacagtgacagggataggtctgctttatgtgaagagagatgatcagaaaggtcaggcaccagacacccctttccttctactccccataaagtcttggcagctagagagctggggaataggactgagatggtacaatgaaggaaaaattaatagtaacatcgatgacaatatgaaggtagtgtggcttgcagttaagaatgcagtctctagaacctgcctgcctgcttggttcaaattcacctctgcccattatcggttgtgcaacgctgggcaagttacttcccttctctgtgccttggtttcctcatctgtggaataaggaaaacagtttccactccacaaggttacctgaaccacacctccccaccctggtaggagcagtatgaaaaaggccaaagccttcaaacctttcatactctgaccccagtttgcctttctgaaagcatctcttcaacacttccttctgaggtaccctgaggccattccatgaacccctgtgcacctccacatcctccacttttgctggcattctatctatctagaatgtgcttctcctctttggcaatgttttcctcatccttcatgaaacagctgaaacgtcagctccttgaataagccctgactgagggctgcccccattggttggtcaacaaatactaatattaagagcctactatgtgtcaggcactgtctcaggcactttaaatacagcagtgaatgaaactcctgccccgaccctgctcaacactcataatcatgaactcttcagcatccctgtggagatctgctatgacattactatatatgttatagaactctttcccctgttagaaggaaagtctttggagaaaggggcctgatcttacctgtctttatgtttctagtgtccagcacagaacttgtcacaccaagcacttaataagtattcgttggatgaatgtcatcctgaaaaattttcatgctagaaaatgctcacctacaactactttgatggcaactctaaataggaatatagagatgattcatctagagatattttttcctttatttaaaaaactgattccaatggcttgccttttgggaaaaccacatctgttaattgtgtacaacacaaagaaaagtctatttatttagctctggatccctagaactttatacagtgctgtgtcatcagtaggcactcaataaatgttttttgaaggattgggaaggacagagggaaggagggagggaaaaacagagggaaggagggagggagggaggaaggagagaaggagaaaagtttgggagccaagagaagagctggaagagacagagcattatccctgaggccagtaaggcactggcagagctgccatgggtctggccccagaggaggaaagcaggggttgagccaaaaaagggagatcctggctgggcctgcccgcatctgaggcaggtttcactcctcaggttcgggaaagcaccttcaggaacaccactgtttcagaatgacagtcctgagatatttaaacaatgactgggtgagtaagccccactgaagagagtaataaaaccaatttcttacaaatattctagaagcaaacataaataaattcgtaatccttcctgacacactccatttggggagttaggcttcctattcacctacaatgcaggtgagtaaacacaagtttttcaaaagaaacagaaacatgcttatgttgaaagatcccagagagcgatcatccgtgattgtaaaacacttctcttccattaaccaacttctcttccatttatttgtctggattttaccaaggagacaaataaagatgggagcagcaacatccttgtagacgaaatcactaataaaaaaggatatagttcccagagatcgtgacctttctgtaccactctctcaaacactccctcccaccccccaaataaaccacatataaactgagattatggtggtgattgcagatgcagtttcagggtaagaagagactaaatcagacactgtatgtgggagagacaagcgcatactgcctgacacatagtgggtcctctttaaatgtttaaagtagaaaaaagcaacaaaggaaagaatagctcatctaatctgtacttggaatttctcaaattactcataagagcacttaaaaaaatccagaaagacagaaagtatgcaacccctgtcaaaatagtattaagtgctgaaacacagacaaagataggtaattaactgctactagcttagatgaaaatgtctgcaatcttgttcaagtgcttgggtaatataaagcatttggagataaacttaggaagatgtgggggttgcaagtgaatagaaaaagtgtttacaaaactagtacatagtcagctttttagaaactagttcacacacatataaacttttcagtgaagagtttaaaataggatcaaagctctcccagaatgatggaaaaatgcttgacaaggcttcttgaagctccctcgagggtctctttctgcagatatatcctttaaaattgtgtgaagtgacattctcccaaatatgactggtgtgccaggtctttaaatcaaatcattcatattataatatgtgaacgcattaagtctccctctgacgaatttggacatcttgacccactccactacaaagagtaggatatcatcttccgaaagtacatgattggatttgcacagagaggtaaaacacatgggtttaagtaagagaagacagtgtagaaggcagctggggagaaaccggtagaggaagacaatgtccttgtgtgtctggcagtgtcattttgtgactttttctctttgacttccaaccacactttatattttcaactgtgtaaccaataacacattaaacttcaataagagtttgaagctagaatttttgctttaaaatttttacattaaattctatgtatagacttatgtgcatgtgcacagaaagagaattctgaagatgtgaaagatgaataatttatttttaagattaaatttaggggtagtgaggtttggggttaaatctaagctagaatcaatagtctttcatcaccacgtgtgaccaaagatgacccgcagaagtgatgttacctgactctgttgaactctatgacataatgtactgaccaaggtcatgactctgattcctatggcttgccttttggacaaaccacatctgttaattgagcacaacacaaagcaaagtatatttatttagcactctctctcttgcgtgcgtgtgctctgtgtattcatccttgttttccagtggtgtctgtcctcaaggaccaaagttgattattctatacgattctgaggcacagattctgtcactggcatatatgaaagttttctaaaatgaaatataaaatcagaagtgtctgaaatggctgtaactactccatgacccataactgatggtcaactcttccaagaccttgttctaaaccagatgatcacacatacttaaatagatgactggtctcaacacacacacaaaatagaaaattgaaaaattagtaggtgaattgtttcaatgtgaataatcaaatacattaatacttctaggtaaactctttttgatctctttgttgtttcttaagcactcagatattaggattaagatttactaaaagataggataatgttaaattaacaattgtcctgtaaggaaactctgggagtaaactataagaaataacttctaaaactaactttacaagtggtttgtgaatgacgattaaaactattcatttcagatattagagccaatgacagtgaagaaataaaaaatcttgcagtagcctccaggagacgtaggataagtcaaagtgaacatatcatagctcgatcctactctttcatttctactgctacttaaataaaaaagaaaaaaatttttcccgaaagggtagaatatggcagaaacagtaagtaccaaacccagcaaaaagaggaagttggtttcttacatagaaatgggtaacttgctatatgcaatatttaaaaaaaagccactgcaagaaggggcagtaataaaaataaattattttccttattgcaaagtatctgagggtaggaaattgacccaaactgccagagaatgaggaagcacccttttcaccctgtcctcagaatgttatttcataatttatcccttcctcagatggcctttttctgccacgtccctgctctctgctcttcagctgtcctctctccaaactcctcaattaaattatctcacgtttttctctgatctgctgttcgcagcttgtcacatcactataccataagccttcccacatgctgccgtaacagtacacttggagagccgttccgcggcagccactcgctggtatcctggatcccgggtgcacgagggtaccctacaacagtagtttcattgtctagaaggagcaaggccaacccacctagtcttcttctaaggagcatatgggttcacatccctaaaaattaggaaatgtgctatgatcaacctgtttaagcaacaacccatgtgccagatagtcaattagaaaaaaaaattgtgcttgtcttcttcctgttgtataaaagaacaggcagttttctcctgagcaccgtaattgaaaaaataaagttatctggttatcacaagtgcacagcttttcatcttgtttttgtttctgcaaataaataatttgggtctgtaagacatctttcacaaaatgatgtttcaaaaaatttttacagaatactctatctagaatggcatgaattacccaaaacagtaatacaaagaacctacatgccaaattaaaacattaaatcaaaaggccaataacagaggaaatagaaaatcttgttgcaaaatgagatgagattacagaaagacacacagatgaaatcctctagtttgatgagacagaggtacagagaggctcttcccaaacagtccaactttaaaggaacacctcattgacttaaaggtggcaatttacaggaggcagaggagctaatggctgacaaatagtgaagcatcgtgcactagccaggaagattttccattcaaggagtttaaaaacataggagacttggagccacatccacccaagtgaggaaaaatgttatttttttctctcccgtacccaagtaggacttactgatctaatcagaaaccaggtggtcaaagcctcagatgcccagaggggaggaaatgaacaggtccatcctttcagctgggaaatatgacaatattgtaccaaacacattaaaaatatgcatgcctttcgatctggtaattccatttcaaggatatctgaaaagatagatacacagaagatgctatttgctgcacttttcataatgctctgccttgtttccaacagtggaaaaactagacaacggtggaaaaatgtccagtaataagccatgaagcattcatacatggattctagacagatacttgaaatgatgctctagaggaatattcaagtgacatggtaaaaattgaagagattacaacatttaaaaggatgtgaccaaaaagtgggaatgtaatggttaagtgtctgttttacacacacacacacacgcatacacgcacacctacagtcaggactgtaagacacattcaggaatggtaaaattataagtgttttgattctttccttacttgcctttttttgaaaacatcttttataaaaacatgttgttttttgataaagagaaaaatcagtaataggttttgaaaaaggaacacaatcaggtggtggtctcgtgtacagggacctatgaaacaccagggctggaagggccttgtggctccctgagctgcttctctcatttgagagacgaagaaccaaatgcttccagagtgggaaggttctgacctcagaaaagctaggcaaggcatcccagcaggcagaacaagagagggacacaggctgctaagggttgccccagcagggctgagtaagtaggtggagtggaagtgatgcggatgtatgatttgagagtgtgagttcaacagaggtgtgagtccaaggtgatgctgggcttgggaacaagaacaaataagaacgtaagaaaattaggacaacagagatatgataaggggcaagtaacctacatttttttccagcgcttctatgtaaaaggctcatgtttactcatgtaatgctcaaaagaactcagaaaataccagtactcccaactcactgttaaggacactgaagttaaaataactagcattggtctcagggctagcaagtaacagagctatcatttgctctcaggataaattccaaagtccatcttcttcctaccgtgctacacattgtctcctctgtttgatctcctgagagaaatatctcgattcatacaggttacttatcagctgaggcatctggagtttctattgcatcaaacatctcagttggtgagtcaataacatgggggatgcccattgtaaaatccagcataaacgaaacattcaaaaggatatattcatggaactggaaaggccagctccccctgtgcatgatggagagaagggaagagtggtattacaaaaatccaattgctggatatataggcagatgaaaatcttttcatcctgctctaaaggtatcaagaaatgtggggtcctttccttctaaaacacagcctgcatctttcactgggttccaattagtctgtccttgaactgccagaagtccttagcattaacagtgagctgctgctatcctggctatcatttagggaggagcataagagcaggcactgcaatatcacctctctttggtctgggaaatgggcagcagacagtccagatgccattaaatgggaggtcttaatcacctattagctacttgcagaaaccaagacatgattactctccttcaagcccccagtacttttctcactgcagggttaatgaaaacattaggtctcctcctcttccctttcttattgttctgatcatctccgaggggtttgattagcaccagagccttctctgtagttatccctgtctacagtgataagcaaccaagcccacccctgcagcgtctctcatgcccgtgccagtgtttataatcacatgcactactctagtttggacttttattggacaattgctgtaccctcccaactggtctccttgtttcaattacccttctacatcatcagcaagaccaaataataattattttacaatggataaaccctcctcaatggagcctcagagtctactgagttaaaggtagttttaattcttccatgcagttttcaaagttgcttgcaatatagtctcaattttactttctagtcttattcacatctactatctaacacttatcaattactacggccacttcattacttcaaatgtcctgagaagcagacactaacatgggattcgatgtgctagagatttcttggggtagggtgcaggaggaggcaagaaaagccttcagatcgagatgcaggtctggcccctgggaaggagaggaggaaggaaggaggataggctgtgaagtgtcttggagtgcagcatagttccgagaagggtttagccatgtcaatggggagtgcttgagcccaagcttctcagtggaggaccccttgtgttgctggaatgggcatgccttacttagcacccccaccatgcatggtcaatggctgggagtagcccttgggaagcatagccttggtgccaaaacagtggtgggttcagaggggcagcagttgggatgtcagtcagtcagtcagtcagcggtgttgcctaaagcaagagagctgagcggtgcattttcatggccaccacagtcactgtataattcaccattaaactgggacacttttaagagtagaagagggacctatcaataattacacgaggcagacaggtagaaccagggtccatctaggcaaactagaatttattgtcactctatggcaacagatgcatcaaagggcctactcagtgttgactagcatagatctttccactttttggcattctatcagtttggaacagttttataacccacaccatggctacagaaatcctatgcgttttaaaactgacaaatgtcatcttctgaatgttgtcttttcctccttggaatcatttcgtgtgtccctttcctgaaatactgaccctttcctgctatatattttatttttttgagacagagtcttgctctgttgcccaggctggaatacagtggtacaatcacaccttactgtagcctcgacctcccaggctcaactgaccctcctgcctcagtctcctgagtagcttgtactgcaggcatataccactatggctggctaattaaaaactaaattttttttgtagacacagggtctcactacattgcccaggctggtcttgaactcctgggatcaaacgatgttcccaccttggtctcccaaagtgctgggattacagatatgagccaccacatctagcctctgctatatattttaattaattttatattatctgctcctgccataagacagtaagatctgtaagggtaggaactatgtgattttcagtttttctctggttgactaccacatcttgcagacacagtggacaccaacagaaggcatactcctaaatctgtagtgtcccaactccaacttccttatggcttttcagttttaaacaaatacttgagtcatcttgtatttcttaagtgcaaattttccctatgtctttatagttcagacagagaattcaactatcagccaatcttggtgaatgaattcttttacgatttgttaattactttgtccttttttctgctaaaagcctacattgaattacttcaactttgcctcaaaagaggactaacaaattgctgaatataatttgcactttaaacaataaagctattaatggcattttagcaagaacacccattattttctctgcagcaataaatcagcatttcatctgttataaattgcttggtcagcttcaaatggctttagaataaatctctttctcctttctgcctctgctgtccatgacaaagaaaggaggcagaaggtaaccctgtgttctgcattcccgggcatataattttcatgctgcacgactctataatttatttctagcgataagcatcttgtagtgctacactggctgcatgctcacacatgttcaaatgcacacagaaagacacaggtaactcttcagcagtaatgctgaaataaagaggcttccaggtgaagggctcagtgactgtgtatggtaaaattttgatgccaactgcatattttagtaatagggcagctgtaaatataaacacaaatgttctaataatcagactatttttcagccccacctccaaaatatgggtaaattccacaggatgattagataaggcacagggttatcttgttaatattaggctattgtacattcacatttctgagaaatatacttaataagttttactttttaaaaatcattttcattgaaagtcttgaatgtagcatagcatcacaaagtaggtgcctaataaatatttaagtgaatgagttaacagaagaatgcctttcatttagtctgcttaatgcttaagtcacgttatttagtgttattcattcatcacaactaaatactaatatgtcatctatatttactacaagctagtccctcttctctagtttataatttgctgatacttgggggttatgtttactgtcagttatagcgctaacatttcaaacataaggaggactttgtgaatattactatggataatggtgattagctgcttttggcatcctaggcagagtgagagaaaacagacttaagctacagcatgagggattcaagttagataagaaagaaagcgttctcgtatcaaatctaattaagcaccagagtagatgaatgaagggagctatgaaacattctttcttggaagtttttaaaaataagacgaaatctcatcagtacatatatcattaagtatgctcctccatgaagataaggaggaattggttctaatattctgtgaaaggcaagtatatttattaaggttatatctaaaaatataattttcagagtatggccatttcatgtaaagtactggtatcaattcatagtcaagatcatgaatcacacgcccaagtggtgacttatagttctttcatttactaggtgactctgggcaagtcactgtatatctaagatccagattcttttcctaaataagagtaatcctgcttctaaatactactcctcaaaataaattaaatcagaccttgttgggtaagttatattctgaataaataagcagtagaaaatctgattccttcaatttcaagtcatttcaatactatattctcagttaatgtcctgaaacaaataatctatatataaataagagtttttctttttatcacactagtaacaattagaaaagaaacactaacagataaattttagattgtggcaattaagtgaatagcaatctgatagctataggatttaccttcaaaatccaggcacattcatgtatttataccaatctctctccatgctaatattcttacagaggaattttattaaaacatggctgaatctatcatttcagtattcccaggcacaaggcagtgaggaaataaaacactccttctatgttatggaacctagagaaaataattctttcctaaccagtggggtacattttcctccttgaggttcgtaagacaaattttgaaaaaatcatggtgcagactatgtaatttacgcttaaagtattgtaactgcttttgtgttaggattcatattatgagaaaattcacatatattacccttttacggcttggttatagatctattttgattatggtcattggagcctaaaacatccacaccctaaaaagaacatatcattccaatctctatctcttttaaaatagggactttgggctatagcatgtttttctcaatagcccaactccctactcagagatactactataaaagctgtattttggctgggagtgagggaggaaacaaccctagctatttgcagagtagaattgcaggttccattggcaaaaaagtgccagaagtagaggaaatgcaggttacaaagcatacagaggaagagtgacagatgagatgaacaaaattgattcatggagagaatcagatcaggacaaagggtaaaaaagtctcaagagcccaatcacgtcaaaaagatcaatttttaggagaagtgtagtcaatagtgtcttaaaacaaaattagaagtggaagcaattttgaaggtcatttgaagagtaatctactccttttatagatgagaaactgagacctagaaggagtaggtgactttctcaaggccactctatactaggaggtgacagacatgtgctgcacaattcagaataatgagtggtaggttcagaacccaaaaagttcataatgagccagggtagcccccttcctctttaagggaccctctctctaagcgccccagccttgctcccaaggagcactgcaccttctgaatctggtgagtgatggggaacaacaggccaggaagggaggaagtatatctgccaatgctcaaaacgtgttcattctgatggccctagttctagcctgccttttgaatagcactgcgttagtcagtactggacaggaagcacaagtgttactttggcagggtcctgtccgtagaaagagacccactgagagcctcttgtgtacagccacagacaatgggataacccacatgctggcccctcccagtcagctaccaaggcagactgcggaaaaggggacaaactggcaggaagaacttgaagcaggctcaaccataagtcaggttgcacagcagacatgaggagaaggggcactgcaaagggagagctagggatcataaatccaatgctatttgaggcggagtgtctgcgatctgtaatttatatggatataataagctccatgcctaagacaccgcagccccaaacaaccaccaccaaaacacaaagcacatgtttaaaggggtgaattacccaaaacatcaggtttctccacatggctagactaagaaggctgcaaaatctatcactgttatgggctggaaagccaaccaggagagccttcttaggacttctaaagggaaacattctggatgaacctcttggtcttgtaagaagggaggctagttatgtttaactataaacacatggcagtaggtgtcagcgatatgttccattcgaagactatataataaacatcatttttggaaaaggaaactaaactaagaatagataacctgagaatgccatgcaagggctagagcaacttcccatccttttgcaagcatttagcaatcaggtttcgcctttagctgaactcctttcatttcatgcaatatttaatttatacagagatgattcatttgcaatagtaaatcatcacaacattctgtaaaaacaacaacaataacaaaagactagaaatataggaggcctacaacaagcacctaatttaaaactgcagcctcttcctatccccaaattggccctcctctttcctgctctgtttttaaatttttttcctagcaattaccaccttctaacttactataatttgcttgtttattgcttattttctgttttcctccaatagaatagaagctctaagagggcagcaatttgtgtctgttttgttcacagacacatcccatgcattgagaacaatgcctggcacaagcaggtgtgcaaaaatgctggccgactaaaaaaagtcatggatgggttgtcaatattgcataaagtcctattctcagatgacaattgaggtggcctcatcactaactacaagagattttttttccccaatggaaatcaccaaagttttaaaaaagattggaattccaaggttagtgagggagttccgctatctgatgaagcagtgactcacctgaaaagttccaggggacctaatcccaatgtgcatggggcccaacctcctgaccagccttgcatatctgaaggtggggagggaaactgaggtaggtatcgagtggtgtaaaaaaaacgcttcacaagagtttttctttatagccttacaattttaatacttttgtatagcacttcccaggcataagcaacacttccactgcatcttactctactttcataacaacccctgtaggcagtaagaattatattctgaatcttggagagtgtgctacttgcccagggtggttggccaaagtgggactgttcctattttggtttaagaatgcaagtttttgggttacaaattcagtcctttttctacatggcatggccaaaaataacattctcaaagatgggttacttagctgccccactctcatggtttacttcaggggagcattgtacaaaaatgggtgattgtctagttttcattgccaatatgctgggaaataaagaaaataatgagagaacaccaaagtttctactaccaaacaagtaggcatttcaggtggtctttacttagggccttgcatttcttaggctaagttgtgttatattgagctgaggtggaggactatgaaaaagaaaggcagcagatttcacagggaccattcaaagccctgcaggaacaacaacaacaaaaatgctatgaaacaacacggagtaactcttgcataaaaatggagaaaagtagggtctaaaatacatgcaccaaaacccaaaaaagacatggaatacatgacccaggcggccctgaaaatctcatcctcacacaaagaagaactgtgcagcatccagagagaagaagggatggtagctggggagatgagacctttggagaattaactaccaaaggggatgaatcagctcacgtctgacaacacctacagattctgtcaaacctgccgcactcttcaagagcttcaaggctcacaaacaggaaattgctgggtatgacttaacctgactctcaacctccttagagaagagcttgccccaaaaaggtatgaacaaagtgcagagccaaagggcaagaggtgaagaagaatacgagctcacattccaggtgtggggcatttagtggaaggaaacacttttcgaaacatatgagttatttgggatttagcattgggctcaatgccaatcaacatattcacttggtagaccaacacttcacagaaatgagaaaagagaaaacaattacaaaggaactctaagggcacaaaaatttgtgaagaagtgagattgggttgttaatttattcattcactcatgatattctgcatcagattattttcagaagcaaaaaactttgaattgacctaaacagtaagtaaatttattattttacacgacagagttgcctggaagtaaagccaacccaggactggtttagcccacagctcactgatatcctcgagggcctgggttctttccatctttcggtcctattttgtaggttccagggaaacccataccgctgtgcatgagccaagctgatgaccagatcttgtatatctaacaacaaattcacccactggatcaggaactggggctgggaccagctgcccgagcagatggccgcttagaggagaggaaatactccaaccaaatcagggttgcaccagctagaaaggggctaatggccattgagtgagcccctggagatatccacgatggtcatttgaaaggtattcattgagcacctactatatgtccactcctgtactgatcactagaaacacagagaccaggaactgcctgcacatagacaataatgaggaaggcagacattaatgaaataattatacaaataaagataaaattgcaactgtattaagtgcgatgttggaaaggtatgtggtgtcatgagagcgttaactgagggggaggtgatgcctctctgatgaagggatatggagctgctggggaaggggcatggagaaacatttcagacaaagggagcacaagcagtggccaagtagaaggatggggtatggcacattcaaaaactgtccccagatggaagacagtgagggtgagcttggagtaagacggagctaaagaggtaggcaggagccagtccatatgagttgtatacaacagaagataagattaacaaacatctttttaaattttaaaaatattagaccatttgttcacataaagttttacacaaacaaaagctctaaaatgccttggtgcacaatgtagtgtgactatcaaatggccattccccttccttgcaaaatgcatacttctagccatttcacttacactatctcatcgagaagaaaggcaggtgtgggaggcaaggcacaggtagacccaggagcggggttgaaagatgaagccacacagtcataactgattgggacaggaagaaaataattaaagaggccaagctaggaaagggacatcaggaagagcgtggctttgagacagggttgaacaggatcaggggcctgggcaggggcttcatgatgtgtagtaagtaacgagagacgggtggttgagctgggggatgggaaaagacccaggagcacagggcagagtccagaatttacttccctctcctattctagggaggtaacgatatggagatggcagaactcagtctccctctgtgtcttcttttggtggggggggggcacttactcacatagcaagaggttacacaaaactattcaagggaaagtgccacaaagtcctctctcagcaaatgaaaatatgcttcagaaataaacaacactgccactccctcatggggctgaaaaatatcatctcttaatttgatttcttagcactaataaactacatcataatctctcaatagctgagtataaatggtcgaattaaccatcttctgcccttcaaatacttaatttccatggtgactaattatgcatttcttttaccacatggatgggcaagtaactaaatgggctctatcttctaaagcagacatttaacgtgtgacaaagtcctctcagataaacttgtctcttttgaaatgagataactaattactgggtaagacagcagaatcgtttccctactgggaaatcaactacgtggtctagtagaatgaaaggcacggaccatggcaaatcaggtctgcaaaaacagtaaacaaaacaagccaacagaacaattaacacatgtggaaaaagccaaatacagtatccactgcacagctgatttgattttaagacaactgaatatgtgtttcagaaagaaagggaaaagagtgaaaatatatggaagtataagaaaagaaacaaaacatcctaaaagtaaaataaggcaactaaaggcaaaggaaaacttttatatacgcagacctcatagactacacaaatccctttgtctgcattctctagagaattaagaaatggtcactatacatatattttattgctcaggaaggaagtccacatctcttccagaattctaactattaaatacacaaagcattgagccatgcagataattctcttttcaaaatagggacataacctattttctctagatcagatgtagctggctaactgagagcccatagctattgtggtaaccaggagaaaaggaaatggatgattaaagtaaatctaattcaataagctagtgacattgtactgtacaaaactggggatgggaaagaggcggatacaggccaaaggaggaatagtgcttattttgttccttttgaattttatcaaattgtgtatatatttgtgacttttaccctaaggagcataaaaaactgacaataaaagattatctgaatggaacattggtttttggtaagtgtcaagcacaaaaggaatcataatttttttcaacgagctttcaaagtatgtatgctcttgacatctgctgataagctgcagtttcctcctaaaaacttaaagcttctctaaattcaacataagcttgctttcagtatctgcaaaatatatgtggataaaattgaagttttcaaaagggagttaccatagaaacacacaactccctaaaagagcagtccatcatctcttaaggggaaccgtcatcacagacatgtattcagtatctctctgtgcacgtgaggccttagacaatacacaaaggacagtcagcacttgcacactggacaaatacagaaattagataagccaagtccttactctaagtaagcaaggcggggatgaggccctttgtgtatgtgcatgtgtgggctgtaggggacaggaatcatgtgagctggatcctgtgatgcagctaaaatgcagccatcataacatttatttaaaacacaattctataacaatctggccagtgcacacagttatcactatggactgttttctgtgaattcttttaaaatgaggatctaagtactagaagcagcacgtacaaaaatagttttatttttactagcagagtagactcaagctaaaaataaactaaatgggaattttgtactgcagacttttcaaaaacagtgtctgtatacctaagacaaacaccacctcttaattagaaatttctgtaaagcattccaaaaaggccacactattttcagtcagactatatggttcttcagacttggtttctcttgagacaaaagaaccccatggagacgacatctaagttggagtcttcacttaaaccacttatggtctttatgaaaggatttttgggccaggcacggtggctcatgcctgtaatcccagcactttgggaggccgaggccggtggatcacgaggtcaggagataaagaccatcctggccaacatggtgaaaccccatctttactaaaatacaaaaattagctgggcgtggtggcgtgcgcttgtagtaccagctactctggaggctgaggcagaggaattgcttgaacccgggaggcggagcttgcagtgagccgagatcgggccactgcactccagcctggcgacagagcgagactccgtctcaaaaaaaaaaaaaaaaaaggatttttgcccttaaagaagccaaatcattacacagcccttttacaatgggacagatctaactggaaggaaaaaaaagatatacttttaggcactgtgccccaaaaaactcagcaattaaagtttgggattaaaaaaagttaaagctatctaaactgaggtttgtatagaaatgtgattatttttgcaggtgtattatctgtgattggtactaatgatttgcaaatcatattaatgaccataataatgatattttttctaatgaaacacagcactttacaaacattaagtatttaatccctgttaggtaaattacagctactcttaaccacatcttacaaatggtaatactgatatcactattcatgatttgccccaaatcacagatgactaacatcagaatttattttaaataaatataaacaataaagtacacatgtgcttatttgcatgtgtgagtatacaaagcatcatgattaggcatagttaagcaactgattagaaagtcattcaaggtctcacttaaaaaccaatcaagttaaatctaggtaatacaggcctagtaccatcagttggcattattctggggaaaaaaaatatcagaatgcttagcaactcagaatgcttaacatcctacctttccactgcaacctgtaacagacaacggccagtggcccacaatgccagtgccaaccacagacaggatggatggctctggaaccattagaaggcaccattcaaatagacaatggtaccaaccagcgtctcgatggtggttataggtctgaaaatgtgtactaaaagaagcggaacctctggccgatgaatttatttggatttcatggctattagtactctgacttccacataacctttgagattcagactgagcaggagttcctcagagaagcttctctgagccctgagccggacccaacaatgctgctccagagaatgtcttcagactccaccccagagcttcttcacgatttttggacactggctttcttgaaagcttcccaataggatcaaacttcttaagggcaggagccatactgtcttgtgcctggacaatgtttataaattgatggagctttataaatgttgaataagtcaatgagcataggactaaatttatttaaattactagtgctctcatctatcagaaaatttgttctttcggtgaatatataattaaaatggtgtgggttaaaagaaagttcctgattatcacaaaaaattcagagaccagggccaggtgtggtggcttatgcctgtaatcctagcgctttgggaggccaaggcaggaggactgcttgagctcaggagttcaagaccagtctgggcaacatagtgagaccttgctgctacaaaaaattttttaaaaattagctgggcgtggtggcacacacctgtggtcccagctacttgggagtctgaggtgggaggatcacttgagctcaggaggttggggctgccgtgagctgtgatcatgccactacattccagtctggtcacgagagcaagaaccctgtttcaaaaaataaaaaataaaataaaaacaaaaaattcagacaccagagatttgtctactaatatgcattttaattttctaaggacaagcaagcaaagaatgatcatgattttctgaatttaaaatccaggggtgaaggaactacccagacatctctgatgctgcccattcttttatcttgaaggaacactgctctgggcatgacagatgaggattaagtaattacgctacacactctggcgtgtgtctccgaaatctgcaaacacatctagtgctctgaaagcggacttgtagttggttttttaaagatgataaagagaactttgctactcaaataaaaataactgatatggccttcaaattttcctaagttcccgaaaagcttatttttcctaagtgtacccatctcagataaaggcagaaatcacccctctctcaatacagtcaacttctctaaagatgatgcatacaaacacaccagactttggcagaattctctagcggagatttaaaagaaaatatctcgtggcagtagagagtcacatgaagacttccaacagctcagacattctccttctacacaaaaggggaaaggccctctctgtagcaattgtttgataaacagaccacagtggcgtttttttacttctcctctgatataagtgaaaataagtccttggtactatgtatggaaggcaggtaaaaacaatgaagtgataagtatttacaacacagatttaatttatctacaccaaaattttaaagattttctgctttaagtagagttatcctgcttaacatcctgccccactaatttttatttgaatttggaaaaaagtcaaatgtggacccctaagagtacattcatcttttcagaagcagctaagccctgatttttcaaaaagcattaatctagactattttataaaattataaaattgatttaaaaatattttaaatcaagactaaaggtagatgatatcttcattgtaaaaagaaaaagatactatacattcccatcctgtgaaattacagccaaattttatccattcaggatactttgggaatgaggcgttctatacagcttagtttcccagagagctgaagggctccaaaattttcttaaaatagaaatatttctaaaatgtaccatatatctgtgcttccacgatcacagtctaagacacataatatactttttccttaataacttataattgaagacaccagctcatgtgtacaaattgaatgtagatcaaaatgtgctaggtaatttggtcacagataagaatttatgtactgtgatgcccacaagagaaagcaggaaagatctaaaattgacaccctaacatcacaattaaaagaactagagaagcaagagcaatcacattcaaaagctagcagaaggcaagaaataactaagatcagagcagaactgaaggaaacagagacacaaaaaaccttcaaaaaatcaatgaatccaggagctggttttttgaaaagatcaacaacattgatagactgctagcaagactaataaagaagaaaagagagaagaatcaaatagatgcaataaaaaatgataaaggggatatcaccactgatcccacagaaatacaaactaccatcagaaaatactacaaacatctctacgcaaaaaacttgaaaatctagaagaaatggataaattcctcgacacagacaccctcccaagactaaaccaggaacaagttgaatctctgaatagaccaataacaggttctgaaattgaggcaataattaatagcttaccaaccaaaaaaagtccaggaccagatggattcacagctgaattctaccagaggtacaaggaggagctggtaccattccttctgaaactattccaatcaatagaaaaagagggaatcctccctaactcattttatgaggccagcatcatcctgataccaaagcctggcagagtcacaaccaaaaaagagaattttagaccaatatccttgatgaacattgatgcaaaaatcctcaataaaatactggcaaaacaaatccagcagcacatcaaaaagcttatccaccatgatcaagtgggcttcatccctgggatgcaaggctggttcaacatacgcaaatcaataaacataatccagcatataaacagagccaaagacaaaaaccacatgattatctcaatagatgcagaaaaggcctttgacaaaattcaacaacgcttcatgctaaaaactctcaataaattaggtattgatgggatgtatctcaaaataataagagctatttatgacaaacccacagccaacatcatactgaatgggcaaaaactggaagcattccctttgagaacagtcacaagacagggatgccctgtctcaccactcttattcaacatagtgttggaagttctggccagggcaattaggcaggagaaggaaataaagggtattcaattaggaaaagaggaagtcaaattgtccctctttgcagatgacatgattgtatatctagaaaaccccatcatctcagcacaaaatctccttaagctgataagcaacttcagcaaagtctcaggatataaaatcaatgtacaaaaatcacaagcattcttatacaccaataacagacaaacagccaaatcatgagggaactcccatttacaattgcttcaaagagaataaaatactcaggaatccaacatacaagggatgtgaaggacctcttcaagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaagacagacatatagaccaatggaacagaacagagccctcagaaataatgccgcgtatctacaaccatctgatctttgacaagcctgagaaaaacaagaaatagggaaaggattccctatttaataaatggtgctgggaaaactggctagccatttgtagaaagctgaaagtggatcccttccttacaccttatacaaaaattaattcaagatggattaaagacttaaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttgaaatctactcgtctgacaaagggctaatatccagaatctacaaagaactccaaaaaatttacaagaaaaaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggctgtggagaaatagaaacacttttacactgttcgtgggactataaactagttcaaccattgcagaagtcagtgtggcgattcctcagggatccagaactagaaataccatttgacccagcaatcccattactgggtatatacccaaaggattataaatcatgctgctataaagacacatgcacacgtatgtttattgcggcactattcacaatagcaaagatttggaaccaacccaaatgtccaacaacgatagactggattaagaaaatgtggcacatatacaccatggaatactatgcagccataaaaaatgatgagttcatgtcctttgtagggacatggatggaagctggaaaccatcattctcagcaaactattgcaaggacaaaaaaccaaacaccacatgttctcactcataggtgggaactgaacaatgagaacacatggacacaggaaggggaacatcacacaccagggcctgtcgtggggtggggggaggggggaggaatagtattaggaaatatacctaatgctaaatgacgagttactgggtgcagcgcaccaacatggcacatgtatacatatgtaactaacctgcacgttgtgcacatgtaccctaaaacttaaagtataataataataataataaatttatgtgctgtggaccatggaacaggaaggagtctgtttgaccctcacagtattctgaaatttgtcctctcaaaaaattcctgatgtcaactcctatttgtatcatttgcctcttcctcacagaggtagagtgaagctatgtggtagagcatggctttgcaaggagtaaaatgttttaaaaaactagttagtgaaccaaggctggagaagtttccttgcaaatggttttcctattccctaggtgggtgtcattttggatgttgctatcagctacctccttttttctttttctttttttttgagatggagtctcgctcttgttgcccaggctggagtgcaatggcatgatctcagctcactgcaacctttgcctcctgggttcaagcaattctcctgcttcagcctctcaaatagctggggattacaggcacctgccaccatgcccaggtaattttttatatttttagtagagacagggttttaccatgttgtccaggctggtctcaaacacctgacctcaagtgatccaaaatgccttggcttcccaaaatgctggggttataggcatgagccactgcgcctggcctgctatcagctacctctgacttcagctggagcttcatctgtaagggctcccaggcgctcctggaaagtacacatttccccagctttcattcactttattcaatgattgagaaagagaaacatgcttggccagttcacaaatctgaatttagatgtttgggagttctccaatgtttcacttctttttgctgaggtaggcttgtaaacttggttaaaagaaactggtgtaacctctttgaaaagacaattgggctctctctccctgtattttacacatggatgtaaaagtcattaaaaagtacatattctttgacctagaaaatcactttctaggaatctagcctaaggaatcactggctatataaacaaagaggatgtgcaaagaggctgaccacaccgctgattataaaagtaaagtaggcctggtgcagtgctgcacgcctgtaatctcagtactttgggaggccaaggtgggagaatcacttgagcccaggagtttgagaccagcctgggcaacatagtgagaccccatctctacaaaaatagaaaaattagtcaggtgtggtggtgcctatagtcccagctacatggaagcctgaggccagaggactgcttgagcccaggaggcagaggatgcagggagtcatgatcatgccactgtactccagcctgtgcaacagggcataaaagtgaagtttaactaaacctctaacattaaaggattggttaaaaaacatggaaattcaaacaatggaaaactattctgccattaaaattttaaaataatgatccacatattattgacatgcaaagatttccacaatatattgttaacccaaagaaaacaataggtttcaaaaatatgtgtggttgtatataggggaaggtccgaaaggatctgtattagaggttcccaaatgattctggtagcccttagagtctcagtaatttttcacaatgcctccaggcccaaacaaatacctaatagagctgtctgttaagtagttagatccaaacaacataataactatttatgtcagaatgatttagcagctgaaaaaaaaacacacataaatgaaaactactatttccttctcaagtaactttgttataacttgtttatagaatgtatacacctgttgggcactgcataactttaaatcttggaatcgctggacaccactaccttatttcctgttccacgctggttttcatgtgatacactttttatcactaaacactcagcaatcactgaaaactcggttttgtaaagatatgatgtcatcaaaaggaatgtagtgtgatctaatgctgaaactgtgaactatctccagctaatagttggcagagtgttgtacgatgtttcccttaatgatggaaagtatctgtgccaaccctagagctgcacccagaatttgctgtggtgccccagagcatcttggcacacagtttggagctgcaggtatataacaagatgttaacagttgctttctctcaggttactggtgattaaaaaaaaaaaaaagattttctgaactttttcccaataaacatctgttattttttacaattagaaaaaccactaaagtgatttatgtatttttcagagttctttatctttacaagaagatggagagtctccccaattttttactgtgaagaaaagtctaagcataaacaacagtaaaaatggagtcttggatgatgccttaatgatgaaaaactccctcatgaataacgttctgcaataactcctcctattctgaccccctccctgatacttgcacaggttggatcaatgaagtcactggtgtcaggacactaacccagacattcaccccacttcctgcgggtagccactacaattgtttaataatagactctctgtccctcagctgatgtgcttgtaatagagcatggtcatgcccttgtgggaactgagctataaatggtgctttgctcttggtctgcagagctttagtctctggattaacggtgctccttttaaaacagtgcctgctgctttgcaccctggtgtacactgctgccgtctttaaaggtctccactgctctctttgttcccttctggttacttttgccctgtttgtcagtttttgcactaaagaaatgaatgggcttttataccttcaccaattgggactttcagaaccagcctagtgagttaagtctaacagatatttagccccctttgatagtcagttgttgctggatattttgtttgtttttgcctttgtgggaattggtgggcagaaaaaaacattttccagtttcatgctatttttaaaacctgaggattttttacaagttttggcatcgtatagttgaagttctattgtgatcaatatttctattcatttactttcttactaaacaagtgtccaaggaattataaaacactttttttttctaatttagaaacttctacaaatgtatacatcaattgcaacttaacctttacaagtttaggaataatgctgtagtagaatatttaaaggaactttctgcataaacttcagttaatataggtcttacttttaaaatatcttctttaaaaaataaataatattgcttactattgggataaaattattttaaaaagaataatgagaacagctcccaattctcctttacctgccccagggttccctcagcacttatcaccttttcaacatactatacactttacctatttatcttgttaactgtccatctcctccaaccagaatgtaagctcagtaggagcaagaatttttgtctgctttaatcactgatacatcttgtctccagcacctaaaatgtaggggctcaacaagtatttgttgaaaagtcagtaaatgagtgactgattcttaaagacctttttgtaactccattttagaagaccaaagaaaaaaagacaaaatcttgaacattaatatttatacaaaccaaatactactttttgtaggtaaaatatgattctattgtgatgtaaagttacctttttgactgtagtgaaatccatgaatggcaaggatctaactaatttactattgctcctcttccaggaaatgtttcaactttcaaataaagaggacttctgattgtcaagcatggcaaattcatgtggaatgcctaaaaatgctgagtactaaaaatatttttaaagatatggctaagcagcaagaaagtaacagcaattgttaaaagttgaaaatgacaaggaaattagaacctagagaagtaagtaggtaagtcctgcataagtcaatccctgatggggatattaagagacaaagggacagcctaatgtccacacaggaaggtcaaagccaatacccttgaaagatgaaatcctcagtgggtaaattaaaaaaaaaaaaaatcttcccagaaatagaagacagaataagtcttggtgatgggagaggagaaaaaagaagaaaatttcctcaaaaaatacaaagcccaggctgggtgcagtggctcacgcctgtaatcccagcactttgggaggccgagacaggaggatcacttgaggtcagaagtttgagaccagcctggccaacatgatgaaaccccgtctctactaaaaatacaaaaaaattagccaggtgtggtagtgtgcacccgtagtctcagctagttgggaggccaagctaggagaatcgcttgaacccaggaggtggaggttgcagcgagctgaaatctcaccactgcactccagcctgggtgacaaagtgagactcttgtctcaagaagaaaaaaaaaaacaaaaccccacaaaaaaacaaaaacaaagcccagaaattacatatccatgtgccctttccaaatccaaatagggtaaaaagtcctgagttggaaatgactacaaacacatagcagaagcaaatacaaagcctctctagaataatgaatattaaatctaagtttcaagagattttcataagaattccaagtaattaagttcacaatcaaaaatcacaaaacaaagaatcaagctgtcatgaacatgaatgagaaaaaacaaaactgcagaatgaaatcatcaaaggctttagctattgaatgtattgaacacagatataaaatagatgtgtttaacatttttaaaaaagtaaacaggatcttaaaatatgaacaaggaagatttcaaaaatgactaggcagatttaagaaacagccaaaaataacttctagaaatgaaaatataataattatatttagagactcacatgagtaagtccaataccaaaatagatgcagctgaagtaggaatgagtgatttggtaaacagatataaagaaattgtacataaacttatacaaaaatgaaaaatataatcttacgtttaagaaattatatggccgggcacagtggctcacgcctgtaattccagcactttgggaggccaaggcaggtggatcacgaggtcagtagttcgagaccagcctgaccaaaatgggcaaaccccacctctactaaaaatacaaaaattagctgggcgtggtggcatgcgcctgtaatcccagctactcggaaggctggggcaggagaattgcttgaacctgggaagcaaaggttgcagtgagccgagatcatgccattgcactacagcccgggtgacagagcaagactccatctcaaaaaaaaaaaaaaaaaagacattatacataacatacagaaggaaaatataaaagaaatatttagagatgtaaagggcagaatgtgaaggaaaaaacagacaatgtgggaaaggcagcattcaaaataatttttttttctgagatttttcagaactagtaatcatcaaattcagaaagccaaatgcatcccaaggatgttaaataaaagaaatgcccacccagacaaagcctggtaaaactgtagaagaccatcataaaaaaagctctgggggaaatctggggaaaatgtctttaaaacactgaaagaaaataatactgaatatgtaagtgtatacctagcaaaactacctttcataaataaagcatgaatagaaggtattttcaatcaaacaaaaaataagaaagtttacttccaaaaacattcattaaaggtacttctaaaggacatgcttcagaaaacagcgatgatctgagaagaagaaatggtgagaaaagaaaatagtaaatacatgactatgtttaaatagagtataaaaaacagctgctactgtatacaaattgtaataatgtgtaatataaaaaataatataaaactataaaccaaataaccatggcatgttaggctgaaaaagaatgatccaaattaaagaactctaaggttactgaactgtttgagaaaagaatgaatactgtttagtgtaacactttattaagttacataggatgccaacatctctagggtaagcgtggaaaaaagagaatggtgtgtacaactgttaaattagtagaagaaaaaccatggaactatatttaaaaaaaaaaacaaaagcaaaatccaaatgaaggcaataaagaaaaaataaggctcaggaaaagcaggacaaatagcaaaaaataatatggtcaaaatgaatataaatgcattagtgcaatcaataattagtgtaatctgctaaacaacatacatcaactgaatattttacttaaaagacaatgactgattgaattaaaaaatagacaacatatgtccacacagacttgcatgtgaatgttcatagcaactttatccacaatagttgaaaaaactggaaatgacccaaatatccatcaacttgtgaatagctaaaaaacaaacaaacgaaaaacctgtggtatatccatacagtgaaattatactgaaaaaatataaaggaatgaaactctgatatgtgtaacagcataaatgaatctcaaaggcattatactaagtgaaagaagccaaacacaaaagtctacttactgtatgatttcatttgtatgactttctggaaaagacaaaataacatagtgataaaaaatagatcagtagtttcctaatgccagacgtgagggaaggaaactgatagcaaaaaagcatgaggaactttctggtgtgacggaaatatctatagctttattgtggtagtggttacatgactatacacacctgccaaaattcatcaaactgtacacttaaaatatgtgagtttgatcatatgaaaattataccttaataaagctagtaaaaagacaaattccaattatgtgatttacaaagcacaaatctaaagccttttgtgtctttgaataaaggaggctgggggaagaactgcgtaggcaaataataacccagaaatctggtgtagctaaattaaacccatacacagttaattttaggcaaagagataaaaagggccatcacatattaatagaaatatttaattccctgggaagatataatatgttcctaataatgtatcttcaaaaatatataaacccaaaaataaaagaacctcaaggagaaactaaccataagacagtctcatttatgaacataaatgcaaaaatcctgaacaaaatattagtaattcaaatctaataatttccaaagaaaaataatgtgtctaaatttgggttattccataattcaaggttgcttcaatatcaatcagtgttattcactagatgaaagaagaaaatatatgattatctcaaagaatatagaaaaagcattcaataaaatacaacattcatcattcatgattaaaacaaagaatagaaagaaacttcctgaactggataaaggatatcacaaagcaaccctataacaaataccatactttataatataaatgaaaagttaaagttttatctatcactattttaatttaacattggagattcttgccagttcagtaagacaagaaaaaagaattaacattttatgggttggaaagggaaaaaaaactatcattacttgtaaatgatataaagaatctacaaattacttttattaataaggaagccaataaggtttccatatacatgataaaatgtaggaccctttgacagtggcatggctaaataaactacagtaaaataaacacaataaaatattctatagcaatgaaaatgaatgaactaaagttacacaggtcaacctggataaaactcagaacattgtgttttgtggggagcaagtcacaaaataatcagtatgattctattacataaaagctaaaatgagatagtatattgctttgggatatatatatggtaaaattatatgtggtacatatgtagtaaaactaaaaaaaaaaaagcaaacaaacaagacagtaagtaactcaaaatccaggaaagtagttggggagaggagaaaacaataggagagaggtacataagggtttcagtagcaatgataatgttcttcagatgagtagcagaaatgtggatgttttctttatttaatcctttaaagtgtatctacatgttatatattcccttccacatgtatgatatacttcataatctaaagaagtaaatgaacctgagtgaactttgttagaaatgcattttaaagtcaatgttacttcaagttggaaaacacaggcatttaggaagttctttttctatatctaagttttgaaattaatatttattattttttcttattccttattctaggaaagttgagagttctcatttatacaatggttttcctattacactgaaatcataagaaactctcttggtaggttttaaaggtaaattatacaaccattttgttttcacaactgcctgtataagacagaagaaaaacaacaaatgaacaattaactggtaaggaaagaatattaactaataagaaatgtcaaaaaggcttgacttctcatattaaaaacaactttttggtggaaaaaacctaatcccttcttttgaaagagaatttttcaaaattctcagtgttggggcggtggggggtgagtggctgggggttgggaaatcagatctcagatcaataaacaggcaaacaggttgactaagaatagaaggtatcattatgtattttacatattttgtattttctgcatattagatgttttgacatcttaaaactacctttctggctagagagagactgtctctttcaaggctagccgattctcagagataacaaagagcccggctggtagcatgcctttgacaagaaaattcaccaatctagagacacccctcctctatctggccctcagaggcaatatttctctgcctttactataccacagccaggtaccaagcaagcagggaccacccagaaagcttggagcctaaccaaactacttcaactagcaattctaaactgttaaccctgccctgccttgcctttcccttggaaactccaataaaggctgtggctggcccaagctctcccctggctcctgccttctgcctcctgactaacacgggtgttttcccttgtggccctgcgtagcatgtggtgacacgcctctatgggacctgtgaatgtaacaaatttcttccttccaagccctgttctcatttccccttcagtggctgtactgattttatcacatatccaacatgtacattcttaaaacacatagcaaagcaggagtttcagatgttaaccaaggtctccaggaatgacaattctggagctcagggcgagcagagattagtgaaggagggagcaaatttacaggaaacaagaatatgcaaatactgagagtttgagagttcagtggtcgaaaaacaggagatagctgtggaaagtgcacactgggaaggggcagctctgaggcacctcacggcacctggacaacctcaaccagcttaaggtgcctaacagaggaatttataagcttcttgctggtatgggaacaaatccccaagtgaggtgcctgctagatagatctgcaggttgaagtagatcagggaaacgacacaccggaggagagggatgtaggggcagaaaagaggggcccatccaaaaaatgtgtgtgtatccccacctacccttacctccttccactttttctacaagcgtcagaactgctcaacatcatcacttccaaatcagttttggtgacagagtccaattgcccaaaccagatgcaatgccctcattatgtcttaccagccctcctgctcctgcctcctccagttcatgcttcacgtagccacagagtaatctttatagaacacaaatatcaccatattacttcccagcttaaaaacctttcaggattgacccatatccacccagagtagcctccaagccacttagattgtcctcctttctgccgtccttctggcttctctggctggagactttagaccacagcactgtaaactgattccaactccatgttaatatgttaatttaatatgttaatattaaaatattatttcatgggtccaggtattagcacattatgtactcttttctccttctgaaaggaagaatctttgcctgccttaacactattattcatcttcaaaaatctgtgcaacacttcattctgaagcctcctcaaacaactgcagtctgctcgctttatggaccaccttgctgctctcattacattcaatgcacactattttattcacatgtatgtctgtcttcccaactacactgcagactacttgagggcagggatggtatcttattttttctttgtatttccagtgggtagcacagcacctgacccataaaaaaactatcatctattgagcacctaccgtacagcagatcccatactaagcttttcaaatgttatgacgtgagttcccacaacaactcaatgaactatttataattacctcttttacaaacgaggaaactgagatttaggaggttaacatccccaggaccttccagttagtaagtggtagaattctgattaggacttgggtctctgacaccattgcctacgttagctccttgggcctctggtgaaacgtaatgcacgaaatgtggatcggatcgtatgaaatctcccccaacttacaccctgggttgaaggctgtgaagcttatgcagaatgctagaggaggcattaggacatggggtttctggttctgccactgattaacctcaactctgggctgtcgcaggctttctctgggcttcactttcctcatgggggaaatgccatccttaacagatcccatgtcatatcctcactcttaaggacctctaaagctgataagaaggtactgtgaatcataaacctaggtactctttctagatattggccttgaaacatctcttccttcactgaaaaactgcttctgaaaaaggatgccagaagccacttttggtcaagaaaatgtccacttttgttctcagcacagagcaggtacccggactttccctgttcccaagtgctgtagaccaaaatagcagggaaccaggatgaagtcagccagaaacacgctttctataactgctcttcacagaagagaaaatcaacaagctagtgtttaaataatgtgcagggtgtgataccaaccgaacctccgccctccttcctggggaaatgcaaagtttgctgtggccttttcacaaacctcggagagaatgaaatgtcagctctaacactgaatttcccagcttcattccacttccctcaccacctcactattacctaagatgacattctgtatattagtatactacatcttaaacatcatccctcactcagacatcagattacaaacaaacagctgaatcctacagctgttcccactagaaacaaaaagattcttaacatatttgaagggaaaaaatctgtttgttcccagatgtctcctgagcccatttctggggcgtgtctactagtaatagtgcgtaaacgctaactgtactcctcgctcctatttacacacactattagttttcagtaaccactccttcccaactcccaaaaaagacagctaagaaaacaatgttcacttggaggaagagaaactaaatttctttttgctgttcctctcaatcaaacccttgcaggaaccaaagtattcactgtggtttaaacacttgtcactcaaaaaaaaagtacccagaaatgccatgagacttcctataatttcacttttatttaaggagctgtgctgcatcaatacttgctttgggcacaaaatgcagaggagcttgatggcattttgagaatggcacagatgcaaagtatttaaaaaatacataccacccagtgtgttcctgggagacatggctggactcaacatgttactatcagcagtgttagcctggttccgcaggggaccacatatgcacatgtaggtactgagcctgtgctctgggatacatgctgtgctaaatggtttacattttttatgactcgttaaaatatacttaggaggaaggtatgttctcccctttttacagatgaggaaactgagcactacatgaactgccccgaatcacattgccagtaagtttgcaaaagtggcatttgaacagtcagtcagactccgaatatgtgaaggagttctttaagggaaccaaggaaacaatgtgcattacaacccttgggagacactctagtgtgtatttctataaattaaaaaaaaaatgggaagaaattgatcactaatgaaatgtatccatctgtcataatgaagattttaatgacgaaacaagtaacctaaaactaaaattaagacattacaaatatcaaagaaacaaagatacaacccctaaaaggggctggggtgctaatatttagaaaaataaatgtgtttcaactactgccccctcctggtggcataaccaaaggtacctttctttttcttaacttgatggatttggaaggttttcttctaactgatctaccaaaacaaaaaatgtaggtaaagaaagactgtatggagcttattgaggataaggcttagttctggactggagtgaaggtctttctaactgagtaactataagaaactatgaagcatcttgtgcctccatcttctcatcagaaaaatgggaataatatccactctatctacctcaaaggttattgtgggcatcaaagaaataatgcatgtgaatgttattttcaatgaatctaaaatctaaggtattatgattaattaaagccatttatagtatcatctattaaatttaaaattacatttactctttaatcctgcaatcccactcctgggaaccaatgccatagaactaatagcactgtatctaagaacaaatacaaagatgtttatgatttcagtgtggacaatggccaaaaaaactgagaccaaagtaaatatccatgagtagggcaattgtagaataaaaaattctaatagttaccccactggaatattatgcacccattaaaaagaatgttctagagctttatcaattgaatgaagagatttcaacacagttttctgagaagagcaaaacataaaaaaagaatgtttaacagggaattctaaaagtcttagtgcattttaaactttaataatttcagaagtataaatgctatacactttcaagaaacaatatatgaaaaataaaaatttaactttttaaaatattgatgttacttattaaaatcaatataaaaactattatgcacaaaaaaactaagagtaaaatttattattcaaaattccaaagttaaataagtataaaagaaatataaatagctaaatgtttaaatgtttctaagtttatagcaattatacctctaaaattatgaacttaaaattgcactaatacttaaaaatgttatttcaatagctttaggcatactagtgtttttggttacatgaataaactgtatagtggtaaatcctgggattttagtgtacctgtcacccaagtagtgtacactgtacccaacaggtagcttttcatgcctcaaccacctctcaacctcctcctcttgagtctccaatgtccattacaccactctgtatgcctttgtgtacccatagcttagcacctgcttataagtgagaacatggtatttagctttcaattcctgaattactgcacttagaataatggcctccagttccatccaagttgctgcaaagacattatttcattctttttcatggctgagtagtattccatactgtgtgaatggaatgtgtggtgtggaatacacaccagtccaatggaatggaatgcattctatttacacaccatggaatactactcagccataaaacagaatgaaatggaattatgtgtattacacacacacacacacacacacacacacacattcctcacatgttttatccactcatcatctgatgggcacttaggttgaacccgtatctttgcaattgtgaattgtgctgcaataaacatacacctgcaggtgtcctttttatatagtgacttcttctttgggtagatacccagtagtgggattgctgggttgaatagtagatctacttttagttctttgagaaatctccatattgttttccacagagggtgtaccaatttacattcccaccagtagtgtgtaagtgttcccttttcactatatgtacatcaatatctattgtttttttactttttcattatagccattctggctggggtaaggtggtatgttgttgtggttttaatgcattaacactttgagaacactctataacatgtttttgttttttaaaaacaaaataacagtcccctcactcccactgtgtggtgtgtgtgtgtgtgtgtgtgtgtaattgtacatttacataaacaggggaaaaatggaaggctatatgtgcagttaaaatgggagaagggaaaagaggaggagagtgatccagacaaaagaggaaaagttgttgttttttttttaaaaatggggaaccaaaaagtgtatatgctattatcacatttatgtacctatataaaatcatttgtattgtacagctatataatattacatgtttaaattttattattttagagacagagttttactctgttacctgaactacagtgcagtgaactacaattgcactggcacaatcacagctcactgcagcctcgatcacctgggctcaagcaatcctctaacctcagcctcttgagtagctgggaccagctacggcaccaccatgcctggctactgattgatggattcattgattgtagacacagtctcactttgttgctcaggcttattattattattttgttttttaagaaaggaaagaaacttgccccaagtcccatactaagctaatggcagaagaaccagaacttgtacctaggtctctctgactctgcagtctgagccctgaaggattacactgtgatttaggatggttatggattcacaggcaggactcactagccctgcaattggcctctccagcatggagttcctgaccattattcgtcaatctcaggagctgctttcaaaacaaccaatcgtcctttgaacctctcacttctggggtggagcatgatagcatggtagatgctgcagacatgaggcttttggttgatgctgatagcaaccctctgttgcacagatacataattttaatcaccactgctaagtaactcttattgatttgttcttctcagaatcaaagacacttttctctctctctctctcaagtaaattaaaaatggaaacatattgtcaatccctgaacacgtggtgtgcttttttccttcaggcccatcacatactgttccttctatctggaatgtccttcatctttttcctctgctgggaaaacccttccatattcttgaagttgcagctcaaatatcacgttctccgtcaaggatttcctacctcatccaggcagaactgcttcaccctttgcatgccctcaagaatcaggacaggcttctcttagcagtgctcactgaggctttgattatgggcttagggactgatcttccactggagacctcatgagtatggtctcactctcaccttgttccagtggccagcatggtgcttggcacattatagccttcaattaaatattggttccatgaaactgtgagattgagaacgtattaattcacaaggtaaataagtcataggtccaatactgaggcaaatgaacatgcaatcttccatgcacaaggccaagaatcccttgcttttaaataatatgaaccaaatcactaccaggaaagaggctacacctcacacagcggatcttcactctcgcctttccccaactcagcaacagcaggacaagctatgaaaagttcttttgtaagtttatgggaataataattcttttaataatttcaatttttattttagattcagggggcgcatgtgcaggtttgttacctgggtatagcaattatacctttgatattttgaacttaaaactgcactaatattttgagaacacaccacataatgttttcatttttataaaacaaagggaaaatcctctcactccctctcaaatgctggcattcagtgtgaaatcatagctggaatgtgacagatgtgtattgtgtgtgtgcacggaaggcctctttactaattcagaccaacctttacctcctcagtgtgagattatctactgaaataataatgactgatatttatatacaacttagaatgtatttgctttcagagacattacctggtttgttgtatgaagcagaaagcaaatcaatcaaccagatttatcattatgtttacactgattttgcagtagatagtaaccgagtttatgccttgaccaaatgtccatatataacatacagtcagtaaaactgttgactggctgtaggttcctgctgtgagaagtgtgatctgtgaaattctaacatgcctaataacatttattcccttatgatctagcatagatttaagccaggcaaaaagttttaacaaaaactgattatgcttgtcaataaccgtgaatagtatcccaattaagacaatggtcatttatttgttcctactgccaccagtgaaagcaggaaaagcatttggcaaatctatttctgtcaccctcagatttcaggaagagaagttcaaacagatgaagctgatgttactggaataactcattctactctaccattcttcctgatctactccccaggctctgtgagctgctggtaatcaaggatgtttgactgggttctgttagctgtcaaggtttactaagctgagttagttaatgagtgatggctggatttcattccaggacttcatatcagccatgaagcaattaggcatgtacttcatgatctcccactggaatttcaaaggtgccttagtctaccaaggaactaaattcagtgtggtctgaaaggaaacaataaacaacatttaaccatgagaggtagcaaaggacgtcttttctcagtgtctatgttagacaggtgaggaatgttgccaatttattttttgtccatataacctctatagctatttcttctcttgtctgtcgttctgaaattataaagggttcttatgagttgtttatgtgaaaccaagtaccctgacccacaggcaaggtattcctggaactgctgaaatagcaagccagataatgatatcatttaaaaaagtgccaggcaagaaagctctgattaactactgaaacatgctcagtggagatatttgtagctagaataaacgccattttaacatctcctctttatctagggtcctccttcctcatgctattattgtgaatatttcctcttcagattcctgcatacaaggaagactgatgaaagagagtaaaaatcacttttggagaaaaaaaggtaagagctggcagaggtaaaagaaagattctgaacctcatcaacagttgttgcaatctcactcacctctctggctaaccttcctccctccaccccttcactgctgctttcctgccactcacccagactggactttctactctgatgctccacaagaaacagaagtggtaagaagacaagcaggctcccgggggaagtggaggaccatatgaagtttcatgaaagaaatggcttcagggatgatgaggcaactcttcctaatacaaggggtaagccctagcccaggggcacacccatcctctaggaggccagggatggtctctgtcactcctgggaagtccctgcagactctacctgctttccaagtgcttcaggaaacatcaccttaaggttgaaggaggacaaactcaagcagttgcctatggtatggctaagggggtggcaaacagagggctggtgatttttacaagtaacctctcacaatacttgcgccattacttctcttttcatttgtgtccatgaatagaaactctcagaggatagtatgttagctccatggcctgtggcactgtagagtgagttctttagagactgaaggagttaagagtacctgtttagctaccagaagctgaatgtcagccggtatgaatggtatgtagctgggcaattttccaaaacccatgcgtggctgcgtatcaggaagactgctataaacaaatgtgcatgtatgcatagagcctgataagtcaatggggggagacagacacggaacagccaaccagcctgaggaaatatgcagagccgggtgagcttccactttaggtgaacaatagctctgtctcggaaacaggtctggatgggctggtgaacagttggaatgatcctttgactttttacacattaaatgtctgtttcaggggaccgaaagctggattctcaattttccaattatcctaatattataaaatcactaaaatggtgttttaaaaaaattcttaatatgtaaaacatgcaaagatacattaggtgaaaaaagcacagggcaaaactgcatttatagaacccaattatgtaaaatatatagatacatttaagatgatacattaaaaatgtcactaaaatataacacgatctttttgtggttgtgggattatacatgatttttgttttttctttctactttactttccaatttttctaaaattaacatatattattttcatagttaagaaataaggttacttaaattaagaagaaaattacctgtggatgaaacgacatctgatgatgggttatgagggttggggaaggccagaaaggcataaaatagaaccaaccacgtttataaaatgttaaattcaactggtcttcacgtctacacacattagtatcttctgtcttacactgtaaactcccagagagcaaaggctgtgtctaattctgtgcaatgtctggctcaattaaaaatgtagacagaatataatttttatgatgattacgcaaatgtagttggttctttttcactctggcagccagtttagtgttactgatgcttggacagtgacacagaataagaacatacattgttttccccctttaaaatcatagtgtattaataggctacttttaaaaaatttttttgcagcatatacactcatagaagagaccgatcctctaccatatttaaagtagaaagtaaaacagtactgtaattttctctgttttagcccatttccatgttatataatgaatgtaattccaaggatgagcttacagtttgatttccatattaattcaattactggactcgccactgactcagacctggaattaatataaaatacagggagacacacacaaaaaatgttccacttaagaaaccaaaacagccctaagtcaaaccactcttacaacactagagtaatatccaatgaagcggcttccatttacagtgttttccagaccccacaaagttcttttcagagttcttatattccctaaaatataaccaaggttactgtaacttttgaagtcactctcaagatgtacctatcaataaacagtagctttttgtttttttagtacggtggctgtaagaagttacaaatgactgtcagtgtggtttcaggtggtattcttattagaaatttaaaacacggtgttatcaaatttggcctaagtctgttcctttcaaggttatcgtaaaatatgcaggaaatgtgaaatcccaagtgcttattaaattaaactggagaagtcactttttgagagctcggtcctcatgcccctcccctgcccccgtgacaatggtagcatttaccaagtgctctcagcaggtgctgagtgttaagtgcttcacttgcatgatgtaacataatactcaaaagagctctggaaggtaagcatttctatcagtattttacagatgataggtttaggaaaaggttagggaccttgaccaaggtctcacaacgcctctgtgtcagagctggaatttgaacccaggtctgataactctcagagtgcaaactcttaaccactaaggacttgttcacttcagagggctaattaagtgtgaaatcaaaagcaatgaataatcgcaattatgccacttttaatttgagtctgttgcatatacataattggtcttcctctatattaagaaggatgccctataaaaaattagaaattctgccaacaaaaacctcctgagggaaactaagaacatctactaaataaataaatcaagtgtcttattgagaacacggcaatactgagaggcttgggtgtggccacctgacagatctggaggaaacctagaggcaaaatgtaccgaatattctattgcacaacagaatctatctgtggaaagcaccccctaaacggaagtatctgtcaaagtaaaaataaatcagggtaacagcatctaaaaaatatattgtgagtgagatgcatacttctctcatttactatggtacacgaatatacttagtttaattgtcttgtttaaaaaagaaacaaacaacttttcagcccaatctataaaactctgacaaggactaacatcaccgtgcagtcatgaagcagggcgagccagctgaggcttttggtagggtcttctctgcaatctgcttctactatgtgatgggtcaccaggagcgcaggctcactgaggactctgctttgcatgatgaagaaatcatctggatctgttcacagagacgggtcattccactcaaactcataaaagccaggctgacagattaactgaaatgcttatcaaccaatctgagaaccagaatttcccagaagagcagaggattaggatcagattattctgttttttaaaaaattaaaacatttcctgagcacctactatgggtcaggatctgtcgtaggcacttttacattagtggtttcatttaactctcacaaccgatctttggtgtgagtactttttaagtacattttagatagaggctgtggcctggagaggcagaggaactctgctgaggtcatgcagttagaggagcagcaaagctcccagaagagcacaagtgccccagtgctgaggctacgggtctcactatgcggaaaatcacaaagttcagaaggtgctggcaagggagcccagtggtcataggttgctgtcatcaagcctaaagacttaaaatgcactggtgacatatggctgccagttgggctgtcataatcaggaacatccctaaaactttcaggctccccaactccttttggtgactgtcatacagaccagcagccagctgtttgcttttgatataaatgtgttctaatttctaaaatgtaaagtttaattatctacatttattttattttatttttcctgatagaatgtcagtagacacaccatgaatttgtatagaatgtcagtagacacaccatgaatttgtttaagtgtgggttaacttatgggaattttatacatagctaacttcagtcatttttctgttgatctgtgatagtttcagtttcaaatgatattttctgccactgttccttgaaattcaaattttgagggtgctcattatttggtacccgggcactgatttattcatatctattaaaatacatatataaaaacaaaaataaaacacgaagaaaaaaagaaaaaaaatacatatacaagtatacacggtacaaaattgtgtgccatactgtgtactcattcatgaccaaaagacactgatcatttgtaagcttattctagtaaactgaataaaataatatagctaatattttatacttactttttctgctcctactgaaaaactggacatcttaatagttacttcatactaccaatctagtaataaggtctggtggccccaaaatgaaaaaaaaaaaaaaaaaaagcgaaaggggactgagtatttacgttttttagcattggattaaaaaaaaataaaaaacaacatcagtttccaaaggctagctctgaacattttgcctcctcttgaccttaaattgtgggctcaccctggagaataaatcttaatagtgaattatacatagcaactttgaagacaaataatattagtgcagcctacccgtaattactctctttttacaaagtttcctaagaaaacagagccaaaatgcttaaaatttaaacagaaacagagagagtaaatggctgtgaaacatacacatatagaaatttatattgtatatttacatttggtctaaaagcaacttcttaaaattcaccaacagaaaaaaacaaatacattttttggagagaagcaacaatgtaggtaaagatcacagattgtttaaaaggcatatctaaacatctaagagacagtctttgtttaaattgaactaggatttcctggagagtagtaaaatgttgtttcagtatagtgaatgtgcaagttaacacttcaagagtgggcttccggccgggcgcggtggctcacgcctgtaatcccagcactttgggaggccgaggcgggtggatcatgaggtcaggagatcgagaccatcctggctaacaaggtgaaaccccgtatctactaaaaatacaaaaaattagccgggcgcggtggcgggcgcccgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagagtgggcttcctttggcttcaaactaaacagctggacaggggatgctacttaattctttttcttccctaccagaaggaggaggtgctcaagtatttttctttattctttcatctgtttatctgctgagcaatagggatcttgcttcaggttggttaatctgctgagccatgacacatatgagaaggttctctggcaggacagtatgctctccaaacagagactatggcagtgaaagaaccaaagatatatcatctcccctctgaagcctctgcttctttggggtaggaattggtctattaactctgagcattttttttttaaagatggagtcttgcactgtcacctgggctggagtgcaacggcatgatctcggctcactgcaacctctgtcacaggggttcatgtggttctcttgcctcagcctcccgagtagctgggattacaggtgcacaccaccacactcgtctaactttttgtatttttagtacagacagggtttcactatgttggccaaactggtcttgaactcctgaccttgtgatccgccctcctgggcctcccaaagtggtgggattataggcgtgagccaccgcaagcagccaactctgagcatttttaggcactaacattccaagcgtctgagattccaaataggaaagtgctattttaaatgactctttaagctaccattacagataactgtaagaaatattcaggcctgaaaaaatgttcattcatcaccaaaatgtgaatcacttctaattgatttactatttctgctcttctgctaataacagaattttgtcactatccacaaacattccagaacacttatcttacagaacagaaaagcagttgtctatagtaaaaacactccaagtttcccttacatgtcacactgtagaaaggaaacaaaacccatttattttctcaactatcttgcctgtgatagtctgtgtacgataaaatttatagaaaactaaaatgctagagtccctacagacttcaaagataatctggcccactgatttctttgtaagctgaagccccttggcgaatctgatgggagctatgaaccattctccctccagaaaaatgtatatgcataccaaatattgtattcacttcccagcattttagagacaacccctgaagccaacctaggctaagaccccagaccaacgactctgatctaattccactgctttgtttcacatatggagacaccaagttccaaacaggggatgtggcttggccataattgctcggcagaaactatgagaaagtaaactggatgaaactgaaaatgatgcagatagcaactctgaaccatcacaaatcaggcctatcattttgctaggaaaggagaaaaggtgaagtgtttcaagaggagagctttctttcattttaggtttctggttgagcttctcactggttttcttcatcttgccttcgggccaggcccatccgtgacttaaggctaccttttcttgtgtttgcttctgtaaatcagtaagacctgcataacctggccacattcagaaaggagggcaagtgtgagagtgtgaagtagaaaccagttttaaggaactgtaagagttctaaagaactctaatttggtcacataatggatatttaagaagtattctgaatcaaacactgctcacatatttaaggaagtggcagtctactaaactgtcaccgagtaaaagtcctagagacttgctttaatgattagatggaacaaattttcaactactgcattcatccgcacatttgcaaatggctcattcttttaagaactaaaacattcattctgggattttgtatttgtgtttagttcattgcaaatttactcaatatatttcgaattcaattcaacaaatacgcttaggacattccaatgtgacggaatggaaacgtgcatggattttggagtcactaagatccaaattcaaatattggatctgctttatctagacacgtgattattgggctcattacttaagggtctctgcgtttccccatctgtaaagtgggaataataccaactactgtgcaaattgggtttgaaaattagcaataatatagtctattgtaaagaggctaatgcagtatctggcaaacagggattccataaaatggtaatacttaaaataatgattatttatcaaatatctacaaaggacaaacttcatcctagacccttctctaaaatctgaattcataatatcaaaatgaatgaggatttaattcattcttaaaatgactcgaatacttgctaagattttgacatattaaaaactataaccattataaatgaaaaggccactgttcaaatgactagctttgctacagtacaactgtcagttttttgaccaaaaggaaatttataataccattggtgggttttaagtctttaggtaaaaactgtgttttaaagtaacagaacaataagacagcaatatagtggtttcttaatgactaaaatcttacattacatattatggttcagtattaatgtgctttcacactacctactgagttttcagactgcaactacttatccttttcaaattgctatcactctctttttcatgggagatttcttacaaattccttggagaatccaaaaatttacagtggaaattttttctcgattcctttttttttttttaaagaataaacctattcaacaggtaaatctaaataatttttagcagttctaaatgtagagaattcataacttcttattgtaattgaaaaggaacatacaaagcaattagtcacttacaaaacccacgttcaaccttcaaaataatgactaacttgataggagaggcaagacttctttaattaaatactaaagtctagccatttgagataagcaaagcaggttatacaaccgtcttctgcactcacaatatccttttctccctcttggaaatatatcatttttcagcaatagtagaacatgtaacaaaaaaagttactgtactgtagaaaatcactctaaccacaagctaagtttttggctaagagttaaacttcattcatttggatttcactagtttcacaagaagaaaaagtgattaaccctagtgtaagtaaaattcccttgagaatatattagattcttaagaaaacaaaacagtaagcaaccttaggcactcacttacatataaatccttagggtgttaactgaaaagcattcctagccatgctagaataggattctcaaacttgaacactgattacctttttgagagctctctggacaggtgtgctcagaagcactggaagatacaggagagtttgatacacattctgagaaagatggggtggctcctgtgtgtgcatgtggccatctagcacaatcactattcagcacgggactacatttcccaggccacttcacctccaggtgcagccacgtgactagtgctcaacaaaggaatatgagaaaagatggtgctttacttcaaggcgactgtgattaagaagtgaggtgcagacaattgcaagatggtgttacaggatgaattatgtcccctcaaaattcacatggtgaagtcctaacccccagtacctcagaaagtgaccttatttgaaaataggaccattacagatgtaattagttaaaatgaggtcatactggaagagagtgtgcccctaatccaatatgactggtgtccttataaaaagggaaaatttggatacacacaggaaaagagggaagatgatgtgaagagactcgggaaaaggtgaccttctacaagccaaggagcaaggcctggaagagatccttgcctcacagtccgcagaagaaaccaaccctgctgacaccttgatcttcgactcctagtctgcagaactgtgtgaccacacatttctgttgtttaagccacccagtctgtggtactctgttacagcagcctgagcagacaaaatagatggtgaggccagaagacggaaggcacctgagttcaggattcctgaatcacctctcaataaaagcacttcactgatcagaaatacttccactgggctgagagctgagcaagaaaggaaactagttgtgtcaaaccattcaattttgagggcttatctgttataccagctgtcattacctactataggacctaattaatttaagtggcaagtaattttaaattattttacatgaaaacaaacatggacctatcacatatcacagggaacaatccatgtaaaattttaggattaaaaacacttcaaagaaaatttgaatttacaggaagatattttggggtaaattctctcaaatcctccatagggtataaatttactctcttctgccaatagaagtagaatttcctcaagaatattaaacaagtcacaatgtcaaagttgctggaacttcaactacgccacataatccacttaattttttttttttgaaattaagtggagcatttctatcaagtagcccaagtatgtaaaattttacttgggtactaaagatgagaacactgtgaaatgagttatcagccttttccaaagttctcaatatttttataatcaatctgaaaagaagtcactaggtacagaataccttctgtttgaatatggacaaaaaatgtaccctcttttatgacagggtaactgatacagaataaatactggataccattttccatttttgattttttttttctgacatgaagaaaaaatgaaatgataactatcttcggtaagacttagagttatagttcaaaatacctcaaaagccgagctggcagctggcttctcatgtttatagaaaagctaggatgattcagcctgagctcagagctcaatttagatcatagcatctggattcaaaacacatgtgagatgtggcagccgattttcaggtcatgactgatccaagacagagattgcagaccactcaccagcattattccaaatggagaaagtgcctgagagaaacagaagtctcaaaggtatttggaagcccactccaaactgttagggaacaggtaacatcagcattttctgcatccagcagctttaagcaggtgccgcagaagccaagggcctgaggatgacactgaacagctttgtcatgacattcagccttgccatggtcagaaaacatccctcacccatgacttctttcctgaactggctattgttcagattaaactatgggaatctggtaataaattggaaaacctctgacagcacacacttcctgctaagatctgtgtttaactttgctttgtttcgaagagaaaaactgtagtaaagaaaaaggaaaaataaatgtaaatgccctttttcttgatgagaagaaatcatagtcacagtaattctaatataaactacacaatgaaatctaaaagaagaggggaaaatccccagctcagtttcaatctctattggaattcaccttgtgccttccttgattttccttggatatgacatgtccagatgtgggtgattctgcagctatggattttatgtgcaataaaaaaatgcttctcctgctgcttttcctcacctcccccctcccccatctcttttcctctctctcctccttgtctctttgttgtgaatgtcagggctgtcagtgtcacagtctgacatgattagcgtttctgacattacaccaagaagcagacagagagcaaggagagcgagcagaggggaaggcagttatgagtagccatttaaagaagtccaaggaaaaaacaagcacaaccacctttctctgaggttccttgattacagggcagtttataaatcaccttggatttttctcatttatcctattagtctgttttcctgttcctctggagatccctaaggtgtggatctagtctgtgagatcaaagccagcggctctaataacagataagacagaattcgtgattcagcggattctaaggttgtgaagtgtaacaatcagcgcactttgggaagatagcgccagtccatttcgagtattgattcgctgcactttgtcactctaatgatgttatctcattaaaagagataaatgccccactgttcttctaagagcatctgcttcttactcttctctctttttcaacagcatggctctcagcagcagcacattaaaatcaaattgaaatccaatgcaaggcttggctacagagcagctaaggtatctttttaattgctttttcctactctcaacccccttccagctcctccactacagtccttcaaagaaacaagcaacataaagagaaagagatgtagaaagtaatcataatagaaagcatttgctgagtgtctgttacatagggactccactgtgtcaacatttaacttattcctaccttgttagataggtagaacaatcctcagtttgcaaataaagaaacggagttttgactttaggtaacttgcccaagatcatgaaggtagcgagagaatgagccacaatttgaacaagggtccattcaatgcaagtactttttttttttttaatctccatttcattcatggaacaaataagaaaatatgattgcaacttgattagaataggtgaaaaaatgtaaaagaaggtagcaattattcttcagcctgctaatagccaagaacacaatgccataggttttgtttcaacagatttcttattaaataaaaaaggtagcaatttttcataatgaatgttttatacattattcctttgtgtatcaggcctctaaagtacacattattaaagtctattaaagtctgtatttagcagcattactaatgtgcctttggggaaattattacaatgaaacagcatcagtctttcacaaaatttcaattgtttaatattccttttcttatcttcaatacacgtgtctatttttagctataatcagacctcatcccaaatgccgtaatcccagcctagagctgtcacagcaaattgtttatgggttggatttaagaaataacaagaaacacagacattgttaatttcacccaacactttttttttcatgattggttgcagttttcctacagttctcattaacaggtgctccttgatcactatgacacgcgatgatactttatctctctggttagggttggttatcttaattaattgcttatatttatatttaactgaaactagcctcaagatgccactttattaaagtttgagagtggtaagaaattacaaaactattccattaaaaaaaatagaaaagaaaaccaaataaaccagaagaacatataaactatgattagtcaaatcaaatctctgcatttaaaagtaaacatcatttactagatgtctactggactagaaatatgtgtcttctgaacagtaactgaggagtttctgcaaattattctgcaaattgtaaataggcatctctacctttttattacattaattttatcacacagtatgaagtttttttaaaaacaaagccaatgatgtacatatattcaaaagcacaagattctctgaaaatatagaaaatactgctaggcttattttacgaagacaaaggacaataggaagctgggaagaataccagcaaacagctatacgttataaggcctctgtatcacaaaaatgaagggaaaataaagccaatctaaagtattacgtacttaaattaataaactggattggaagcaatcattccattataaatttcctttcatacatagcaatcccactgagatgatacctttgtaaaatcaggcaaaaatcaattgttaatattctagagatggacaaaccacagattaagtacctaaataatcatgtttccaatcaccaattaactaagtagaattctcttaattgtatctattaaggcctactaattgacagaaaaagggcagagttgaggacttggagaaagaagacagaagcattcctctgcctgattcataaaggtcagaatcccctggccgttgttgtaggaacccagccatcaccagtcacaaagaaaaaggcagcagcacactttgagtatccaaagggcctctttactgaggctgcatggctgttgtgggcttagtccaacatgatgatgtaggacaagaacctaccagttcaatcaacatgcaattaaaactcctgatgaaggacggcccagggcagtccattggtttggggcaggggacgcagagaagcaaagcctgttttaattaagaaaatactaggcactcctctttaaatcctcaaaaaatgaggatgaacaagattccaaaaccaacaatcacaatgtgtgtgaaagtaccagcaacaagaatgaagtgggactgaatatgtgctttcctacaaatgaaacctgtttgatggtgtaaggaaaatggatgagctgtggtcaagaataggccgaggcagacatctagtccagcatgactcagcgagtttggagtgcaggcacacagctctgcctgttatgtaaccatgccatgtgaggtgcattaagtaaccactcatgtgtgctcatgcttgactcggagccactattgtctgtaaaaggtataattaccctgctaatgctgtatgtaacggcttgcacctgtggctcatcctcaggcttgtacccatggcttgcttgtgcccatggcttgcttgcacccacagctcccgtgtgtccagagaataaagccatgttgaaatgcccccatgattccttgactggtctttcagctgcctgccactcatccaccgactctcctccgacctcagttagaacccgacagatggtcagtagctgcagccatatttcaaagaagttatcatgattcacagctaggcctctcagacttgaaattatattacagtcatgtcaaaacagatcctttcttctctggggcctatagggtcttaacacaaagtccagcttttctattccgaagacttaatttacctcctacctcttcagactctccttcatcttttctgacattatcagatgttaagtcaggccacatgaccctttcactcaagacaaggcattgccatatccatatgacacggtagtgggtgcacagagtctcagggctagagctcactttgaggtgctccaacacaatcattcatcagatgctcaaactctctgtacaaaaaggttcagattttcagcataagccctggaacatgaagactgtgatatggtttggctgtgtccccacccaaatttcaaactgtagctcccataattcccacatatcataggagggacctggtaggaggtaattgttaactgaatcatgggggtgggtctttcccatgctgttcttgtgacggtgaataagtctcatgagatctgatggttttataaaggggagttcccctgcacatgctctctcttgcctgctgccatgcaagatgtgactttgacttcactcctcctcaccttccatcatgattgtgaggcctccgatgtaactgtgagtccattaaacctctttttctttataaattacccagtctcaggtatgtcttttattagcagtgtgagaacaagctaatgcagactgcttcttggagaagtagacaccagccagtgcttcaccacacactgctctgagatttggtggtgagccatgcacacaaagagagaacaacggaaatgtgtttctggttagacagaaaggaggagaagagatgggactgacgtagaagcattaccatagttccatagtcaagatgactgtgtacaaagagaagtctacgtaacttaggaagcaatcctctggaatgtatatgtttcatacatatttacacacacacgcacacattatatgcatgcacgcattttaaagacaaatgagcgttaacatattcagttaattattttaaatttatcttatctctctttcatgccaaatcgaccctctactcaattacatggtaagttgtattttaaatttgcacttccatacctctcagaagggagttatagtgctattttcttccggaaacttcacagaatttcccagtacaaggcaggtggagacagagtctggaggtctaacttgccctttaacatttccatgcacctcacattcgacaggactcaatgtacacgtaacagaggggctacagtggcctggtgccagcaatgtttctttttggcttcacaaactctataaaaatgaagttttttgaagagctaagggaaattattccttaaaaatgtagaaagtgagaatagaagtgctacaatgtccaagggcactcactgaccaggactgagggtccagattcttgttagaggaaagcctgccacatataagacataggcacagtctaactcagtcgttttcaaactcatctcacggcccttttacaggctcacaaatgatcgcagaccctaaagagcttttgtttatgtgagttgtttctatcagtgtttaccatactggaggttaaacccaagaaagttttgcaacatgaagacacaggcacacatcccagaagtgatgtcattgcatgtcacagtctctttaaacaccgttgtgtatagtcaagagagaaagggtgaaacaggtaaattgtatcttagtattattataaaaatggcttttatcttgcaggcagacagcctgaaagggtctaagggtgcccctcccaagggtccctaaaccatagtttgggaaccactggtctagttcaaacttgtacacatcggcagtgtctttgaacacgtaaatgaagaaatggcacagtaccgagtaagaggatgtactgttaatttttaaaaattgaggcactgaatcaaatgatggcatctttttctagagcatttctctactcactactgcccccaaaccattagtaaattaaaatgatccttcctggtaatatgccaagcagaatgaccctaggtccaaatctctgttttgaccactctctgttttctatctgctcactaaatatcttcatccatttgcacctcaaatgcaaaacagctaaaatagtacttattttttaaatgtttggttactaatctggttgttaatgaaatacacaaatattgtagaaaagctgaaaataccaaaaagtattttttaaaaaagaaagaaaggtgtcctatgtttccaccctctgggaaggccatggtcaacattctgggcaatagccttccggtctttttatcatgtatattttaaaaatgcaatgaagttcatattttaaagataattagtatattttatttaaaaatatttttagtatgaaagaaatgcacattgcttaagaaaatctagaacatacaagcaaaataaagataatgctcataatatgttgatgtgtataagcaatctttattctgtgtgcatactgtacctttttttaaaaaatgaaatgattagactgcacatgctgttatataacttgtcttcttcgcaatttatttagaacatctttttatgtcactcagtattcctcaatccctccttggcatttttattatatggctgtactatggttattcaaaaattactattttaagaatattgtgatgaacattttagctaaacttctgaacacatccatggcggttctctttgagttaatgttctagaaatggaaattctgggacaaaaggtatgtcaattttttaggcgttgatacaccttatttaagtccccttaagaaaggtgttctttcattaactgtgtatgacagagcctgatgttccctactcccaacttcactgggtaaatgttacaaatcttcatcaattgtataggtgaaaaatactatctcatcattttaatttgcatttctttgattgctgttgaggttgaacatttttcttctattttgttgatcatatttctttctttgttggtcttacctttctgttcttggcccattttctattagtgtaattatctttatgttataaatctatattaatttgtaagaactcttaataactctttctcatacatgggtaaatactgccccagcttgtcttttatctttcagaatagttcagaatgtcttttgattgaaagaagttctgaggtgttacatagctaagtacattctcttccttgataatttctgacactagaaattaataaggccttctttattctaagatcatttaatttttagttgtattttcttccatgtcacaagtttagaccttgcaatagctcttcaaagtctgccacaaggaggacctggccaatgccttcagaaaaatgactgttgaggcttattaaatatagattggacatttggtgaaacaaaccattgagggtgtcctggaaaggagagagatcttttatgtttattattcaccaattccttacacaacctccagtagctctgttaacttgctctttaagaagtttaaaatgaaaaaagtgttcatattaggtttatgttaaaatattaaaccagtgggcgtgatgactcttcttacctttgccagaacagcagctgtcttagatagaaaatacctttgctacgttcataatgtatttcttgcaagcacagtgcatggcatatagtatgcacttgacaaatatgtgttggagctgatgttttaccaactagagctctgtatatgccaggtttggggtgagagaggcagggataataaagtctggacttcacagcttcatatgaaggaggtgcaatgaaagaaaaactccaaatgaaggtagaaactaaatttcagttttactttttagttgactgtagagatactgatctgcgtgtaaacgtgaaactgcctcagacctgggacagtaggatgtggtgctgaatactggaaaatattcagagaaaaaaaaattctgctgggcagatcattaagcaaaacagtggcatccacccactaaaagagacaaggggcactactctacttcatttggatgctttggcatttgtccaaagcaataaaaatcagatccagcttgatctgaacataacaaggaagaaacagttctcaagaagatcctttttcatgatgggggaagagagagggtcattttgtataataatggaaaaatcaattatttttcaatcagatggagtgtcctcataaatttaaagcacagaacagcatgtgacatgccttcataaaaaacaatgaccatgagggagaagagtaaaggatcataatcccaaagttgctactaagaaggaaagatctttcaagagaagaacaacacttttcttgctagtgtgttttctgtgaatgtacacagtggtcagtatgcactgaacgtacaccatcctgcacaatttgcctctacagaatcctgttcaattggcttcccatttggctatggcttttaagtgacacactgaaatcctttctctatagcatgataatgcagcagtaacacagataaaccagaaatgttggtttttcttactggcaaatatactatatgtaatatatatttacacatattagcaagaaaataaccaagaaagtagtagaaatacttttgacagaatttaaaagttaaattttggccaggtgaggtggttcacacctgtaatcccagcattttgggaggttgagatgggaggattgcttgagtccaggggttccagaccagcctgggtaacatggcgaaaccccatctctacaaaaaatacaaaaattagccaggtatggtggcacacacctgtagtcccagctactcaggaggctgaggtgggaggattgcttgagtccaggaggttgagcactccagcctgggtgacagagcaagaccctctctctctctctccaaaaaaaaaaaaaaaaaaaaaaaaagagttaaattctaattatgaagtttttgatcaacataaagattggaaagtcagctcttgcaaaaagctgcgaagaatgtatgaacactggaaagatggtcaagtctgcatgagggtttgggagaatgcacaccctgggaaaatatgtgccccacaatttctttaacatgtaagaatttacaatggttgtcagaatttacaaccattaatgcctgtttacaatatttaaaaggtgaataaataaatatgaggctgtctactctgtgtaaacccatgagtttgttatcatattccacgtacactaacatattccctgtagactggcctcagggatgacagcagattcttgatgggccttatgcgcaggaatgccctctgcttctctttttagctggcactgatacaccaacatgcgagctatccaaagtcccaaagtacacccctttctggtgtttcctcagaccctggcacagataggagttcaagaatgtgaggaatgaaggccctacctgatggacagcaactcatgaggtatcagggtagtcctgttaaattagtgcggccaactgctaatccttttgtggcacgggatttgggggattctgtgttttctagagggatggtctctaatggattcaaaagagagctgtcaatgtctaactgcaatcagcatcgccctggcacttcaaaggaataacaaggaccctagaacgccagggccaccctccatccgaacacctccctaactgaagtgccccgtcagtgagctgggatttaggaagaaaggagagcattacagtgtgtgtctgaggaagaggagagtgcacaattcgaatgtctccaactttctaggaacaaatccacttagaacgtcagtcacacccacaacaatatttctagcactccaactaacaccataattgaggaggagattctctggttttattcatgctgagaagagctgtttcctccccagagagtgacctattctttgtcttatgccaagaaagccataagaaaaatgctgacctatgaaggtgacacatcatgcttaatcactactttcaattaaaacaatataaaataaagaacgtactgagccactcaggcagaacataatatcccaagcaacagacacacctactgagacttgacatttccgaggagtctggttcccagctgtgtgtggagagtgaatccatgacattagatgttgggttgccctggagaaacttagggcggagctgtcacagcaaactgcatttgctgataacagatttcccgagttgccttagcttttcaatacaccaaactccaaatactaggagccaaaaaaggtttgcagccatggatctcccctcatccccacctccagtcatgaccctggggcagaacacctgcctactttccagtattctagcagctaacttctcaaaggaggcttaacgccaagtgtttaagctggggtggggttgaagcgggaaaactcagcactggtttctttctctttggctcagctcagccaaacaaaaactcctcaaaaacaattgcttgtttttttgctggtctcttcagataggataaagcggccagagtctcccataaaacttgcatctagggaaagagggtaagtgcacagagggcttttccagctttctcccacccctgaagctgcccagggcccttcgtgcccatgagaaggctgagtaaatgaccatgagaaaagtcaccactggaagagggtcctttagtagaagaatttcaacagggaaatgggctttctaaagtctagagattccatatgctcttttcacaaccaaaccatcgaacagggctgtccaactctaccacaatccatacaacaggcccacaataacacacctgtttttgtaggctccggaaacaactctcccctgttttaaatccttcagtggctcataggatctggcccttgcctccttctctgggcttatatttgaccaccttccacttgtgcagcagtttccaaccaaggggtaattctgtccccgtatgggacattgggcaataatctggggacatttttggttgtcacaattagagtgaagggaaggggatgctacaaaaaatcctaaaattcagaagacagtctctcactgcaaagaattacctggtccaaataccaagtgtcaaggctgagaatccctgctccagccataccaaactctttgctgttctctgagcacaccaggctttctcatatgcttttgtgcctaaacacattcctttacctggaatgccttgccccaccttccctgtccaggaaattaccatttcccatctaggatcctactcaaatgtcacctcctctacactgtctttcccagattccccagagttggatgttcctttttctgtgcctccaaagcttctggtacacaccttgctagaacatactcactatgttgacccaagatagtctgcacacgctaaaggcatctcaagttgtattcttcgtttattcccatagggcccatctggtaataaatcaccactcaccaatttaatcagggaataaatcaaaatggaaaagatgcaccttacactctcttggaactatgtctaagggataacagtgtccccaacattaaaaacaacagcagtaaatatgtatcaagtgcttgtaatgtggacaggtaccatattaagcactggtatacgcagtaactcatttcatccttgcaataatcctatcaggtaggtatcattattatcagcattttacagatggggaaattggggaaccaagaagtcaggccacttgtctagggtcactgacactagcatcccaaaaaagtgatatttagtcccaggaaatctagccccagagtctcaatattccaatattcatgccaaggcagttacactaaaacccagtatttcagccactcagaggcccctggcaagtataaatgacacctccagaggactacgcagccagagtagccaccagcacctgtgaccctgcttgtgggggatcacacgactctccaactctgaaatgcttctggcaggagaagcaacctcttcacatcatggaaagacatatgtactccagaaaatcatggtaccgtaaaggaaatacaagtgctgattcctcaaagtacctcttaccttgttcatgctgcagggatgggagcaagggatcagacatgtcacagtgcgaggaagttcttgaagattctcctcattcctggagccctcactttctgaagcagacagctgcactgtgaatataaacaaagaagaaatccatcagctggtgcccaggaaggcatagagcactgccatgtccagtggcacttgctgtcatgatggcaatgatccaagtctgcactgtccaacatggtagccactagtcagatgtggctattattgagcacttgaaaagcagctagtgcaaacgggggctgccaggactcaacagctagaactttcacagatttcctagaaaggcagtgtaccataagggaattcaggaggtcagtcttccatgggccaaatgaactaaacagtccaattccccccaaacagtccaattccccccaccatgttttcattcatgctatttattctttacatggcgttttttgattcatatgaattacattttagagtaaaagggtcattgtacagtttcagggttcttctttgtcttttttgtttttgtttttgtttttttggcatagagtctcattctgttgcccaggtttgagtgcagtggcatgaccacggctcactgcagcctcaaccttctcggctacagtgatcctcccacctcagcctcccaagcagctggggctacaggcgtgcaccactatgtccagctaatttttgtattttttgaagagatagggttttgccatgttgcccaagctggtctcaaactcctaagctcaagtgatcctcctgccttagccttccaacatgctgggattatgagccaccatacctggccagtttcaaggttaatttgtcaaatattaggggaaaatattttaaaaatgacttcaattacttaaatggacttgtagccttttcctctgaaaggtgtttacaggtggaactgagaggagagcaaaatattgtaaggttcctgatactcaatttgtgtgttatttttttaagttgcatctaggagggatttatatatctgcaccttcccataatacatggaatcggaggtttaactggaactgcagtgcttttaaaaatgaaaaatatactatttttaattataatatattaagactatagaaaatgttcaacaggaaaagaaaaaggtacttataaccccacaagcccaccataaccatctttagttcttagtaatcagcctttgtctacactggagaataacatgtctgctaactaagtccaggacatggagaattccaaagctgtattccccatattaacatctttcactgctaagaaaatgattttgcaatttacattttcaaagataaactcctactccatgcacattactattctatgaacataatattactacgttccttttataaatcagatgatagagagaggaaattgcaaatcactccttggctatttgaaatacagattccaaaaaaaataccacatgcggattaaagacttaaatgtaagatctaaaaccataaaaaccctagaagaaaacctaggcaataccattcaggacataggcatgggcaaggacttcaggactaaaataccaaaagcaatggcaacaaaagccaaaattgacaaatgggatctaattaaactaaagagcttctgcacagcaaaagaaactatcagcagagtgaacaggcaacctacagatgggagaaagtttttgcaatctacccatctgacaaagggctaatacccagaatctacaaagaacttaaacaaatttacaagaaaaaaaacaaccccatcaaaaagtgggcaaaggatatagacagacacttctcaaaagaagacattaatgcagccaacaaacttatgaaaaaatgctcatcatcactggtcattagagaaatgcaaatcaaaaccacaatgagataccacctcacaccagttagaatggtgatcattaaaaagtcaggaaacaacagatgctggagaggatgtggagaaacaggaacacttctacactgttggtgggagtgtaaattagttcaaccattgtggaagacagcgtggtgattcctcaaggatctagaactagaaataccatttgactcagcaatcccattactgggtatatacccaaaggattataaatcattctaccataaaaacacatgcagatatatgtttattgcagcactgttcacaatagcaaagtcttagaaccaacccaaatgcccatcaatgatagactggataaataaaatgtggcacatatataccatggaatgctatgcagccataaaaaaggatgagttcatgtcctttgcagggatatggaggaaactggaaaccatcattctcagcaaagtaacacaagaagggaaaactaaacaccgcatgttcttactcataagtgggagttgaacaatgagaacatatggacacagggaggggaacatcatacaccagggcctgtcggggggtggggggctgggggagggatagcattaggagaaataccttacgtaaatgatgagttgatgggtgcagcaaaccaacgtggcacatgtatacctatgtaataaacctgaatgttgtgcacatgtatcccagaacttaaagtataataaaaaagaaaataccacattcagtcatagcaatagcatattttaacaataatgtacaacacagatcttggaattccaactttgtagtacgaatacatccaaacatctccacatgtacatgatgcctgggtaatcatggcttcaaagtcaagaaaattcaatatctaattgtaattgatcttaaagtgactgaaaaaaataatgcatgtaacttttactctttcaatttccagaagcatgtgctaataaatttcttagttttaaagtagaactttatacatgctgtttccttttcaatgtatgtatccatccatgtaaaaactacagcctagcacttaactggaaagcttgcccaaatgcctagcagagatgcctcatgtcacaattcaatttctatgtacacattggtatcaacacaggaaatgtgggcacaagaagataataacagacaaggattcttgaacatcatttccctgaggaaccccacccagctccaatcatgccacaatccccgtactctcagaacttggataaatagcttgcactaaactgattacggatcccttcctgcccccgccccaactgttcttatgtcattttcatgtatgttgttttacaaccgaaacaggctaaaaaccctttgagggaaacatcagacacacagaacgttttaaaataaatattacgatagttttttctttgctgtcactcacagggcctaggatgatacagactcttaagtgtggggtcttaaaaacaatgttaataattgttgcagctgcctttggagttcttttaaaaaggaaaacctcttaatgccagggttgtaaatcttttaaaaaatattaagaatgtcatacaactgtatagtaccccaaactgtacaatgcacttttatatattaatactctcatttaatactaataccaatctgggtggtagttttcctaatttggaaaccagacacagagaggtaaaagaatttttcctggttcttgctataataagcaatagaccctggactagaagtgacttcatttcaagacgctatggaaataaagcatgtgaaagaccagaaataaaaaataaacacaacacacaccccaaaacaacacacacacacacacacacacacacacacacacacacgcacatgcacacaccaagaccaccatttaacagaaaacgcctcagagaacagatgacaattttagaaactgggtcagttcacttctggacagcaaccaaaaagactggccttgttctatcaagtactttccatctcctttgaaatcgagggaacctggttgttttgcagccaattcagtttatgaagaagcttagcaaaatctacagcttaaaaaaggagactgcatcttaaatataaagcattagggaaaaagatacctgagttaccatggtggaatcaagaatgttttcttttttagtttattattcaatgtttctttttattgttttaagaagttggattcctctagtactgaacaaaaggaaaactacagacgtctttaaagggtgccttgagaaagttaatcccataagcccgtgtgacttccactcagctgatcctaacagttggttcaatggtcaatcttagacttctaaaaggttaatgaaacataatttgtctttccaggtggatagaagcatgggtaagaagaaaggtggtccagaattacagaatcccagcactttgtgaggctgagacgggtggaccacttgaagtcaggagtaccagcctggccaacatggaaaaacctcatctctactaaaaatacaaaaattagctgggcatggtggggcaggcctgtaatcccagctactcaggaggctgaggcaggagaatagcctgaaccaggaggcagaggcactgtagcctgggtgacagagggagactccatctcaaaaaaaaaaaaaaaaaaaaaaaggcagagacaaagtaagtctaagaagaagagagaaatgacaagaaaagatgaaagatataaagaatggagaaaaacaaagggcggcaagcaaacaaagacactcagagataggtttggtaacatggccaagtgcccctcaccagccaggtcctcgctatggaagagacccagagatttgggctcctggtgacaattccacatcctatggcttctctgagggttatactctgatgtcttgggtgtcagcaaatgggagttggagaaaacaccaggcgtacctgattcaccactatttatttaccatcaacctccatctaccatggagagaagcctattttacctggatcactgttaatgtggtatagaggtatgctgagaataacataagccacctttaatcctatgctctttaaagagaagcttaaaagtgtcaagggctgtgtgtgtgtgtgtgtgtgtgtgtgtgtgtgtgtgtgtgtgtgctctcctgacccttgaaaatgcaactaatactgccaaatactgaatggaatatggtgagttgggcttttctccccactccaactcccacccccttctatgatgtccattctagaagccttcagtaatatatgtcaaagctgggtagctcaggcactcctgtgggagatagataggccaacaagagcaagcaggtcactcttcgcagtgttaaaggtctcactagcttttagacataacgtaccatgaggccagtctgtgggatggactcttgttcctacccttcccaccaccacgcccagcagcttaggcagagggctggggcatgagggcctatgccaggcccaagagcttttggagaaggagtaagtgaagtaatacaaggtgaaccggctctgaagtctagaaaaaaatgctcttgcatctaggacttagaaacttgggaaatcagatggacaggtgagagcaatatcccaaatttcctctactctattttaaggggtggagtaattcacatggctttgaagttaagtctggacaatcttcaactggagactttcaactgaaaaaatataaggtcattttattacagaaagctaatccctcccttctaccatagggggcatggtgctgggattgaaggatccaaaggcaaagaaactagactcctgcccccttcccccaatgcatacacaccttctttccaagtggctggctcattccctgcttcctaaagaagaggcaagaggaacagagtggagcttgccaaggagattcctgcaggtccctctccatcctcaaagttacagcagatgtgtggctgtggttctccatgacttcagtgtcctcgccaccccacatggaggcagcaaacacactataacatggttctgccccaagagaccagacgtttgccattctgctttgctcccctgtgcgctgccttcacagcataccatggaaaacagacattctaagccagaacaacaagagcatcttcccatcaagcatcaacaacagccttcctccccaaggataggttaggtaatttgaaaatgaatgttctgaaattttaactaatatatgagttatggttcaataggaaatggtaataaagaggaggaaacaagaggattataaattataaaagagagacacattgttggtaacacacgcacacaaatagtctgagagccagatggggagaaacagaggccaggaagggccaagagtgacaagtggtagagggtccatcactttcatacacccacttctggcacacaggctagggggttcttgcacttggtcaaatgataagtcaggatatctaatctttagattcagggctatcactgtaaaatgtaaatcgcagtctccagtgatttaggactatctcaatttaaaggcacaacacagaggagcccccaagaggttacttggcctggcccacttcccttgcctaagtgactatttaaaccaggggtcacaaattcagatgactgcaagggtcaagaaagaatgagatgagtgaaaggtcaggtctgggaagacagtgaggaatggggcatccggggagtctgctactcagctctagccccagcaaagcaggaacaagccccatgtgccaagagcttctgatactcaagaaacggagttgagagactgtgtaaaataatttgctgttttaatgttggaaactcatgctaatactttggaaattttgtaggagttgggtctggttggctagtttgcctcttctactgcacaccttccatgtcagtcaggggattctttgttcctgtaaacctccgggagagaaaactctctacctgcctcttggcccctctgggttgtactgctagggcttcactgcccacagaaagccagggagaagagtaggcaaagagagataggggccaagtcagtctgaatatcaactccacctctcggaatgtgatttttggcaagttactggctctctctcagtctctgttcctttatccctaaagctgggggaaattctttatatctctggagattcttttgaggattgttttgagcatttcacaagaagagatcttgtctattttgtactagtacccaaatacccagcacctatcccgctgccttacatacatacagtaggcactcaatatatgccaaatttaattataatgtttgggaagatctcctgtaagtctggcaccagttgaacctatttcctttcattctctcctcttctgatgctttaatgtcaatattcatatctacttctcgcttggtcagaatattttgaaattaaactttatagaagtccaaattaagaataaatactgaagttttttcttaagaagcatggcacacttttaggtcagcaaggcactatttgggtactactggtgacagctttttgcgcactttagaagaaaaaaaactaaacaaaagagatttcattgtcctattaataaattaaggaatcatgcattaagtttagcattctcaactcatgtttgccaatagtgcacgtcactgcaaagggagtacacagtggctattccaggcaactcttgatccatttgttcactttggattgagaaggctgaattatattcatctagaacaaatgtttactaaccatgtcttatttacctgggtttctttgattttatgctgaaagaatcccagacccctccaaataatttcaacttccctctcccttggcggggcggggggagggggttgctgtacaattcaggcaaacatatttcctatgatttggtgagaaactgaaataacagacagcctgatgggttacttcagagtgatccactgcaatgggagcactgttaaagaagcgttaagggggccagctatctctccaataaaaagtttctaattaaggaactaaaatattctcaagaagatcttggggacaagctataagtaggatgttaccttaattggggctagtgcttacaactgaaactgcttagcaagccagaatgggttatatgccttgttcctcttgagaagaaactttcattaatctgcagaagaaaactctagttggcctgaaggttcactgttaacctctgcttttctggggcttagattctgttccttttttttttttttttttttttttttctgagacagggtctcactctgtcgcccaggctggagtggagtggtgccatcttggctcactgaagcctcaacctcccaggctcaagtgattctcccacctcagcttcccaagtagctgggactacaggtgtgcaccacccatgcccagataattttttgtagagacagggttttgctatgttgcataggctggtttcaaactcctgggctcaagtgatcctcctgtgttggcctcccaaattgctgggattacaggcatgagccactgtatctggccatattctgtacttattatcagcatctccttagtgcagcttattctttttgagggagtaccatgtcccaggttgttaagcctctccacagggatctagtgtttgcctccactatggcctgagggcgttcaatgctctcaaaccagtttctgccaaaacagttgaagttataccatgcaggtagtagtgtaactatgaaccccagagctattcaaacagtgtaaccctgggtttccatccccctggtctgtgccccaacacacagacttaaagccccaaacagactggggaaaatcttcttgcccccctttcacaagcaattcctgtgtgagtatagacaccatagcccctagagcctagagcctacagctgggtctgaaacactctaaggccagtggcatcaatgtcttctggcacctaagaatttccctgtcctgctttaaagctcgtatgtacttgaaaatatttaaccaatataataccttaggactttttggggtgggtggtcagaagtaggccaggcttaggactttttggggtgggtggtcagaagtaggccaggctgcatgagctcagtataccattctgccagaattgggttccctaaatgcaattctgccatatttaggttccatatgtagccaattctagctgtcatttaggctacaactagaattatgttctttgtagcctaagctaattgctgtgactctttcactaactcatcctcattacagagtgccattgggggtagaaagtgcttacgggtagcccaggccttgagaaacctacccttagccagaagcagcaggtccaggcagttaccccaaggaaacaggtcaccttccttcccaaggctgcattttccacacccaagtctgccctcagttctgtggaaaggaatctgccttccattaacttttccataatttagaactggatgactgcacactgatgttttagtagaatgagagaagcaaagacagcaagaaatgcaacaagggcacaaccaccttaacacatcagggaggtctgcagggagtcactgcgttctccgacagcaagcagccaagagaacagccacagaaagcagttccagcagctgaccctggggtcctctctgatctcattacagcagttgacactagtcctcacaaaacaaacagaggaaatttatgcttgccttagctgtggaaagctccacattccttattaacgagagtttcagcttctgagaccacagccgctggaatggggaggaggtcagctgtgctcccaagaaagaactgtggctgctgccttgccctctttctggggctggatatacaggcagcgagcctggggcctaggctgtctgctcaggtgactgaggggaagttccctttctgctaatgtcgacttccctcggctcagacggtggggtcatttcctcttaaacagcactgggaaactcactgtaagggagtcctgaggggatccacctgctaaggtcgcaattccaagagagaggttgttctgcataaccatactcaaaagtactcttgcctgcaccttcaaaaactttacttaacttggaattccaacttaaaacattatttcatatcctttaattcaatcttagaagtaactgagcagccagctcatgacgtaaagcgtgagcttctaaaccagagtaagaaatgtggagcagaagttctgaaccagagtggttttgtctcccaggggacatctggcaatgctgtagacatttttggttgtcatgacccgggggagggtgctactggcatctagtgggtgagaccaatgatgctactgaagatcctaccacgtacaggacacaccccataataaagtattactggtccaaaatgtcaatagtgctgagattgggaaatcctgacggggagggaacattcaaggatatgggtagacttaaaatcatgccaactcataatcacattataataatgtggcaccatgcaacttggggtccccaaaatgtaaacaattaacaaccataaaaatttaccagttctctccttgagcgaagtaaaagctgtaacttacacagagtaagaccatcagagttgcctggaagaagtggaacagcttcagtgttggactatgttatcatcaatatcatcagtgccttgtttactccaggtcaaggtgtgatctgagtgtctactatcaaaattcagtggtagctattaacagaaggagtttatacgtgaagttctatggtcactaaaaccgtctaaataacctaagaatatctagctctggaaaaaactgcaaaatgtttcaacttttaaaataccaacaaaatatgaggaacaatgttgatgttgacctacattctatctagggtggctaaaagaaatagctgcacaatagggttctaaataaatgcagaattgaagaaatgcatcataacaaagataatcagggtgactattttgaaatgctccccatttctgtttttctttctgttttcaaatattccctctcatccacgcggcatattttcattacatttgttgtaagaatgtacatttagataatctactcactattcttttatgcattcttttactccagccaaaaagggaaaaagtccctatccaaacaaagctaatgcatgtaagcaaatttgaaggaaaaaaagaatttcatgaatgagcgggagacaattttttaatggaatgttttaaaggcttgtggtataaacagtaaacaaaattgattcactaacattaatactgtttgccatgatgtgagagttggtctttttttttaatgccccagaagctaaaggaaaataaatactgtggtagggaaaaataataccttacttggcattttgaagtcattgctcaatccttcttgagcaagaaaaccatagtaatgactttgttttacctaccgcaattatggtacacctcgcagcaatccttcacaatattttcctccctctgttcaagtcctgctaaataatctctggaaaccattaactaagagtacggttccaattttcctgttctccctcctctgctgcctcagtgtcatgttggcgtcaggacaaagcaaacttgtatgacatcacagagcaaactcattttctgtaaaccagccccttggtagtttaccgctactggaacccaacgctgtcaacagtgtggtctttgtttggtgggtgttgctctaaaaatttttttaaagtttcccaacaccttcttcttttaaacagaggcaagctgctggaggcgccgtcctcgcctggcccgccccactctgtaaactagacattaccttatacacaaatgactctaggcattcctcagtctagctgcctcactgcaaaattcctatgctcctcagcagcagggcagcgcacattcccctggcttcccctctttcctcttcccccaccctcctctttttcttttctttcttttttttttttttaatttccactgcctcactgtgtttttgtgtaaatgatctcacatgactcaacaaatccatctgcctgaagcaggccaagtctggagccctcccaggagggaggagaagaattgctttgtggaaaggacctggagctctgccctttctctggctcgaattacccgcctgtcaggcctgacggatttggctaaaaataaaaggaaacgggccgtgaaaagcagatgaatgggctcagcagttccttagataacacaggcctgctgttgcccaaagctccccaaacagaaacttcaaatgcagggcctctgagtcagtgatgtggcttccaggtgaacgaggcctgtcaaatccactggagttgggggacatggcctgggctgtgaatttcggtttcctttccgtgtgtgtgtgtgtgtgtgtgtgtgtgtgtgtgtgtgacacagagagtgagagtgcacgcaagagagattgagagagtgagagaaccagtctagtattaaaaggttctcagaaaacagtagacttcagtggagtgaaggcttgtaaaaaaaagaaaaaaaattgttgtttccactacaaaattatccttctccccacctccaacaccagacattttcagcctccctatgatgtcacttctctgtttagagccagcaaagagctaaaagtctttcttgtaagtgtatgcccagcgcctgcagtgggtattaagcacttaggttggcaatgtaatgacacactgtaacaatctgtaatatgaggcagtcagcaaagccctggctctgaaagctatttctcccgaccattaaccatatgtttggctcctcagatagccaagcgggtgttccagcttaccatctggtttctatccacacaagcaactgcaaagcacaggctatgtccctctggagctgtgtgtttctttttctctctcttttccgctcttctcttcccctttcctcctcccagctcctttggttccttctgctaaagaattctctgccattcatcacgtacaaagaaaactttacctgacatggcagcggcagagccattaagaatgcacagctgtattgtaaacacgccagagggccatttaccatccgcggaatctgtacaagtcgggctctaccccttcctcatctactgagtgctgacacttgatccagcatgttaaaaacaggtacattcttgagagatccaggggttgctgtggtgcccttcatactcacttcatattctgggagtggggctttaaaacacatacacacacacacacacacacacacacacacgctcccgaagtttgcctctgcattcaatctgcctgacgtcagtctcacacaggatgacataccaccactgcaaataaccaacttaactacaggttttgattcttttttctgcactaagggtttgatcccaagtgtgtatttttctgagtttttttttttccgcctaaacagcccacattgaaagagatgacacttcagaagaataagaacatgcagccgcttgtaacaaattgacaacctgcaaaacttatgcttatttacatctgcactttttaatagtacacagcaatgaaatggaacctactatcagaatttatagaattttttcacaatgtttccaaagtatttaccccagagtttctccgctacaggatttaaggtcctttataactctatacatttttaaatgtatgaaggaagatgtatttgatatatagaaattaggtcacttttcttcctgtccccctaagaataaggtctgcattagcagcccattttaccgaattaggaaattaaagttaattctttcccacacactgaaaaaaataagggctggtttctaacatatcaagaacaaaagaaagaatatcattaaaaagtgactaaccagaatgtcagattttatcaatgtggcagagctacagaggatttgtcaggggaggactgtttattcaggctaacaagggtgccaggaaggccactacctatgtaaacttcttaaacccacagcccttgtcagtcctcatttccatgatctgaaataggtgttgtgttagctatttctatcaataagggacattaaaattctgctgcatgtaggtttttagagagtgacagaaaaggaaatttttaatttcagaagccttaggaaaattgtccacagatgatggcgtctattaaatgctgtttgaggtctcaaaaccataatacaaactttaaattgcattagcttgactgccaagaaaaacaataacagcatagttaataaaaagaaagaaaaattagcaatttaaaacttcagtattttcatagttaactacctggttttctaagcactgcagaatcattttattacaggtatttgtgcttttcataaatactggtgcctgggcccctttcctccagctcaattatacaaggatccctgagtggggaggtatttttgaaaagcttcccaattttgtgcaactaaagttgagaagtgttgccttatgtgaactaacatgatagtagaaaccatctcatcaaaataaaaatgaaacctttggtatagaaatgtaaatgaaatttaggaatagaacagtagctttccaaacttgttctgaagtgaaatcttcaatcaaacaaaatcttatatgaaatccctataagcaagataggtaaaaagcagtaatttatactgtccttttatacttttagtctgtacaatattcatggattttttaagttcaaagttataattttttaatcataagccacccagtgagaaaaaggaggccattttattgaacacaaaacctgaaattgaggttaaggctgaaaggtccagtcctatacacctcagcatctaattttttccatggccaatggttaagatgatcaaggtctgatgtatataaaaatagcagtgtgtatagcaggatgaaaattagttcataagttaatgtaataaacatccattaagtgcttactacacacgaggtactgccctgtggtcatcagagaaataagttgcagcctttcccttgaggagtctacttaagacgacacctaatggcagaacagcaagacaaatgcaataatggaggtgctgagagacactatatgggaaggagtggctaattctgcttgaggaaatagggcgtgacatcaccagcaagggacaattaagtcaggtcctaaaagtgtgagcaggatttttgacacctaaaaaaggagggacatttcagaaagaagaaactgaatgtgaaaaaaattaaaacccgtaagtataaacagggttggtgagtctgggggttatgagaaattctgcaagggacaggaagggctgggagatgaggccaaagaggtaactgagtccaggttataagaaactctaaatgtcatgatatagcttagaccagtgctggccaacagaaacacaaggtgaactaaacctgtaatttaaaactttttaataaccacattaaacaaataaaaagagagaaatttacttaatattatagaaaaaagtattattttaacatgctatcaatataaaaagtattaatgtgctattttacaaattttgttcatactgagtctttgaaacagggtgtggattctacacttacggcacatctcaatttggacaagccacattttaagagctcaacagccacctgtggctagtgactattatatttggaaagcacaggtttagcccttattttgcaggcagtgcagaccaaaggatatgcttggttttatttcatgagacaatggcaacaatgtgaagaagcagaaacattgggtctgggagaaggcttctgaggtggcttccacagtccatgcaagggacacagagaagaacaaggctcagagcaagtaggatggcatggaagagtcagagtcagaagatacttgtaaaaggaattcagaaaactttagaagactgtatgtgagggatcaagtgaaggactcacagaaccattacatttttttcatgctgaaatttgtgcttagaatgaaagctcactgattgtgtatttaatatgaagtttcattgttccttttgagcttgcttccttctgcagtagaatgcagtgtcacttatgtaggatatagtaaattcctcttcaaagaaccaatatggtacgttcagcatgttcagctctcctgttctttgttctccattttaaagtttaaaacttcctcgttctttatgtctccttgcccctagtttcagtaaacaaccccctcttagcctctatcatctgctcttagtcatccttagtcacctgctctgtccttagtcaactgctctgtccttagtcatccttagtcacctgcactgtccttagtcatcctctgtcacctgctctcaaacagtccttcctgccgaaactactcaacccgccactctggcgcgcacccctgctctctttaaaacagccaatcggaattagcttagactgtgtggtccaaccctagccaataggggaaagacacagcagtagggactagctgcgttaaggataagacccacttccccttccttgtccagtgtgctctcgccattgctccatccatgagacgcacccttctatagaagcaaattgccttgctgagaaaacttttgcctgggtgctattttcacttggtggcaccgagcatttacttccaacacttaataaacatgtgctgagtacccaccacatgttaggcaacgctgggcactggggaagcaaagctacgacataattcttactttcaaagagctcaaatacagtgtaggagacaaaacaaattacaacagagcattaagtaaattaataaacagatatgcaaagaggcctacaaaatgttccataatgtataacttagaactgtttcatataatgtattcaatggcacttgtgagatggagtggggctttcagatagtaaggcttctatcagctgacttttttgagacagggcctcactgcagttgcccaggctggagtgcagtggcgtgatctcagctcactgcagcctcgacctcctgggctcaggtgattctctcacctcagcctcccaagtagctgggactacaggtgcacaccactacacccagctaattttttttttgtttttttaagtagagatagggttttgccatgttgcccaggatggtcttgaaaacatggactcaagcaatccacctgccctgagctcccaaaatgctgggattacaggtatgagccaccaggctcagcctcaattgatttttaaaagtgatccagaatatgatttacttctgtgtctgtatttggttgcactcactgtattaagagaatcctgatactcctaaatacagataacactatctgaatctctgctctcaaaactcaaattttcagacaaatctctcgctatttgctactcttactacttactatctgaaactgagaaacgaagctgacatgaacataacaagttcaaattcctttgcactggaatttacaatgggaaattttggcacctgaattctggaaatgagcagatttgaattgtaaggcacagttgtattggaaattataacagttctttagcatttcatttgataatctcataatatgcctcaaaactaatctaaaagcttggagaaaatgcagcagtcaagattttatttcaaattttaatcactaatgataatttgacaactatttaaggtaaaagagtatccaaaatgtagagtgggtagacatgatcctctaacagaatgtacatcactaagtgatgtgtgtggtgttcacttattgtacaactagccattaatccacacagaagcctccatcccacagaggctctgaaacgctgcctggcatgtcatcaagtgtgctgaatatgtgtgacaagaggaatttgcctgttcaatttatgatcaggctggaatatgaaaaatactgggatggaagttcctaatcaatgattcatttatttataagaagttcaaatatgtaagccaaaatagtggaaaacactatttcaaggttgacttggcagtccaattcaatgtgctggtggtcctaatgtgttaaaatttggtaggtagcacatttgtgtgcattttcttttattatagttataaaacatagtttaaaatatattaaaatgaaatgcaaattagatgtttgcagagcctctgaagtatctccagggaacttctgcagaccagagtttgaagatcactggcttagggactttgaggttaaaatgtaaatggaagaacaacaatttggtgcacctgctattttaaggctcatcaagtcattcccaaacttcagcccagggcagaaaccattcctcattatcctaagagcagtgaagctgagaaacaaaactgcagaaagtgttttcagattctctggtgagttagaatttaaaaggctgggaccaaaatttgaaatacattattcatatctcaatgttgttcatccattaattcattcaacaatttactgagcacctgccacgaggcactgttctagaggcttgaaatacatcataacaacaacaacaacaacaacaacaacaacaaacaaggttgggcatgctggctcacacctgtaatcccagcactttctgaggccgaggcgggtgggtcacttgagcccaggagttcaagaccagcttgggcaacatggcaaaactctctactaaaatacaaaaaattagctgggcatggtggtgcatgcctgtagtcccagctactcgggaggctgatgggggagaatcacccaagcccaggcccgggagttcgaggctgcagtgagctgtgatcatgccactgcactccagtctggataattggagtgataccctgttttttaaaaaaatacagacaaaattccctatctttgtgaaatttagagttagtggggagagacagacgataatcacaaataagaaacttgttgtaaggtaacaggtgacaggtgcactgaaaaaaattgggagtcaggcaaacaccacatgttcacacttatacgtgggagctgaacaatgagaacgcatggacacagggaagggaacaacgcatactggagcctgttagaggggggtggggagggagagcatcaggataaatagctaatgcatttgggacttaatacctaggtgataggttgataggtgcagcaaaccaccatgccacacatttacctatgtaacaaacctgcacatcctgcacgtgtatcctggaacttaaataaataaaaattggagtcaggaattagaactgtggtggaggagaaaggctgcaattttacataggatagtcagggtgtgccttactgagagaaagaaaaagaggatcagagatctggaggggagaggtaaaccaagaggccatcagttcaagcagtggttctccaagcggggtcctaaggccaccagcattaccctgaaacttgtcactagctcagaaatgctagagaggcacccagtggtctgtttttgcagactctccaggtgattctgatgtgctgtaaagtttgagaaccactgccctacagaaaaggccctaaaataggagtgggtctaggatgttctacagaaaaaggggtgaaaccaggcatctggaggtgagagccaggaggacggacggtggtggccacagcatgaatagctttatgatcacagcaaggctttggctcagaaaaatgtggagctatgaaggacttttcttcaggagccacacagcctacatttcaaaatgttcatgttggctgtttggttgagtggaagcactgcatgacttgcctcaagaggagactccctgactgctcaactccattttgggcagtggtatgctgctaaatgtttaaaaacagactctgagggtgaggagcaccaatttgtagtgtttgatttccatggtgtaaactctcccaccatggctgatttcaagctgccagtatgactcactgaacatggagttgtgaagagatgtgcataaacgactcacaatactgactctagtcccaacgtcactgttaccactgagaacatttaaaaataagggagaattctgtaaatctgattggaaatgtgaatgctattttataagtctatataaatgcaatgtcttctattggtctattactgtcaatcaaacacagagcccaagtccttagaattttttttttttaagaggcagggtctcactctgtcatccaggctggagggcaatggtgcaatcacagctcattgcagcctcaaactcctgaaaagttaatacaacaataatatattaacttcatttagagaaaacaccattagtattaaatttcagcttcctttattcaaaaacatttgttattgaatttctcttctcttactacaattaacatcttgcactctcaaaaagtatgcattgactaggatttgccatgcatagtatgtgagattgctgctccaaaggctcacataaatccaagacaggccatcaaggaatgtgcgtgaactgcaagaataaaagtttgaatctatctgaagatgaaatgaagtttgaataaggccttcatccatttgatttgccattaagaaacttttcttagcctaatggaatatccctacttctgtcaatgagatttcagtttgtgaataacattttcaaagtgcagcatcttctgtctacaaaaagacattctatgaactcttaatacacataaagtgtttgcaactaccaggagtctgctccacgcattctcccgtctgcatgatccctcgggcggtataccacccacactcagaccccgggcagccagatcagcaaatgtgcacaagcctgcactcctgtcaaacaatggggtctttcaggccttacaatcttgtgaagaaacaggctaaaacgtcatgggaaaaattaggaaatatcagaggaaaacagctcacaaaatgaggggtggaaccacttgctcacatgttctaatttctgaacaaagagaaacaacagtgacagccccctgcctgctctgacccctccatttcaaaagagaggcatcctaacccctttttcttttcttggagattacagcagcaagatgtagacagacagaattagaaattcttaaacctaaagaagcagagttaatttcaaaagctttatcctcaagagaagcataactaacccatcttaccagccttgtttggtgatctgaaatatcaacaaaattacagactagaaatcaactagacttcaacaaccacataaaggaaaacagaaactcctgatatatccctttaaaaaaaaaaaagctcttccaaagtattcttggtattaaatctcatgcaatagctagctctatccacctcagcaatccttcctcattaactgctacacccagtttatacttttcataccagcctagctagctggcctagtggcctgcaacactccatttgccatccccagcctttatcaagaattgttccacttgtaaattacctgtctctttttatccacaaaataacatctctgtttaaaaatctatttaagacttactgcaaaaatgatttctagattaatccagtacatttgcaaacttgccaacaaatttacacttctgctttaatatacttttataatccatctatattttccagttgattacattaatctgactttactaaaatctctgaggataaagtctgagtcaattcttctttacataatctccaactttccaccatatcactatctatctgtaagacgctatcagccgttaaacactacaggcacatcagctgctgtctcccaatagtgaggctgatggtcagccattttgggaaaagaaccataggtggattattactataatgcattatgtggaagaggtgtttattttgctcctggaagaaaaaaagcaacatgtattaaaatcataaaaatgtttttaggttgggcgtggtggctcacgcctgtaatcccagcactttttgggaggtcaaggcaggcggattgcttgagaccaggagttcaagaccagcctgggcagcacagtgaaaagaaactttgtctctactaaaattacaaaaattagccaggcttggtggcacaccaagctattctggaggctgaggcaggagaattgcttgaacccaggaggtggagggggcagtgagccgagatggcaccactgcactccagcctgggtgacagcaagacactgtctcaagaaaaaacagttttaaaaggtaaaacaacataaaaagaaatattctatagtggaaataagagagtcaaatgaggctgagaactttacaaagggatcttacagacatgtcgccaatatcactgcatgagcctaagtataagaacaacctttggggagaaaccatcatttgacagtgaggtacaattccaagtcaggtagtgaaatgggtggaattaaactcaaattaatcctgccagctgaaacgcaagagacactgtcagagagttaaaaagtgagttctatccatgaggtgattccacagtcttctcaagtcaacacatctgtgaactcacagaccaagttcttaaaccactgttcaaactctgctacacatcagaatcacctggagagctttacaaactcccattgccgaggtcacatcccatactaataaaatcagaggctgggcggtggctcacgcctgtaatcctagcactttgggaggccgaggcaggcggatgacctgaggtcgggagttcaagaccagcctggccaacatggtgaaaccccgtctatactaaaaatacaaaaaattagccgggtgcagtggccagcgcctgtaatcccagctactctggaggctgaggccagagaattgcttgaacttgggaggcggaggttgcggcgagcagagatcatgccactgcactccaacctgggctacacagcgagactttgtctcaaaaaaaaaaagaaaaaaaaaatgtctggggtggaagccaggccatctgtagctcttaaagatccccaggagattctaatgtgcatcagagttttagaaccactgtcctagactctgtcagtacaagattttgctcaatgaggaaaaagcacgataacttacatttaagttggtgacaggtaaaagcaaaggttacctctgaaacttttaagtaggaaatcactgctttggctgcaacaagaagtttgtgctctgattctcataattggtgtagcatacagtctttaaacagccctaaatgaacttgcggctttgcgatttagactaggagagagaaactaggcatggtggtagatatgagcccagataacaactgaattgttgcccattgtgccgtcgagatatttggcttgagagcctacagcctggatgcaagtcctaggtcagtcatctgctggctgtagagctacaggcaactctccaacaacataaccctggtattccatctgaggcagtggttcccagccctggctgcatattagcaaacctgggtctgggacgcaatccccgacattctgactgatccagaatggggccccaagatccttatatttctaaagttccccaggtgtggttatgtcatatgagtgaggagaaccacaggcagagaggttttgagaaaggatgctgaggccatactacgtgggttcaaatccctgctccactagttactagctatggctcagtttccttatttgtaaaaacggagataactgataacacctcctttgttgtgaggcttgactgactgaatccatttattgatctcagtggattattgtacggatttggcataacacctggtacatagcaaatgttcaattttaatcacatgcatcatacctatacatgtgtacatgtgaatatgtcctaaggattaaacagtttgatgcatataaagggcttagcactgtctccatatagaaaatactcagtaaatataagctgagctgatgctgacagtactggtcgtaggacaacttattgcaactgactgtcttctgtctggaatttcatcctttcctcactgcatggcagcctttgcttcagaaaaccacaactttaaaaggtatggggataagaataaatcattttttctctttcttttaattattaagaggtcccactaacaatgaacggtacttctactgcaaagttatgatgggaatgtgggcttaatggcaaagaaaagcgatgtggagacctggctctgcccccacatgatgataaatagcagaacttgacagccagaggaaactcagccccctcatttcctaggggaacccagagttgaaatgtgttttgctcaagatcacagtgtgagtggcagaactgggatcagacttaggaacagagctctttagtttccaggttgcttccattgatcatccctggtgagaagcatgcctgagaggtgcattatcatgtggaagatgctgtccttgtggtcaaggccaatgtgggggatgaggaatgtggtaccctgtttcccaattgcttccttcctctctctgccgaattcccttccctggtccaaattccacaccctgcaggccatttccagctgaaagggaggacacagagcactagaaagcagctgtggtttgtttgtggccaaactgttttcttaggggtgttcagttccaattttataacagaagacaattatgaaaagggtttaatttcccaaattttcattacatacaactgtttagagataggcatatataaatggatatgtgcatactttttatctatcaaggacaggaaatcctgtctttcagttgctaagtctcagactattccatctgagtatttttgctgacaaatgtgaccttgtctaggttctgcgggaatttaaaaattccctcaatgtcatttctacttgaccttagcaacatgaccaaactgcaaattcaaatgccattgagtaaaggtacaacattcacatcctgttaccaaagcgttctccaactccaatccagtgaccctgggccagagcctaatccaaaagattacaaagcaactttctgatgagttgtcatggcaacccctagatgttagatatttcatgtcatccctgggctgcaaattctcatttttagtctactcatatcctactatttcatgtataacaaccaaccaaaatgcaatttgaaatgtcagctgccaaacataataagagatgccacttgctattatagccaataataaaagatttctagttgcttgtttcagagatacagcaaatcactgtgtattctaagtccactgggctggtcctcaaagtgaggctatttagctagacttccttagtttttatttaattagtcaatatttaagagagccttggagataaaaagaattctagtgaaacctaggcattattattttccaaacaggaggaaatgtactgatcttcagactttcaatagacatgatatatttggtctgagagagagagacagagagagagagagagagagagagagagaagcccaaccgttatctaaaccttttaaggacacaattatacaagagtgccttgcaaggttttcaactctttataactggaagagaggaaaacacttattactgaaatccagataatcaaaacactttgttttaatcagcagtttctacccttttcacattctatatcaattcacaaggagtgaccttcatcttaggtataatggggtcaaaacctacctctgcaggtgtttctcccttacctgccttaatctgtggcccaggttaagcacacctgcaggcaggctcaacccaagatagccaggagttctattatgagtagactgatgtagaaagatctctcttgaaattccctttagctgacaaagcattgaaatcacctctgcaaatagctggaattgtgtatttatttttcttttctctgtttaaaatttagcagaaatgttaataagaaaagaaatgtccagtagatgaacaacaggcccagaaggaaagagaaatgaagaccaagataatacacaaaccagattatcaatcttgaaataatccagaagtagacatatgatagatcatactatgtgagtttttctaatcctaaacacaaagggaatataaagaggtgtgcagtagggctgcatgtcaaccactttaaactaatgctagccaatacctgtgtagagctgcaaactatttttctgctagaattttaagagaacttttaagttttgaaaattgattcccatgacacttctctttccgtcttcataatagctgccaaaaagttcaaaaccacatttatggcctgtctctaagaagtccttaaatggtctttcttgacatcttttattaattcctagcctcattttctcacttttttgttgtctgctttagtggggagtatctctgaggccaaattaaaactttttacaataatacaggtgtattattcaacagatagccttcattaagcctcaaatatttatgggggcttctcttccagaccatccctctttgatccatgaggcaggagatatcatgtttcaacaagaatttgtttcagttcacagagaagctgaagcaacatcaatttctcatacttgtttcaatcacatttggaattgataagctaaaatagagaagagtgctatgctaggaagctgggatcatgaggaggtgagaagccaccttttttttatttgggagcttgcactcatgactttggccagaccccagaagacacataagttccctgtggtaaagtatttattggactatcacccaatcctttcttctacatgagaatatcactttggcagatgtacaccaaagccttctctgggtataagtcttcagcctgccttggatggatcttgtctgcttccgtctgcctgtgcacacaggctgccagccccactccaccctccagtaaaacctacttgactatgtatagtgctggcttagaatgacacagatttaggttcaagttttgcatcctttaatggctatatgaccctggacaaggtatcaaactctatgagtctcaggtacctcgcctgacaattgggaataataaagagtcccttttggggtttatgtgaggattacattaatgctcatagggtcctcgacaaaatgcctggcacaccaaagtcaatgctcaataaatatcagcgattggtattacaattatgttattataattctttgaggaactgctggtggccagtgtaaatcctatggtctttatctctcctgaccccatccacaggctcatgtgacaattttcccaggatcatttcaattttctgcgatcagagagaatgccagccacggccctatggaccagggacaagatagcacacctgagcagaaagaaagaggaccactagccttgggatagaattatccctcacttcaccctcactgtcggcatgttcagagactaagtgcttatagaaccagactcagggttttcctgttagtctgaagagtgcttcatctcttctaggctttcactggcagagccacaggatgagaacactctcggccccttatcaccacccacatcagcaacactgaggccagcatcagggtcttctgggctgtgcggattggggagccgatgatgtagttaagtttcctggaaatacaggcagcaatttcctgtggcttcctctgtttttgatgtagagatgagcacaggtaaaaactaaacacatcaaggatcagcgcttcagtcggtggtgcaagtgcggaaaaatactgtcatttcctcacaaacagattcagaagtgcaaagtataagccactttccagagagcatgctccccagcaaggacctgtacagtagggctgtgagttgacagtgaatagatgggcattcccatgaacttacttgcttacccaagtgatcaagaaccagaatttccatgaaggtcaatgttttgtataaaccttagcctgaaaaagctctggtctgctcacagagcttcagtcaagccttctccagaatttgcagccaggtcagaaaaaaaggtcactttcagaagtggaaagcagtacaaattttagttaaaattttagatgaactaaactgtttatacaactatcctaaaagatagtttagaattaaataaaacaatgtgcactacatttgggaaacagccaggttcaaagaaggtggtcacagtgtattcttagaaccagaatggaataaagaaaatgatacatgttatggttatgatagcataacctgctgatgaaagaacagcagcagcaggatgtacagtttgcaaagggtccactcaaatcagagtgaacccagatggtgctagaggcagcctagggccaaatcccacctttggcactcactagctgggtgaccttgggcaagtcatttaaacttccatttcttcatgtgattttgtttctccatcattggctccccttcctttgtgaaaagttgcccctccccataccaactggggcacccatcatcatagtcagcaacctgacctaaagatagctcaggtataagacatggtaaaatcttttttgctttagtccgttgcttgtaaccaaaaaaccaagaccttttttcggctgcaagcaaaagagatttaacacctaatttgcagaagttgctaggagcattaaacgaagtcacacaaagcaaacacaagaaatgctggttgcattcatagaaaggaagattagtgtgtggttaaaagcaaaggtattgagtccatctgcatgggttcaaattccagcaccccttagaacagagataaatcacttaacatctttgctctcggtttcccagtctgtaaaaacagagctaataatagtaattacatcacagggttgtgaagattatgtcaaagtagataaagcatttagaacagtgcccaacacagtaaacattcaagaattagccattattattacaaaggtagaactgttttgattactgttaaggatgttgtaaaagtcagtgatctatagagaaatgcccttcaactaaaaaagccagggattgtggcacaagcctgtagttcccagctacctgggaggtggaggcaaagaggatcctttcagccaaggagtttgagcctgggcgatatagtgagaccctgtctctaaaaaatttttttaaatttaaaaacatttttaaataggaaaagaaaataatccttcttctgggtaatccagcttgatggacaatcccttagagacaattagaaaggatgcatttactcagaatttagtaagttctaatattgggcctcctgaatgaacttactgaccagcaggatgtggcctgagcaaatgacccatgtcagttgtgctgcctggccttcctcttttcattgtcaagaatacatgagcatatcaattatgaattaatctctcataaatttaactataagtcaattcttgcaagtcacatctctcaaaaagaactaataaaactgattttggtcctgtggctattcaccagggctatgcccttatgggggccacccagcaaccaaccagcctcactcttgctgaaatctgttaattgcagctcaagcctgttttactaactaaatgcagtgtctccttcaccactgcttcctgtgtgatatcactaactcattccttcattcatttattcaatcatataagaaacatttattgagcaccacctaggtgccaggtgctgggctcagtatttgttaagcaaaagcaagcaataaacagtgctcaaaatgctttttagagtttagtgaggaaggcacgtcaactaacgattagaaacagtatgctaggccagagacaaacctgagccatgagggacctcaggcctgcatggtgggacccagaaagagttcacacaattagcacaaagcacttgggaagcgaacagtttacccagggcacagaaagagtagactggaaagatacataggtctgagacattctgggatttagacaccttgcaaaggaagagaagtcttcggaagattttaagcaaagtcatgccatgatgtttagttttgcctttagaaagaacatttggttggcagtatggaagatgaaccaaggggctggccatatgtgcaaagcaggaggcaggtaaagagtttcctgtgtttgtccagaagagaaatggtaaagcctgaacacagggcaatagatgagggagcaaaaaagagagtctctgggatttcaggatatgaaaccacctgattccatgaagctatcttactttagctcactgtatagaaaactgtgcctgtcactgttcagctacttcttgaaagaactgagactacaaattaaaattgaaaactacatgcacttatactatgtccatgattccactgtgaaattgtacaaacccattctccaggactcaggaaggccaatgttcttattttttttttgagagagtctctctctgtcgcccaggctggagtgcagtggcgcaatctcagctcactgcaacctccacctcccaggttcaagcgattctcctgcctcagcctcccaagtagctgggactacaggcgcctgccaccacgcccggctaatttttcgtatttttagtagagatggggtttcactgtgttagccaggatggtctcgatctcctgacctcacgatccatccacctcggcctcccaaagtgctgggattacaggcgtgagccactgcgcccagcccagtgctcttgttttagaaatctgggagagcttgaaagtacagaggaagggcccttaagttaaatagtcatccctcctcaacaaacaattaaatgttattatgaccaaccatatctaacaggttcagagacatcctagcctgtctgtcaactttgtaggctaaatgaaagttccaggttgtcagacccagtgtagttttatttcctcagtatctatttcctgccactttactttacaaaatgtttccctttgaatgtaaccagagaattccatgaaccctgccataatgttaatactcacggtgaatgcacacttatatcactagaatatctgaccacatctgtttgttttgtgacatgacaggccttgagactggtgaaaaatttaccaaaccaatagtttactttctcttaaatgtaaaatgcaatggaatctcttctgtacctctggaaacactgtagtcagcttttctgaatgaacctgctgggaaatgtcaagatctctaaataaataagttgtgactttcattgtatttgcagcacacaacctctgacaaggaagaaaggccacaaggggatgttgatcaaatccaggtcagaactccatcaaggtggacagacactcaacgccctggtagataacaaagacaacggtggacgagcaataaagaaatctaacaaggtctcaaaggaacagcaaatgaatttcaattttaaaaggacatgggtcattctagaaatcaatgtgtgtgcaatccaacagttccatatataaataccagaaaatatttatgaagcaagattaatctcgttttagaaattattactaacctggctttattactggtttaaactaaatttataaaacaataggcttgtcccttagccaaatacattcatgtctaagaatgaagtcatactctatacgaagctaaagagaattttataatagtctcataaccccattagggggaaaaatgtatctgttctctcttatcgatcgatcgatcatctatctatgttgggaaagcaaatttaatgaactccctgaaactcttagagaaaaattatgggaagacacacactggctagacatatttcgatagtggttaccatagaaacaagtcattagatttcatttttggagttgtggcttttgataaaatattaaatttcttagagtatttgcatatacagatagcgcaactgctgatgtgcaattgaattatatgctgtaaaaaatatttacactacttctacttttagattactaatatctacaaagaaaaaaactcactcctaataagaatgaatttaaaaactcttcctctaccttgccattgtttcctactgggaaaaagctaaagtgagggtggtgaaggcataaaacaggctgggacacaagacagggatctaaggaaaccagcttggtcttgcttgagagaaactcctgatggctttccaaccacagctgctaatattctgcaggccacctaactgaacagcaactctggtaatttgtttttaatcagactaattcttcaatctcattttcctgtgacaagatggctgtttctcacggtgtaagaaatgatgatgtgcttccttcttgggggagtgagttgtgatactgccttgtgtggagctcatctagtgtctcctttcatttatatttcataacctccctgctgtgagcccaagaacctgaagagcacacctcacttcctattttgaaaattaagaaaaagtatacattttaacacagagtcaaaattgcaaagttaaacgaccactaactcaaatactgattttaaggcaggagcagcagcaggttagctgctgcactgaattttactgactgaaagccactagggtgtttgccaatcaatgctaaaatgatacttgaattaaaatcaatacacaaccccatatgtatgtggtgtgccaggaacagcctaagagttgctcgacctaggatctaagatgtccacgagccacaaacctggtaatctttgaaattagggttggcggatttagttttctgtcagctgggaatgtcctggcattaaaccaaggacctcaatccccttaaaacaatgaattcagcaacaatcttgacttcccagacataagaagtaaatcacattaacagctgagaagaggctatgaactttctgtttgaaggtcaactagaaaacaagcgaaagatcagctgaaaatgtcatgggtgaacctgagccaggtgctggctctaaaattacagcaaggtccccatgaaacattaaaagaacatagccaccctgtaaggtgttataggaggattctcttttcactttaaaaattatttatgtatgcatgtacatgctttaataatctctggcaatatgcacatatttatgtatatagccatacatgactaagatataaatctcgtctatatgactaagagatggaccttatctttatatgactaagagattatgttatctctgaagggatcaaaggtcacgtttgtttttctgttttccccaagctcagcactgacatgcatgatctccatagtaagggggggggaatacacacacacacacacacacacacacacacacacacacacacacacgctgactattcacatacagaaatatatatttgctattaaaaaaattaaaaccacatacaagaattagccaaacagtaggaaaaacgaacacatgaatcaaccccagaaccaccactattttagacttgccaagtaaaataaagatctaaaaattcatcttatagaaaaagaaatctgagaactacttctatattgttacagaaaatacaaaaacagatatattttattatttgaattaagcattaaaaaaattcatcttacaagtaacaggtatatcctaatctttaaaagttctatttgtactagtcatctactaggtcaaaaaaagtttaatacaaaacatttggaagtaaatgaaaaaatactgcatttttccaatactatcttttttaatgaaatatcaaaaagtttaacacatgttaatccttttgaaaacctattttgcctcctaagaaatgcaaaataacttataaagtaattctaacatcagtgaagaatgctactatgtttcaagtaaactgtctcaaaaattttaacttaaatatgaattttaatataatttatgtgaaaatgaaaaatacttgaaaatactttgctttggtctaggattaaattcatgatgtatttcattaaatatcctgctattgtctgctttacgatattaagaaaacaagcataacgaaaaataatggttatctcctcagccccactataatgggaattcttcctcataagaactacaaagcaaataagaggagatgtacttcaaaatcttaaatattcatcacaaaataagaaggcaaatggactttaaaaatgatgacccacgtaaaatcaacatttaatcctcaacatgtagactgtctgctttgtggctttcttagagtgaaccttagctttaccctcctagggaccaaattcctatctcttgcattacaaacatctgcaggccacaagacagcaaccaaaggttaatactgcctccagccaaacattattaagaagctaaatctgctaacttccattaaatataatactaaatataatattatttccaaagccaacagatattacttttgaaccctatcacttgtcaatatgaggctagaaattaagagttgactaaaagtatagaaaaaattagccaggcgtggtggcgtgcgcctgtagtctccagctacttgggaggctgaggcaggagaatcgcttgaacttgggaggcagaggttgcagtgagccgagatcgccccactgcactccagcctgggtgacagagcgagactccaactcaaaaaaaaaaaaaaaagagttgactaaaattatagttatatggtttccagataatatataataatatatatgtataataataatgtgataatgtatcacttaatagattgaaaatgatgagatgatacttctcaatggcagacactagcctgtagggtggtggtattcaccacagctaaaatcaaccgctcacttaaatagcacctggactgggaccaaatcctccaaatggctccccctcccacctactcaacagggggcaggctgggacagagagtcacgtgtgttcacattagcctgatagaggatcagaatggagtcagactgcaagggtaggaatttcctctcttccagtgctctcatttcctcatctacaaaatgggaactgctgtaaggattaaaaaatacatagaaataaaacatttagcacaatggccacaagcccacattttcaccctgtctgttgtcaaaagcaaggtaggagacaactaatgctagggtaggtggaaaagagggacagggtgtggctagggagagggacacctgccagtcacatggtgggcatctctgctcacaatctgaaatgtatgccacaggaagttgccaaactgcttatttttttaactgcccgttactaaaggttgatgagataacacataagataaatgaaaaaaaaattaaaaaacaactagagaaataaggtggggaatattatatgaaagacattatacaaggcttttgttttgttttgtcttggagtattgtttttttatttctaagctacaatctatcctgattttctttttttttttttattagtagactattttttagagcagttttaggtttatagaaaaactaagccaaaagttccctcttccccgtttcccctgttattaaccatcttgcacaagtatggtacatctgttataattaatgagccaatgatgatataggattaactagtcataacagtcaatatagtttacataagagttcactctttatgttacacagttgtatgggttttgacacacctatctatccaccattacaatatcatacagaatagtgtcacagcccttaaaatccactgtgctccacctgttcatcctgtcccctcttccctgaactagcaaccactgatctttttactgtctctatggttttgacttttgccttttctatagtttaaatcgtacagtatgtagcctttccagactggcttctttcacttagcaatatgcatttaaggttcctttgtgtctttctgtggcttcattgctcatttctttttagtgctgaataatattccattatctggatgtaccacagtttatcaattcatctaatgaaggatcccttagttgcttccagtttttgacagttataaataaagctgctatcaagattcgcatgcaggttgttctgcagacataaattttcaactcatttgggtaaacatctagatgcgtagttgctgaattgtacgttaagcctatcttgagctttataagaagctgccaaactttcaaagcagttgtaccaatctatcattttcaatatctaaaaatccatctaccaaagtgtaacttaatatctacacaatgtgaccagtgcattatttatgatctacctaagtgaaggacagttaactttcaggttctaactaaacttgaaagataatgtgatcaaaaaattcaggagttgttgactttgggctgttgactttgggcaaattatctgatttctttttttttttgaggcggagtttagctcttgttgcccagactggagtgcaatggcgtgatcttggctcactgcaacctccgcctcccgagttcaagcgattctcctgtctcagcctcccgagtcgcttggattacagggatacaccaccatgcccggctaatttttttttttttttttttttttttttagtagagacaaggtttctccatgttggtcaggctggtcttgaactcccaacttcaggtgctccgcccgcctcagcctcccaaaatgctgggattacaggcgtgagccaatgtgcccggcccaaattatctgatttccacagcctcaaaaaaatgtattaataactagtcgcaaggatcgtctttaaaaatcctttacagtcattaaaggttatgcaattcttaagaaggtgactatgatctttgtgatgccaataactccattttacttttaagcaaatttgttttagtatcattttcaatgaaacctcaacaaactgtagttcagactttggagaaaatgcttaataatcatgacagtgaagaccacttgggactgttaggctggtttttgttgctgttgctgtttttgttattgttttgcctttagatcacaaaagttttgtcctggtggcagaaggaaacatcagttttccattggaacattctctgactagcattatggtctttacataacgttcattccttatttccacaccctccctaatattacagagtaattactgaatctctttttcctatgaattttaaagtttgacaccactggccaaaaattctatgaatttggcaaaaatgatgatggatccaaaaaagctagcatccttttctcagcatttaaatagtttttttcctcatgaacaggtctactacctgaacagttccccatctcaccccaccatccctgtgggaagaaaaccattagaaggcatctacctttatgtagtaaaatttcattgattggaatagctcaattgaggagcaataaacctcagtcataggacattcattttttattttttatttttgggagacagagtctcgctctgttgcccaggctggagtgcagtggcatgatctcagctcactgcaacctccatctcctgggttcaaatgattctcatgcctcagcctcctgagtagctgggataacaggcatgtgccaccacacccggctaatttttgcaattttagtagggacagggtttcaccatgttggccaggctgatcttgaactcctgacctcaagcaatccgcctgcctgggcctcccaaagtgctgggattacaggcatgagccactgcacccggttatttataggacatttaaaaagaaatactgtcttcccaatttcatgtaatacagtaatagctaacatttactaaatacttactatgtaccagatggtattcaagggcttcgcatacatgttttcaattagccatcaaaataaccccttgaggtaattactattactgcttccattttacagattcaaacactgaagctcagtgaagtcaagcagaaactctgctgtgatctctccagaatctggtctagaatccttggataatggctgggcccaacattctcatggacagacactgctgcctacttggatggattagtatcagctgcttctggggtctccatttgggtatattgctcacctgacagcaaccaccccctccccccttcacacgcgcacacatgcgcacacacgcacacaaatactcgtgtacatgtgctctgtgctgtgcctcacacttgctgcctgtgctatggggaccactggctggtatcatatctgacacatcccatgtttacctactgcacttgactcctccctaaaagctgcttctattgccccctctgagccatcatcaccctcatgggcctttctagctccaagtgatcttccttaagctgctgaaattaaccaaacaagaaccgtgaaggattaacaatacctaatataaattatgctttaaaaataggctttagccaggtgtggtggctcacgcctgtaatcccagcactttgggaggccaaggtgggcagatcacctgaggtcaggagttcgagaccagcttggccaacatggtgaaaccctgtctctactaaaaacacacaaaaaattagccgggtgtggtggcaggtgcctgtaatcccagctacttgggaggctgaagtgggagaatatcgcttgaacctgggaggcagaggttacagtcagctgagatcatgccactgcaatcctgcctgggtgacagagtgagattctgtcttaaaaaaaaaaaaaggctttagtactttttaagtaaactgatgaaaattatttaagcattgcaaactcttccttaaaatacaattcatttttaaaagtaagtggacatttcaaccaggctcagtggctcacacttgtaatcacagtacttttggaggccaaggcaggaggatcacttgaggccaggagttcaagaccagtcagggcaacatagagagactctgtttctaacaagaaaatttaaaaaaattatccaggtgttgtggtgcgtgcctgtagtcccagctactccagaggctgaggtagccagtgaactgtgacggtggcactgcactccggcctggttgacagaacgagatcccatctctgaagaattttttaaatttaaaaacaaaagagtaagcagacatttctaaactggctaaaagcaatttcttaagtaggtaaacatagcctttatatgttcatttacatcattcagtagtttagttagctctgttcctgctaagatgaacttcaagaactagctatgaggtgatcagaaataatctgaatttgaaacaagagaagtctgaatttgaaacaagagaagtctgaatttaaagatttttcatatttggattaaaatatttgtaacagggtggaaacagaaaaaattggacaaaaatctatgaaaacttgctctccaggaattttctccaaaggtctcctggcccagaccctcattccatgacaggaggctggcagtgccagaggaatgcagcacaaaggggtggaaaggatgtcagcaagagaagctatcaagggaggaggagtgggacgtggcagaagttaagttggactgataacgtggcaagctgggtctgagtgactactgctggaacacaatgaacagtgggtccttcactcaacccagattggtgagagccaggagccactaagtcaaaattaacctaaatgcacataaactctaggattccaattttattctgtttttctgtgcctctactacactcccttgacctttaaataatcttcacaaaacagttataaagcagagttgattactgtacttttataagtataatgtgtaaaatggagacatcaacttctgaaagttataaaacatcaattttaaatacaatttttccacttttattcttactgttgtctactgaaaacaatattctccaactaatcagaaaacctcaggctcatccttcaatttctgctcaaaactctttaagataggtttcaacagatttccatacaaaagaaaaatgcgttacattcctccctattgatgtctaatgtagtacagtgtattaagatacatacattcacccgaaacaaaataacatgttctcttagtacaaactggcaaaaaaaaatcatttaccttgtttattgtttgtagaattacccccaattcaagaaaaatgagtacatataaaaattaggatttataaaatatgaattagataatataaatgaatttattttaaggtgatttgaagcaaaaggtcaccaagtatattacaatacaatctgatttacaaaatcatatttcaaaacaaattttctaggaacacagatactccataaagcagggtaccttggctaaaacaccaatgtctcacttacatagaatttgataaggaaaatgaaactttacactaaaattgttaggtagagcatgtggaagtattcaaaagaaacctgacgttaaagtcctatgaaaattttcttaaaatatgcatgaaaaacatacttgtaaatttacgatacttgttacgaatcaagtttttgatattacaaatgtgaaaaaaaaaccttcaaatgtcaggttaccgtttttactgtttaatgaaaaagacaaagctaaagaccacatataaattattgacctgcatactaactaccactataacgagaacatgactgcagtttacaaggatgaagctctttatattctcatttggagaggactgttgtagtacatttgacatgtaatatatttaaacaagtatcaatttctttcttcttcttcttttttttttttttgtagagatggtgtcttacccaggctggagtgcagtggtcatcatagctcattgcaatctctaactcctgggctcaagtgatcctcctgtttcaacctccttagtagctgggactacaggcatgcaccaccatgtacagttatttttttttttgagatggggtcttgctatgttgcccaggctggtcttgaactcctggcctcaagcaatcctcccacctcaatctcccaaagtgctggaattgcaggtgtgagccactgtaccaagtcacaagtatcattttcctaagggctaccaaacagcaatattagtaccattactgccttatttaaggtaattaaaatcaactttttctaaacttagaggaattcttcactcccctaaagtatagcctctacctacttttttagtctaatttcttcttattcaccatcatccaccctatgcttcagttaaaaagggttaatagctatccctggaatgtcttcccatctccatgcctttacccaagtggttcccatgcctagaatttcctccctcatagcttcagctgtcaaagttgaacccattcttcaagtagcacttcggtctctgctttatccaggatgctctctgatgtccctaatcagacagcatttcttaatcttcatccctacagcattctgtatctttcttggagattaattttactctcttatatgttatactcatcacattcaagtgtcttctagcttagagtatatcataggtgctcaacaaatgtttgttacatgaatgaatacatatgctccttgagagaaaggcactaattttattcctcattgtgtctctttgctatctccccaaggtgagacctctgcaaagccaggcaacaacccgtccacatgtactcagcacctagaacagcacatcatagtgcactgtcaacaatctacagatgtttgtgaaatcaaccaattaactaatctgctgtcgttttttcagtacttaacactcctgacagaattgcacattcttagaattggatatttatatttttcatttaataaaaaatatttttaaattattattcaataactcttccttgagtgtgtcctgcttgctaggaagtggatattacatacagcagacaaaatagccgtgatccctaatgggctcatagactaatgggagagaaaactattaaagaaacaaatgtatggccaaatatgaaattaaaattctaataagggctgggaaagaaaggagaaagcaaagtatggacaactgggtggtgctcattaagggtggagatcagggaaggcttctcagaggatgtgatgttaaaatgcaagtgaaggatgaacgagagttagaaaaatgaaaagtgggaggtggggtgggcatttcagggagaaaagcagcctcaggaagagcctggtgcacctggtcacagtggtggtatggggtcaatgaagggaaaatggctgcatgaggccagagagcctggctggggccaggtcagcagactcccaccaactccggggaggaggctggattcttagtgcaacaggaagccatggcagggcagatgaagaataaatgaactggctgcttcactactaccctgtcccaagggcccagaccatgaaacggtcttttatttggtttcaaatccaaataaaaacctatgtaggtatagaatcaaaagaaggagttaaaaatttgggaaggttttatacattttcctgttaacagaaaatttaaatataaaaatattttattatctcagagaggcaacagagatttatgctctttgattcagagataaactttgtcttgtagaatgggaaaaaatgactaggtaagatgattttcctttatcacttttcagaagacaagtcataatggaaatgactcaagataccacaatttggaagatgagtgactgtctttgccatgggagcagagtgagggtttgctaaacatcagctgaaaggagagatgtgctcttgctcttagttacagacaggcactgtatgtgatgtggccccataaaaatcctggcagatgatgtagcttcctgtcatcttcctcccataactgcaaagtccaggagacagagtcccctttccttggtagaaggaagtaaactttggcataagacacattttgtgccaactacctaacagcaatgtttaaataaaaataaaatgctattggagcatttcaatacatatcataaaaacaggccaggcgcagtggctcatgcctgtaatgccagcactttgggaggccaaagtgggcaaatcactcgagtccaggagttcgagaccagcctgagcaacatggtgagactcccatctctactacaaacacaaaaattagcagggtgtggtggtgcgtgcctatagtctcaactactcgagaggctgacgtgggggaatcacctgagcccagggagctgctgaggctgccacgaaccatgattgcgctactgcactctagcctggttgacagagtgagaccctgaaaaacaaaatgaaacaaaacctaagattgaacaacaaaaagcaacactaagcattttatccagaagcaagaaaaccctaccaagaatttgtatttgttcatcagaatagataacccaaatgaatactccacagaacaagactgccgtttatttaataggtggtaggtttttaaatgggagataggttatttcttcctttctccccacccacagagttttggccacttccagaccatgttcagctgacattcttttcaaagactcaaaaaaaggtaatgcactctcagtggaaaggtagtgttccaccagttttggtaaatactgatctaggcctgaacttttgatttctgaatgaaagaacaagatgattcatatatgccttaaggaaaaagtaagtctggtgaccagatctgaatgaaagcaaaaaggcttgaatttaaaaagcgaatcctgtttaaattttgggcaaatcatctaacatatcctctttccttttgcaatctacactaagaatactatttttttttccagtttaagaaaagttgacctaccaaagccagaactgctaaataattacaaaacagttgttttagaaatcacttcaccctccgaaaggagtcaactttccatgtatacttaaaatcactcataaaaatggatttaccatttaagaaataattttcaaacacacatgtagtttgtcaaatgaagcctcactgttcattcattcattcattcattcattcgacagatattgattgagccctgttatgggccagatgctgattgtggcacttgtgatacagcagtgaacagaagagtctaaactccctgccccaatggtgcttgcattcctgtgttacgtccacacagctgtgtaactgactctgaagaaaaatgagcttttaaaacataataaacatttcagttttgccagatgaaaaattctaaagatttgttacactacaatgtaaatatagctaatattactgagttatatactcaaaaatggttaagagaataaatgtgttcatttaaccaaaaatttttttaaatgaaaaaaataagcataacaaacatttactgagtacttaccatgttaggcagagcatcatctcatttaatcacaacaaccttagcaggaaggcactattattattctgttttacagatgggtacactgaggcacaaagaggttaaacaatttatccaggatcacatatccaagggatagagctgagatataggcccaagtaatctgataccagcaacttgtctcctaactccatacaaaaagtttcaaagataatactattttcagttggaactacagttaataatacaaaaatagtaataataatatagtacaaggaataataatcaactttttttttttaatcctgatgatttgtaacccaacttactgtccttttgatggccattttttcctaaaaacctcagtgttgaacaaactgctttcaaccacttctctgtaagccataatattcttttccttcaaatggaaataaagaaaaatcacacaggatggtttcttttagacaagatcaggcacgttcagggtggtgtggccatagacgcggatggtttcttttaaaacagacattactgaaactgtaaatatttttagccttttgtacttttcatccagcagcttaactgagaatgatatagaaacatttaaaaatagccactcagtactctgaaaaccattagtttagcacatacccagcacctgcttgacacatcttaatcaacactcttttgctagtcatattaaaaaaagagagaacccttttgctttcagaattttttcccttaaaaaacgtatgtgtcaccagggtattttgccctctctctttctaacttagagggtaacacctggagtaagtcatgggtgactaatgaagatgcaactttcccctcagcatgatatacttcacaggatggaagtaaaagcttctaataggagcatttattacaattgttaggattgtaatggaaagttaattttgttttatagtttgtagaaatgattcaggatgatatgagaacactttctataaacctgcactgataaaaggaagatgatagtgatgacacatgatatactttctgagttgtttttccaggggtgggaaagttcaatccacagatttcaagacagaaagaagaaaggaaaggagaaggaaggaagaaagaaaacaaaattttttttagaattgactatgctcaaatacactgtgctttttagcatcaaactttcaaccatggtctgagcagcactatgttgtaacaaaactggagtagccagcctgagcaaacatgaacatcacaatattttaaagttcaaataacataaggcaccagttttaagactgcccgggtatcctttttagcaatacaaagattcacacaacttggtgacagacagcttttccctccagccaaatctgatgaagacttgataatatcacctgccataatcaaaattcctgggcacatgggaaggtctctgactcaaatcaaagagagctttgggccccaaagctatgggccccacagctatgggctaccaaagaaaggttataaccaggctccagtgtaaaccattttgtttcttttaacagttttagatcttctaaagtatatgagatgatattaataaaatttaaatttcctgctaaatttttttagtctctttccttaaaagtaaaacttacaatgatcagaaagcatgctttcttctggctttatcattcaacttcccaggcaaagatgatcaacagcaacactcttatctaaagcaaaagtaatggatatgattatcactctggacagaaagtctgtatttgcccatttttatcaatgattgagacaatgatccagaagctgtattggtacaaaaacacaacaccagggatgccagaaacaggattacaaaagttctcacaaggttaaaaatagaccaaaatgaatatagtcaagtttactaggctcaaatgtgaggtcctgtatggtcagtacatggaggtccagcagcctcttgattcaatacaggcagtgtgatgggtttgcaaaaatgtactcttaggctgcattaataaagacactgttctcaaggccagataagccacagtccctctcaaactgctcagaaagagtagctttagggccaggtgcagtggctcacgcctataatcccagcactttgggaggccaaagcaggcggaccacttgaggtaaggagttcaagaccagcttgggtaacatggcaaaactcgtctctacaagacatacacaaattagctaggcatggtggtatgcaactgtagacccagctacttgggaggctgaggcaggagaattgcttgagcctgggaggtgaagggtgcagtgagccaagattgcgccattgtactccaacctggatgacaggagtgaaatcttgcctcaaaaaaaaaagggaggtacttctataatttgtccactaccttttaaggaactttctgataaactggagaaagcaaaaaggagtgagatcagaatgactgtggaactaatattatgagaaatattgaggggaactgggcatagataactttgaaaaagactttattatggcagatttgccaagtaaactgataattagaattattttcgatatagaaattaggataccttagaagaggtatctgcatttgatgggtgttaaacttcaggatgtttaaggtcttgctcaactctaccaatctgtaattacatggggaaaagtgctatgtccctcatgaaattaaatactaagaactggagggaggctgcatcaacagattttctgtatcatgtattgaagagttaattttctccaaccaagctagtgaatgaaagggtaactcaagatgaaataatgatgtcaaagcatttttaatatacctcgtggaagaatccaagtgtattttaaagagaaaacacagcacttgttacaccatatatttcatatttgacctgaagttggttacacagaggccttagtcataataaaaaacttctctctgctcaaatgcagtatgtacatagtcataaatgaaaacatcattgccgaactattttttttaaactatcatggcacaaattgcttttaacaaagaagtcatattccaaaagaccttttgtacacaattgtgcagtgtatctttgtcttactgtttagtatcctaaaagaaatagttttcaaaatatctacattcatttataaaaacttgaatgcaggtaatttagcaacaaatcacaactagctgagaactgacataaaagaatgatctccagggccagaaataaaccccaaaagataagacatactagaaaaacatgagagagagaaacaaaatcaatagactatcatctcaatatctagtatgaagcttggtaaagagttgatgaatagaaataaatgatccctacagacagactcaattaagtatacagcataatttgttcatgaaaaaatgagtatgtgaatcttcctagatcttttcaaaaattacttaaaaatattaaataaacatttttaaaatgggtatattaaagcatcctaataaaatgaagctgattgattggttgctctaagggagtagtgataaaataatctgctatataaatcctggatcatataatggtataatgcccctcaaaggtagtagaggaaggtgggttttaggccacttttaaattaattgctctctacctgtttgaatcacacacaatatgtttggctttaagaaaataaaaaggacctagagcagaaaaatagcttatacatagtatctatatattatatttagaatatacattttatatttaagagacatttcctcttggacttttatcctacaataaacaactacaaccataaaaacagtaccagcaaaacccaatctataaggagatttgtagaaaagtaacaacttgatatattctagctgtataaagaggtctcttgtcaattcattatcatccacttacaagtattttatgtacatcttaaaagcctgaagaagttattgtaatgtttcaaactcaaaactactcccctgagcattgatataacttatactccctacaaccaaccaacccaaatctcagtttgcctccattaacgctccaaaataagtcaagattgtaaatacagtgggttctcaatcaattgactttttcaacatcagatgggtggctggagccttcacaaacttcagagccctaatagagatccccttttctagcccacataaataatacaaatcatatctctatgatcattagagatgcaaaaaatcggtacaggcctttctccccttctaacacattatcttaggcttgttttatttatttaatttttacattcctcatgtgatctgtggccacacaagactgattctccaaactgaacttcattctatctgctccacaataagcaatatttattcattttcactcaacaattgtttactaaaaatgtactgtgtgtaagacattgtgctaagagcaagtaagtactaggaagtcacagttctatcatcaagttttaaatctagtaggtgaaagactcatacagaagtatcaaggcagccatgggccacctgagtggtgaaactgagacccaaagagtgtcaggaagacaggaggcactcaactgtggtaaatggggagaatgacagaggagatggcatttgagttgggcctgagaggacaggttgtccaggatttggattgacaatgatttaagggaagagaagagggaagaagaaaacagccaactttaagcaaaggaaacacaatgagacaaatttgcaaaagcaaaaaatgtaatgagcattgcataccaccagaagagcaggtgaataagggtactagctagaagcagcaaggttcattcatttgtattagagaaaagtgcaagataaatggttcatctgaacaatgggtggtttcacagggtttgaaaacatctctccctctgtaagtcatactatctccgactgaagggtccaacgtgaagcaggaacgaaggggccagtcctgtttggttgtccaggtgcaggacccaaaaccagcaacacacagagtgacatatgttgtgactatgcccttctcatatcaaccccaaaatgtaccgaaacactgaaaagacattttccaacggagacttgcccaagttttccttttaaaactattcagttttgaacctccaaattctgaatttcaaactcaaccacctgctttctcagcaacttcaccagtgaactcaatgttgaagctcctggggaaaaaaaaaatctcacataaaacgtacagtgtgataaatccaggcctcatagcattagctgtgtcctcccacttcccacagggactattccatgaaacttatagtgtcttcttcctggtgcacagctgggccacgttttccagcctcctttgcagctagttggtgacatgtgattgagttctaccacgaaatataagtgaaagtgattatgctaatttctaggcctaatttctatgctaatttctaggcctactccataaaaaccttccatgtgtaacctgccatgtttttccccctctcttgatgtgatgcaaacaagcacagtaactctgggagtcacatggtgaagatggagaaactacaagatggaaggaatctgaattcctgaaggatttccaggaggaaaatgtcacctaccattcatcaacacccatttaagacctcatgtgaataaggaagaaacttgtgttagaacagtgaaatgttgagaagttatcttgtatttttttattttgaaaaataatttttattacgtatatttatggtatacaacgtgatgttataggcttaatatagatagtaaaaaggttactgtagtgaagcaaattaacatatccatcatctcagttaccctatttttgtttttatgttaagagcagctaaaatctcacttagcatgaatcccatacctatagtcttcatactgcacattagatctctatacttgttcatactactttgtatcctctgacctacatctctccatttcctgcccacaacccatatccctggtaaccactgttgtattctctctgcatatttgaaatttttttggttccacatataagtaagatcatataatatgtctttctttggcgtatttcgcttagcacaatgggctttcccatgttgtggcaaatgacaagctctcattattttctagggctgaataatattcattttgtataaaccaaatgtggtatacttacagccacttctttctctatttgtccatcatcagacacttaggttgtttccatatcttagttattgtgaatcatgctgcagtgaacatgggagtgcagacatctttatgaggtggtgatttcatttcctttgggtatatgcccagaaaaggaatggctgggtcatatatggtagttctgtttttaatttctttagaaacctctataacgttttccataacggctatacccaatctacattcccaccaacagtggacaagagtcctccacatcctcaccaacatttgttatcttttgactttttgataacagccatcctaacagttgtgaggaggtaaatcacagtggttttgatttgcatttccctgatatgatgttgtgtaccctttcatatgcctgtggccatctttgtgtcttctttagaaaaatgtctactcaggccttttgcccattttataaatcaggtaattcgtttgttctttgctattgagttgtatgagttcctgataaattttggctactaactccttaccaaatacatgatttacaatatatctgatgtacattggaatattgggatatactgattggaattttttcccaatctgtaggctgctacttcactttgttgattgtttcctttactgtacagaaactttctagtttggtgtagtcccatttatttattttatttttgagatggagtctcactctgtcctccaggctagagtgcagtggcgccatctcggctcactacaatctcggcctcctgggttcaagcgattctcctgcctcagcctcccaagtagctggaattacaggtgtgcgccaccacacccagctaatttttgtatttttagtagagatggggtttcaccatgttggccaggatggtctcgatctcctgaccttgtgatccccctacctcagcctcccaaaagtgccgggattacaggcgtgagccactgcgcccagcccccatttatttaattttgcttttgtggcctgagctcttgttgtgatatccaaaagctgactaccaacgccaatgtccaggagctattcccctatgttcctgtgtaggagttttatagtttctgcttttatgtttaggtcttttatcaattttgagttgatttttgtatgtggtatacgataacagtccaattccattcttttgcatgtggaaatccagttttcttaacatcctatcaaagagactattcttttcccattgtgtcttcttggtgcccttgtcaaaaattagttgactatatatacgtggatttatttctggactctctattctgttccactggtctatgtgtctgtttttatgcctgtataatactgtctttattactataactttgtaatataatttttaaatcaggaagtataatacctccaactttgttttgctttttcataattgttttggctattcagggtctttcatggttctgtacaaatttaagaagcattttttctatttctgtgaagaaggtcactggaattttgatagagattgcaccgaatctgtatattgctttgggtactatggacatttcaacaatattaattcttctgatccatgagcatgtgatatctttccatttttttgtgcttaatttctttcattaatgttttatagttttcagtgtacacatctttcacattggttgaatttattcctaggtattttgttctttttgatgctttgttaagtgggaccattttcttcatgttcttttcaaacagactgtaattggtatgaaaaaaaacgcaactgattttgcatgttgattttgcaccccacagctttactgaattcattcgttgttctaacagtttttttgtgtggaatctgcaggggcttttttccccccctacaatataggatcacaccatctgcaaatagagataactttacttcttcctgacctcaatgcctttaatttcttttccttatctaattactattgctggtacttccagtactatgttgaatagaagtggtgaaagtgggcatccatgcctgcctgatactagaccttcatggaaaaactttcagttttcccccatgtattataatgttagctgtgggtttttcataaatggcctttattacacagagaagctttccttctatacatacactattgagcatttttctcaataaaggatgttggactttgtcaaatgctttttctgtgtcaattaagattatcatgtgatttttatctttcattctgttaatgcaatgtatcactactgattgatctgcagatgttaaaccagctttgtatgccagggataaatcccacttagtcatgacatgtaatctttttgatgtgttgttggatttggtttcctaatattttactggggctttttgcaccaatattcatcagagaaattgggtttaaattttcttttcttgtgatgtctttggctggctgggtatcagggtgatcctggcctcataaaatgtgtttgaaagtattccttctagttctatttttttggaagagtttaagaagtactggtatcaattctttgaatgtctggtagaactcagctgtgaagctatctgttcctgggcttgtctttgttgagaggtttttcattacttctccaatctatttgtgattggtctgttacaggctttctatttcttcctgagtcaatcctggtaggttgtattttcctaggaatttatctgtttcctctaggccacccaatttgttggcatataattgttcgtaatagggacttatcatcctttttattcccgaggtgtctgttgtaatttcttcaatttcatttttggttttacttgagttttcttttttctttgttagactatctatgggtttgccaattttacttaaaaaaaaacccaactcttaagtttattgattcttcctgtggcttttctattatccatttagtttatgtttgttctgatttttatttctttccttctactaatctggttttagtttgttctttttctagttccttgaggtgtaatgtcacactattcatttgagatctttcttcttttctaatgtaggcatatattgctataaactttcctctcagaactgcttctcctatatcccatcagttctggtatattgtgtttccgttgtcatttgtctcaaggcattttttaaatttatcttttaatttcttctttgacccattggttgttctggggcatgttgtttatgttccagatatttgtgaatttttcaagattcctcctgtcactgatgtctagtttataccactgtggtttgaagttatatctgaaatgatactagacataatttcaatcttaaattttgtggcctaacatatggtctatcctggagaatgttctatgtatactctagaaaaactttacattctgctgctgttggatggaaaattctgtacatgtctattgggtccatttggccaaaaatgcaattcaagtcctgcatttcttactaattttctgtctgaatgatgtacatgttgttgaactgagaagttatttttacagcagctagcattaccttaataatatacacatttcgaccaaattctttatgttagtttgggtctacccagaagcaagtaccaagatagaactagaaatacaaaagatatattgagaaaggaagccacagaatgtgggaggtccttcaaaccacacctatggacatggagaggaaaggaagaaggaatggctaggaagtcttggattccaacacagttccaagaaaggtctgctcaggccaataggagttcttgagccaatttggcccactggaaaagtcctgtgtcccacaggaatgagcctgaaataggagcccctattgtgcttggtcatgactgggagacgctagtggcaatttgtagtttagtacaatgcaagggtggctgcagaggggcagcagttgggccatcagtcaactacgcttctagctgtagatctaagcacttattttcatggacactacacccctcaaacttccaactttcaagacctacaatcccttatccatatccacacccagtctttcctcctttgttcccatctattaaaaactgagttgtcctttgtctagcccaaagctaatcttgccatgtgttctagcttacgtgccatcagatctgcttagagacattattccatcagttatctccttcttcttcctgtctaatggattatatctatcctccaggatgtaaacttgcttgagattttaaccttgaaaaagaatattaaaaaaatgttccttgacaactcttgctctccttcccttagtatctaagctccttgaaagagtagtataaatgaaccatctcatttcttatttttcaccacccactaattgctcttgctaggattactgaacctaccagttgacacatcctggaacccttgcttgacccctctgaagtattcaacattcttgactactccctccttctgcagattcctgctttgggttcgtggagcaccctatcctcaggttttcctcataccctcagatcattccttctaaagcttctttttatttgcttcctccttaaaagtccacttcctagggcttatatcattggttctctctgttctctgtttcctacattaatatcgccccttgatctcacgatctaattgagcacttatatacttatatactgatgagatcactcatgtagtcacccatgtagtctcaatactcataaccaatcagttaccaagttctgaggattctatttcttaactggctctcagcaccatcatctccttatctccccactgccactgccccatgaacttctgtaggagcagagtgaccctctcgccttggattccattcctacttatctgtacctccacagtgctgcaagagaatatttctaaagcacaaatttcatcatgaaacctctgcattgagattcctgaagttgttccccactgactacaggatgaaggccagcctccttggcatggtacgtaaggtccttcataatcagttttagtctgatcttcctccactaccttctccatgttcccaaactctcattatatgaagttatttgaaattcatacaatgtggcatatgtttcatgcttctatggccttgtatgggctctttgcccaaaatgctctatgaccctgccctaactgggggaatctactgtgcattctttcaatgtttggtttgggattcatttgtacagcgatgacttttacagaccaattcacctatctgtggagccccttcccatccccacgccccattcccaggccattcaagtggctgttgtgttgttagtacccattcatgggtaccatgcgtgcacatgattccaggacagcaatcctgccctgttcctttttgactagcactgacacagagtaggcactaaatggatgtttactgactgaaagaatgaatgatgtacagacccaatctccgaagtttggcctcacaaaatttgcctctgaaaaacaaaattatcacagagtagccaaaaaccatgatgacaccaatcaacattacatgcacacactggtgtccaagtgcaggtagtgacatctccaatttacacgtgaaaagtggatacttggcattaaaggagaaagattcaaatggtctacgtaagacagccacaaagatagctcaagagctattatcccaagggacacgcattaactgttagtaagtatataaactagagttcacatttcacacagaactttctaacacaaattggaaacaggagacgattaagctgatctaaggaaaagcatggctttgatacacaagaaactacacatgcattttacattaaatgctttttaaaattcactcacagaaaagagtacaacaattattttaaaagtcacagtttgtaaatttgatatgtaaaattggaatttaaaataaaaaatctccatggccactgaaggctgaaagagtaaaaagaaaaaggaaataaaagacaaaatgtgtagtttcaaactctctgtgatgcatctcacccctgatcagtgggaagccagttatcacattgaagacactaggtaagcacaagagtttactgaaaatggaccttttcatgaaaaatcatgggtcaaacatctctatgacatacactgctgttaaaggaaacacatagtttctcattcttgacatgatgatgcctgatgtgcttagttagacagacagcttaatatggttcccctcccaaagcttagtgaaaatagcttttttaaaaaatttgaaaaataaatccccaaacataattcttctggcaaaatattaaatcctaccgaagaaggaggctttcagggaaacagtccaaataaaccttttaatttgtttaatgttctataagctattggtatcaagaaaatgtatatctttgttttaaaatagacaaattagtgatgcatctacatgccatccacttaactttgttcctgctgttcagcctttataagagtagcattttttcttgcgctgactcctgaagcctaaatctgcaaaagtctgtgatgacatcaagcttaacattttgccaagcctgtaaaattatttctcaaaatagtgtgctaacacatcagcttttactcaaacctaaattaaatgtcaggaaaggactcccatgtttacactaactgcccattagtaaacatttctgactgtaataactgaaggtcccatgttctcaaggtaatggcaccagcaaaatcccttgaaaatttgctcctaaccacaagtctaagtaggatgtggtcactcaggttttagattgatgatgctgaagaaatgtatttacaggctgaaaagcttataaccctggccaaaacactgacttcagagcaccaggagaaactccttggactagataaagtaaatatttgaagaaaatctgcattcattgagtgatttgctggtatatacaaaatttatcctttaaggaaccaaacaggagttctaattacctccctatatttcttctccttatactttccaagttcaattacagctttgttcaatctctgccttttttactcttttgtcctctgtctgaagttttcaattaagacttactttataacaggattgtggttacgtaggaaaatgttcttattcttcagaaatgatgctgaggtcttcagggaaaaatgtcatgaaagtaagtctgcaacttacttttaaatagttctaaaaaatgaacccctcttgccaacacacatacaaaactataaattcagagacaaaataacaaatattaataattggcaaatataaacaaagggtatataaatgttcttcatatgattctttcatctcctctctaggtttgaatttttcaaaaggaaaagaaaaaaattttaaaagaattacttaatgagcaccaggttttcaaattgtaaatgcatttcttgagcatcacatatccaaaacttgagaggcctagggctaaagaaatgtcaagactaacaaaagacatgttgttgtcctctacagacatgatgttgactcaatttgcacatcctggaagtgtgtatctgggatggaggtgaagaggcattcacagccaggcatttttctccagaaagctgtccctttggggtttcctcgtctttccctcccagtgagaccctggttcacctgctgtctctccagctgtcaagcagtggttcctgggaagtctgggagacccgtgagaggttggaggtagattcaaagcaccctcatggaatgaatttaccaaataaacaactgcatgttagacctgtacatttaaaaacataagtgctacaaatattcttaaaaggctttcaaaatttcagtgaagacaagaatgctttttcaaatgtttatgtaaaaatcttatacaagctgtttgctattatagtcaggatatatttggtgagaaaaacaaaacattgtaactcaaggcatgctccatttcagacaaaacatgaactctctcctttaattatatcagccattacaacaagaaaaccttgtaaaaggttcacacatggggcccacattatggggatccacttcaccctcagagaggcttgttacacagctgagagagagcatggtggaggacagttgcttctcccttttttataaaatccttcccatttgctctaaaatagaatttctaaataacagcacccaaagagtgctcaaaataggatactaaaccactttggagggcaagacagaagtctcttgtcagcttccacaagaaagagaactttaggctgtacaagtattttctttgggatgcaaacactttgatataaaagtaactttctttaatatatttgtgctaacatgatgggaaatgcccaactcacacatcaggatcttagtgatagtgcatctatcctgaacatggctgtcttaattagcccgatgtgtctatggtaataaacaccacgctgcagaacaactcaatatacccaggtgaaatctttaccacttaaaacactttagacggcttgtaatcaattggatggcattttcccaatgagaaatcctaactgcaaggtaaggtacctttctatctatagtgagtgttgacttacgttgcaggcatggtgctaagagacttcctctgcattatcaactcattttaaacttaatactaccttgtgaagtatgtaatgtcctgggcaccagatagaagaggacagagaagcactgagaacagaagaaatgaacatttatcaagtactaccacatggtactgtaacagtgctctctatacattatcccatgtaactatctctacaaccctatgatgtaagtattagtaatgccattttaccagggagaaaactgagagatacataactggactaaggctgcagagatgggaaatgagcctatactgtcatatgcccaggtactatgtgggcacaattcctcctgatcaccacattctacaagctccaacccagatgctaaaggtagaggcaacaaccatggaggaatagccatgaatgttccttgcggccactgcacccatggaggctagagcagacctagtgccctgagggtgggatgtaaattcctttttaaatccagagggtgtgatatggagggtctatctctggtttaacgaagatactgaagccagtgaaaacagatcccaaatctggccccacgactgacccagcctcctaaagagcctgtagatgaccaactacagagagaggaaggctctagaagacagaagatgctccctgggaggttcttttcagctgtctttcttcttccctcatgcctctctatgacttaacttggcatctaggtgcacatgggcaattgttcacagcagccaaaaggtggaaacaaccctaatatcaactggtaaatggataaacaaattattgtatattgtagcatacaataaaattttatccagccacaataaggaatgaagtactgatacacacaacaatacaaatgaacctcaaaaatgttatgctaaatgaaaaaagccagacataaaaaatcacatactgcatgactcaatttatatgaaatatccagaaaaggtgaaaccatagacgcaggaagcagagaagtggtttccaggggttgagggataaggggaatgaggagtgactgcttaatggggacggagtttcctttggggtgaggaaaatgtttcagaactggatagaggtcccagtcgcacggcactgtaaatgtactatatgccactgaattgtacacttgaggagggttaattctatatgaacttacctcaattttttaaaagtacacatggcaacgcatagtctttgagcaatcttgaataacgatatacactatgccaagctataaagatgccccaccctgtgccctttttacattacacacaaatagggacggatttcctgtaagctgatcttgaagaaaaaaaacatgttagacaaagaaaatcagaactaagacatctcccccccaccaaaaaaccctcaacactgtatctttgttcttttcccatgtcctctaccctactaaaacgaacaaataatataaaccccaaccactgagtgtaccacagacagaaaacttggtacacaaaagacctaataaaataaaatctgtcaagttttgttgcccccaaattgaatagaaagatccagcaggcccttaaacatatgaaaagaagcacactcttgctggcaatcaggggaactcaaattaaaacagctagtgatcactttacaccgcagagagagaacacttaaaaagactcctaacacctggcaggggtgaggcaaacaggtactctcatattttgcaggtgtgactctacagcaatgcaacttttttggagtatcatctgacatcatgcatgagtcactgactccgtttttaggaatctatccttcaaatatcaaagtagatacacatgaatatatgtacaagaatttaactgcagtgttgttaggaatggtaaaaacctagaatgctcttgaaggtatatcagctggggaataattgaataaactatggtacaacgataccataggatattatgcaactgttaaaaagagccactagattcatatttgataaggataaatgttgtaacaaaatattaaagaaagttgcagagtattgtttatgatgccattttcatagcagaaaaaatgtcccttctccatgtaaaggtatatgtttgtatgtatgtatatgatgtatagagaaaggaaaagaaccagaggagtgggagaaagacaatcaactttttctatattcacctaaatattattttatgcattgtcctacaattttttttaaaatagaaaaagtttaagtaaacagcatttttttctgcacttgccttttttgtttttttttttttttcaagacagggtcttgctctgtcgcccaggctagagtgcagtgccatgatcttggcttactgcaacctctgcctcctgggttcaggcaattctcatgcctcagcctcctgagtagctgggattacaggtgcacaccaccatgcccagctaatttttgtatttttagagacgaggtttcaccatgttggccaaatttgcctcaaacccctgatctcaagtgatctgcctgccttggcctcccaaagtgctgggattacagccatgaaccactgtacccgaactgcacttgccttttatacatgcaagaaatgtgaaggggacagtccccaaaaacccactttgaggatatgttctgaaattagtatctactgaacttcagtctcctaagttgtatatattctgtccaacagtgcaactcgaactggactctgcagaccagccctagtcccagaataagcacagaaactgagagtagacctttagaatttttttacagcagcttgccagagtaattttatgtctgttgactataagaataataaatgtttaatcaggcttatgtttttagtttctttaaatttcatttttctagtatttcatttttctagtaaatcatttttattgtattttataaaattatcaatccatgacatactggaaattaaaaacaaaactggtccttcacccaagataattagagaagcaaaactctaaacaatgagagtcaatgttcataatgataaaacatagtaatataagatatttaggaactttaataatgaaagattagattctattgagaatacatgctaatatattcaaactcttatgaaaaaagatactaaatagatcagaagaaagctttctggtaataagaacagattactaaccattctaggtaaataattaagttcattcttgtcaggaaaaatgaactctagtttctattttcaagtgaagactaagagacctggagaataaatgaaaccccatacaactccaaaaccagctacccagagttcagccagacactttaacttttgctgaacaaaattaacttcattttcatttttttctcccctctcgtccttctgaatgaagatgctaatagcaacagaaaacagtaacagagacaagtggcagggttaggtggggctaaggtctgactactccgtgcagattctatttaataaagtttcacctaccaatattctatgctgggggtgaggggtgggaagggaagggagagagcttacatactcctaagtcttctgagttttctaaaagttgatacaccaagttacagttacccagaaaaactggtgggaagaataaagaaccaaaaaacatacttacagtccaaaagtaaaaaatatcatttgtacatacaaatttcttctccccttcctaaattttttaaactaatgctatagtgaggtgcatttccaaatctggcagcttaaataaaatcaactgtaactagcattgtggtgaatgaaatgctttacaactcacagctgtgacactgaaataaggaaatcctggattcccaccaaggggtaaccagcatcaaaagacagggcacattttgatgttttgagaatttctgagaagtcagagaaaatttaggttattttcatatcggttggactttccataataaaagagccctaaaacaaatagcagccccaagtgtggcagtgctatattgtttggattccttataacaatcagtgtgttcataagatgcttagaaatacacagaataagctgatggccccggtgagtgggacacacgctgggcagctgtgtgaacttttaaaattttaatttaatttttattttatttcaatagttttgggggaacatatggtttctggttacatggataagttccctagtggaacttcactctgagtctccagagtccattatatcattcttatgatacactatatttggttttccattcctgagttacttcacttaggataatggtctccaattccatccagattgctgtgaatgccattattttgttcctttttatggctgagtagtatttcatgatgtatatataccacattttctttatccactcattggttgatgggtatttaagctggttccatatttttgaaattgcgaattgtgctgctacaaacatgcatgtgcaagtgtctttttcatataatgacttcttttcctttgggtagataatagtgggattgctagatggaatggtagttctacttttagttctttaaggaatctccacactgttttccagagtggttgtactacctaagaaactctaaagactcatccaaaaagctcctagatcagtaaggtctcaggaggcaaaatcaatgaacacaaatcagtagcactgctatacaccaaccgtgaccatgctgagaatcaaatcaagaattaaatcccttttacaacagctgctaaataaacaaataaaatacttaggaatacacctaaccaaggaggtgaaaatctctacagggaaaactacaaaacactgctgaaagaaataatcgatggcacaaacaaatggaaacatatttcatgctcatggatgagtagaatcaatattatgaaaatgaccatactgacaaaagcaatctacagattcaatgcaattcccatcaaaatactatcatcattcttcatagaactagaaaaaacaatcctaaaattcacaaggaaccaaaaaaaggtacacatagccaatagaacaaaagcaaaaagaagaaatctggaggcatcacattgcccaatttccaactatactacaaggctatagttgccaaaacagcatggtgctggtataaaaacaggcacatagaccaatggaacagaacagagaatccggaaataaagccaaatacttacagccaactgatctttgacaaagcaaacaaaaacataaagtgaggaaagaataccctattcaataaatggtgctggaataattggcaagccacatgtagaagaatgaactggatcctcatctctcactttatacaaaaatcaactcaagatgaatcaaagacttaaatctaagacctgaaaccataaaaactctagaacactggaaaaactcttctagacattggcttaggcaaaaagttcatgcctaagaacccaaaagcaaatgcaacaaaaacaaaaataaatagttgggacctaattaaactaaaaaatcaacagagtaaaaagacaacccacagagtgggagaaaatctttgcaaactatgcacctgacaaaggactaatatccagaatctacaaggaactcaaatcagcaagataaaaacaaccccatttaaaaaaaaaaaaaaaagaaaaaagaaaaaagaaaggaaaagaaaaaaaaagaaaagaaaaaacattgtttatgaagttcagagcttggagattcattcaagtattgattgcagttttattttgaaaagaatgctacaatttatgtggtttttctcatgtttatattaaaagctaataaactaatttaaaaagaacctatcaaaaactgggcaaaggacatgaacagacaattctcaaaagaagacatccaaatagccaacaaacataagaaaaaatgctcaacatctctattagggaaatgcaaattaaaagtgcacgagataccatcttactcctgtaagaacggacataactgaaaaacaaaaaataatagatgctggcgtggatctggtaaaaagggaacactttcacactgctggtgggaatgtaagctagctgtgtaaacttatgaaacaaagaccaagctgaggtccttgcctcacctgctgtgcttcaagggctcatcagcttggtcccaaatgatgtcttcagtaggtggcgaaatgttaaaactgggagctatgtgaacgaacgcgctgaaagacaaaacacgttagatcagttaggtcactataacaaaacgtagtatcatgcaaccaagtgctgttaaccaacttccttctctgcttgacattgaactacctgcaaatttagtgcttagaaaaggtccagggacttgcccatgaggaagaactcagcaataccacagactttaatgcaactggatttcacctcctcatgtcaccaagacttactgtgcagggtacaaatggccttcttccgtgtcaaatcttatgtccccctttcactcttgttctccttgacttctttgtagtgtctgacactgttcagtagttttttttttcctctttttattctcctctctctcctgcttcgcctgtttcttttatggtttcctgctcctctttctccttctgcttcttgaccaaggacactttttaaggccctgggtttttctctctccctcagaaatcgtctgttcccagcacatcaattctctccttgcagatagccccccaatcatccccattccctcccttgaactcctctcctttattctcaactctccagtgagccatttttcctgcatatggtatctctactgcatatgctcttcaaaagccttcatttcttgctgcaacactactgctgtggaaaaatgagcttgtctattgacctcattgatttctgcaatagcagaattatcctcccagccaaccaagctccaaatcttagattcatttttgctcattccctcttcttcaattccagtcattcatcaaggcctcttgatttgttacatctcacctctatcttttgctacccacttacactgaccagatcctgcttagctgagaaaaactccctcttctcttctttcctaatgtttcctcttgtaaaattggccagcgtgctgctgccattttgatctttctatcactacccctgccattttcatcttcctctcgctatccccagcaatttgagaatcctcatcacccctctaacaagcaacctgcattgcccagtagagagaaaacaagacagcagagtagctaagaactcaggctctggatcctggtggccatgctttgaatcacagttccacaacttaactgctatgtgcctcagtctcctcatccctcaatgaaggccaggtgcagtggctcacacctgtaaccccagcactttgggaggctaaggcggaggatcgcttgaggccaggtgttcaaaaccagcctggataacataacgagttcctgtttctatggggaaaaaaaattagccaggcatggtggcacacacctgtagtcctggctactcaggaggctaaggcaaaaggatcactcgagcccaggagttcgaggccaccatgagctacgatcataccactgcactccagcctgggcaacagagcaagactctgtttctaaaaaaagtgggggcaggagggacttgataatatctcctgcaaaggcttgctgtgaagataagaatagttaaaaggtgtgaagaacttagaagagtgcctagcacagtaagcactccattaagtgttaaatggtaatggctcccagctggactggcccacacagcatctcctaaacctgtgtgctcacccttcctttgttattacaccttccatcatttggcttatacagtgtggaaactcttcttctcttggctcctctatacaaattctgcccactgtcaaggctcgggtctgatttcccactcagccagtgggaaatctgagtacttcagctgcaaactagcttttctgcctctgaacttctagaatatttactagatgtccctaaatcaagttgttttttaaattactgagtgtggagggaagctcacaggctggaaattactggtgatggagctggaggtcttgctctttcctctgggtgcccctaagtgggtaatgtctcagaaccccagcttctttctctgaaaaagttattatcttatttataaggtttcctcaaagactgaataagaacatgtaaagctcctatcatataatcaggcgtaaacattagttcccttccagtgggactataaacctccaagggtagctcacgtttctccgtgctccaaggacagtaatatgcagagattaaacagacagataggggaatacagactgaataaacgaaaacctttccaagtctgattttatgacaatattctgaaaagggcttttccatgcctattctaaacaactgacagtgcttccatcataaaatgcattttgacacacttaatcttccaagaacatacgttgattctatgccctgatgagagaatatattagctacttaacctttatctaactcttacataatattaagatttttttaagattcatttttacaaaacccagaaagtccacacacaacaaaaacaaaacaaaacaaaaaaaggaacacaaagtaattgaaaagacttttcatacctaaaaagggaatttttaatcacaaccttagtcataaacctcaacaggcaagtcagaagcagtgaaagataaaagtgccaacaagaaaatccggttgaagtgccactcgggttcatgcagtgggttacagggcgcacaagacaagctggcggaagtgggtgctgtacctttatcacagccgcccccacctgaccacctgtagcagcctcagaggaagcagacaacccccacacactttccagctgcatctttgcagccacaaagtacgcacatacaatcagctaacgtataaaagtatatcagaagcatcaatgtgaaaagggaaaaaatctttaactcgtgatgagtaacctgtgttatttagattctgtcattgagacctgatgctaaggggagacccctctaaagacacccacacaaccctgataactggcagcataagtgcataatctttgcatcaaatacctggggcactgaagaggctgaagcagcaaatcctctggtagagggtgaggaccaaatgggggtacctcagaggctacagttcctccccctagtgttcaatgacaaatggaaacatgtcactgggtccaaacgcagggaggactagtctttgctttggcaccaggctagacaaagaaaagaccccttgccccgtgaccccacattgtcctacaaaggaaaaggctggattttgttgatgaatgcaattcacatgtttggagcagtgtcatttgaaaggactgcttcagaaattcatgcaagtcacataagtggagagaaaacaggaaaaaattaagaatggctgtttacaagtcacttctaaaactttgctttgttctacttgaacaatttttatcatcatttaaagcagttaaattaaaatgcacctgcactgtaaatcgtgagagaacatacctgctcttcaaatatgacttgaaaattatttggtttctcccctacctccccctacctgggatgctctcattttacatttaatttggaaaattagaagaaaaatggaataagctcaaatcctaaccaaaatttgtttttacttttaaaatacaaccattttagaatttttaaataaatgtaaaatattttattatttacttaacttttaccttcagggttacatgtgcagatttgtgatatgggtaacttgcgtcatgggggtttgtcgtacagattattttgtcatccaggtactaagcctagtacctgataggtttttttttttctgctcttccccctcctcccactctccactctccagtaggccccagtgcctgttgttctggatgggcgtagcggctcacgcctgtaatcccagcactttgggaggccaaggcggcctgaacatctgaggtcagaagttcgagaccagcctggccaatatggtgaaacccagtctctacaaaaaaattagccaggcatggtggtgtgcacctttagtcccagctacttgggaggctgaggcaggagaacagtttgaacccaggaggcagaggctgcagtgagccgagatcacaccactgcactccagcctgggtgacagggctagatttcgtcttaaaaaaaaaaaaagaaagaaatcatcaatgggcattaaagaaaagtgtaacttttaaacctactttcatagttcaaatacacccagtatttggaggtcagagtagtcacacttcactaactttataaaggagaggctttcaataaatgcaaggaatgtctaccacagcaatacatgtgtaaaacgtttcatctatgacagccatgttctaaattaatgttatatttcctactctgaaataattttaatttatgactaaaaatggtaacaaatgttcttttcattgaggcccaagaaagtatgagagtatttattcacatattctcatttcccatgtaacatgcctagggccatcctgaatgagagcacagaaaatgtgaaggatttctctgcctagtctgcttaagatcaacaacacctataagtctaaacataaaacacacacctttaaatgatcaccattaatgttaataagcattaaaggtagacactgaagtcttttgtgttggcaaatcctagaactacattttcattcagacaggttgcctctggataaacgtctaagattttttctaaaaacaagttatggtatttataattgccttctttaaaagaatgcaaattcttttgcctacagattacgctaagcaaaagagtgagagagagaggaaatttcagtaaaattttgagaaccatagcttgcattatagattttggaatgtaccttcctgccatttaacccaaccccattttcttatttcctagtaaatacactccccagttattcatcccttattataccctgggacaatggtcattttggtaccaatcacaccttagttttccactatcacctgctaaaagttctcttgaagaaaaaaaatataactgtaagagaaacctgagtgatataacgtcagtattttaacatcctaaccctttcaaattctctctatatgagaattgactattttcatcctcccttgaaaaaatgtgttcgggcattaaaattcctctaccttggaccttttcataatggctgccttagtatttattttgatatactattcaagacaccaacagtttgaggttttcacttcttttcttgaagagtgtcacaaagtcaaatttcagcctcatctacaagacatttaaaaattacactgctttcctgatttaactcctaaatatgcccaacacaaataattatgttgttcacctgaagatatgttctagaatcttcacattgctactcataatggccccaaactggaaactatacaaattaataaatagtggtatagtcacacaatataatactatatagcatggagaatgaaaaatcaactaccatagtcaatatggtgtcatgcacaatatgagttaactgtgcatattatcgagtgaaagaagttagacacaaaatagtacattctgtatctccattgatataaagttcaaaaacaggcaaagcaaatctatgctttcccaagtcagagtagtggctaccacgggtgaagtagttactggaaggaagcctgagggatttctagggcgctgataatgctgtgtcttaatctgggaactggttacaacagcgtgttcactttatggaaattcgtcagtaagatgaatatatgttatatgcatacttttccctatttatattatcattcaattaaaaagaaataaaattaatcagcttctcttaagaaacagacttacaggaatgaaaactagtgtgtttcacacagtaaaatggaagaagcttaagagctaggttcaaattccagactctaccattaattattcaatcttagcttctctggcttccagttctataaaatggagccaacagcaaagatcaaatgacataacactgaaggcattttaagcaagaagaatatacaaatgctgagcactactgcctgaaatactaataatgtacttatccgagaagcctttaaagttacatggttctacacaaaatgttagtataaacataactggcaagataatattatcagttttgccatttaaagaacttcctaacaatcaaagatatgcaacatttattctacccaaagttaaagtgtcctgccctaacctctactttgagacacttggtaaataattttcggaagagtgtcaagatacataatattataggagacgatgtcaaatattaaagcttcaataataagtggactagagaatgattctactcacagctcacagttcaatccatctcttcttctcactgacttctcaaccattctgtgcttttccatgttttcctccttcttcccactctaccctgcctcctacctggccatgccccctttctctctgcccactgaaattctacccactcgtcagtgcccagccaaggcattcctctggtgggacacccttccaggccatggagacctttccaggccgtggagacctttccttcctttgaagcactttttttagtgcctcaaccgtctgtttgcaacagtcttggacctgagcattgaacagctatgtatctctcaagccatgatttaacaactcatgtgctcatatcttgcttccccagtagactatatgttttccctaaaggcagggacctgtgtgatacttattttaatcccccttcaatgctctgtacattgtagatattaaatgcttgctacccagtgctctactttgtgggttcaagaaagcagtaatctctaaaagtagggcaaaggtgcagactgggatttcttcaagtaagtggattctgtcggtggcacctcatctctaaaactctctgttaagctctgatcttcttttctctgagagctctcaatcactctagactttagagactaaatcagcactttgaaatcaaagtataaggtgaaccacatataattttaaatttctagtagccacattaaaaagtaaaaaggaacaggccaaatgtatcttaatatttactagttaatcctatatatgtaaaacattatcatttcaacatgtaatcaacataataaaaattatcaaggagatatatatcctttttgtttgaaagctggtgtatattgcacagcacatctcaaccacatttcatatgctcaaatgccacatgtggctgatggctaccatactggacagaccaggtttagagttcaagctagaatatgtgatttcaaaccattctgaaaaaatctaaaatcgaacaaacgctataggaatatgcagtaatcttcctaaatcttgctcttaaaaaaaaaagaatacggccaggcacggtggctcatgcctgtaatcccagcactttgggaggctgaggtgggcggatcacctgagatcaggagtttcagaccagcctggccaacatagggaaaccccgtctctactaaaaatacaaaaattagctgggcacggcagcacatgcctgtaatcgcagccactcaagaggctgaggcaggagagtcgcttgaacccaggaggtggaggttgcagtgagccgagatcatgccactgcactccagcctgggcgacagagcgagactccgtctcaaaaaaaaaaaaaaaaagtctacactactttatcattttataaagccctctgtcatacattatctcatctagatgacatacgtacagcaaacattaagccataaagtagtttcttggtcctatataccaaaagaacacagacctggtaacacacgcttaaatcaaataactcacagccttaaagaacatctattcatgagacgttttctccatttttactatacagtaaagcatattttatctcttattttaagtcatttaagaactttttattttggaattttatgactagccctttaaatattagttttgctaggaacatcaaaagaacaagtgactaattacataaaggggaaaagattaaatgaatcatggattccacttgaacttcatcagttaaaaggataattagcaaaatatttaaggaaaaagtaaatgagcttgttagtcatggccttttgaggggaaaaaggtaaaactattttacttgcctgatctcagatctagaatctaaaagataaagaggtattgtggagaatcattataaaatactcagacttcaaaggttcccataaggtcaaaatatggactatgtataagaagaaaaaatatgctaaatataaaatcaatgtattaatgagatatatttatttaaatatcccttttgagtattcttaacaggtattcagaaccctaatctgcttttgaattttcaatgaatataaaagaaaaatttgaagacattaatggagaattttaaagcaagaatctaatcctgtatgttagaaagaagaaaatacaacgttatgtaatattttaattcttataggtgcccaaatacataagcaacctaactttgacatcgggggaaactggacaaatccatttaaaactaatttagcaacaaatacttacatggttctgtggacatgtaacatcccaaggtgttttaaattgataatgtcaccatatgaactgataattttcagttgaacatacagtttattctataaaatcattaaatcttaagaaccatgagggatcttagagacatttagcccagtgcctctcaaattttgatgtttatgtgagaccccaggggcaccttgagaaagtgcagattcagactcagtaggtgtgggtggccctgagacttcatttctaacaagctccaggtgatgccgatgctgctggtccagggaccaggcagtgggtattgtggccccagtcaagtctaagggaggtcccacagcctctgcttgggcatctccagtatccaggacttgaaacctgcctccaagggtagacattacagggagggacttgtatattacagagagggaagcaacaaggaaaggctgcttccacttctagtgatggaagacactctttctctcccaacatctcctcttctccatgttgaaaatccccacttcctttggccactcttagaactgataggtttccagacccctaaacatctttatcacagaaaatgctccctctgtggtgaaaatctttcttaaaataaatcccttgggacaagacatagcatcccacacatgggacatccagacctgagagtagttgagtgagaacattacattccctgatctaaaggggacagctctcttaatgtggccttaaggaggtgtcgccttctgtaagaatcacactgcactggtggctcacaatgttgtggaggaaataataccaagcaagtgttcccatgtgcacttgaacaattatttttaactaaaatgtagcaatttacagttatttctatttaatgtcatcttgctactataacaactcacataaatcctttaaaatgtttactaataggtcacacatatataaaaaacatagacagtttttaaaaacaattaagaagaaagaatatccttgggaccactgtccaggttgggagataaaacactgccaggacctcagaagcccccagtgagccccttctctatcatacccactccttcacctctggaggtagctgttatactgctttttgtgacaatcatattaaatcatattaattttctttatagttttaccatctatgtatgtatccctaaataacatatttagttttgcatgcttttgaactttacatgaatagaatcacactgtatatattcttctatcttgcttctttctttccatattgtttgtaagattcatccattttgatgcacttttatttgtttaacaaacacatatagaatgtattgtctgccagtcattctcctaagcatgtcacaaacattgactcatttaaacttcctaacaacactatcaggtagacatcattttccctgatgtacagatgagaaaactaaggtacactgaagttcagaaattcatccaaggtcacacaataagtggcagaaccaaaatctgaacccaggcacaatccttcctcttgaccaccaagaaatgctgcctctccacacccttctatatgtggttatactagttgatttttcattgccaaatagtatcacagtgtataaatacctcacagcaaaatgtgctgattcgattcaatgttgatgggcatttatttgggttgcttccagttttttgctcttatgaacaatgcttctttgaatatgtttgtccatgttttttcttttaagttcaggggtatgcacatgtactggtttgttacacaggtaaacttgtgtcatggaggtatgctatacagattatttcatcactcaggtattaggcctggtatccattagttattttccctgattctctccctcttcccaccctctaataggtctcagtgtccgttgttcccctctatatgtccatgcgttttcatcatttagctcccacttataagtgagaatgtgcagtttggttttctgttcctgtgttagtccgcttaaggataatggcccccagctccatctatgtccctgcaaaggacatgatctcattcttttttatggctgcatagtattccatggtgtatgtaccacattttctttatccagtctatcactgatgggcatttaggttgattacatgtctttgcttattgtgaatagtgccgcaacgaacatacacgtgtatgtgtcttagaataatttatattcctttgggtatatgcacagtaatgaaactgctgggttgaatggtatttctatctttaggactttgagcaatcatcacagtcttccacaatggctgaactgatttacactcccaccgagagtgtgtaagtgttcctttttctccataaccttgccagcatcaattattttttgttttgttcatgtttcttaaagcacataggtaatcatttttcttaggtgtatacctaggggtaagatggctgtgttgtaagttatttgcaggttgaacttggttaggtaacagcaaattgttttccgatataattgtaccaagttagactcctgtcaactaaatacaaaaactcccattcattcacatccttacatggtattgtcaggttttaaaatttctgccaatccagagagtgtgtaatcatatgttactatgattttaatctgcatgtgtttgtttattaatgaagctgagcatctttttatatatttactagccaattgggtttcttcctttgtgaaatgcatgtttaagaatatgaatgtacagtatcatttttctttttggttatctggcttttttattgattcacatgtgtgctgaaccagtattatttatgtgccacaaacgtctttaccactttgggcttgttttctcattctccatagttaccactcagtgaacagaagtcctactcacttttttttccaacaataagtgaaagacccctcatgcttttttttttttcttttttgagatggagtttcgctctgttgcccaggctggagtgctgtggtgcgatcttggctcactgcaagctctgtttcctgggttcacaccattctcctgcctcagcctcccgagcagctgggactacaggtgcctgccaccatgcccggctaattttttgtatttttactagagacagggtttcatcgttttagccaggatggtcccgatctcctgacctcgtgatccacccgcctcgacctcccaaagtgctgggattacaggcgtgagccaccacacccggcctcctcatgcatttttaacttttgaactattttataagaattttttaggtctggccaggcacggcggcttacacctataatcccagcacttagggaggctgaggcaggcagatcacttgaggtcaggagttcgagaccagcctggcaaacatggtgaaaccccatctctactaagattacaaaaattagctgggcatggtggcatgtgcctgtagtccagctactcaggaggctgagccaggaggatcacttgaacctgggaggtggagggtgcagtgggccgagatcgcaccactgcactccagcttgggtgacaggacaagactccatctcaaaataaataaataaataaataaataaataaagcacttagaaaggaaaagaattatgttaaatatacatgttggtcttacagtctagaaattcagttgctttgactataaaatacaaaaagcaaaggctctgggataagaccactgtgatacgaagctaagatagtgatctctgatagtctggccaaactgcagcaaaaccaaccaaaactaaacaaaaaacaaaaatgtccccatatgtagacatacggaaatgggctgcaaaaagatgaacgtacacctgaattcctggtgacatctgggcagcccctcagcaggtagcacagttcttcctgagctagctgctccactctgctgtttcctctgactcgcattttctgttaaccttcctcttggaatcctttgacaatgactcacagggttatggggctacttagcaataccacagccctccgcaatagatgctgtgtaggagggacgcagctcagtggattgtagtctgcaccagtattttcctttctgcattcagggaggatttgcttttcagccacatttccctcaaacacagccccgacaggagatgcttagcgcagagatttctaaacgatgaaatgatctgagtttggctccttaatcataatgaaactaaaaacagtaagatgagaaaacaacagggggatcatcattcctacaaaaaacaactttatacttgggcaaaatcaagagattaaaaaaaaaaagctcaaactaacattttccaacctttcactaagagcaagggctaaaaccacatgttttgaaggtcttgcactgtgttattattagaagtcacaattctattgatactgatgagtcattcgtatcggcggaaaccaagaacttccatcaacatcatgttacacacagtcactgtggcttttctttattactggtcaaagctgcttcagaatgcttattgaaacttaagaaaaagaaggcaaactcctcaagggtgtgcaaagctttcccttccccagctgatcttactttaatcatcctttttcaagacagtttatgatgattggatcaacttgtatctacaaaaggaagtttatttagaagcctcagaaaagcaacatttcacactttccgatgaaaataagcaaaactgaactctgaaaacaaacagtgaaaccatctctgaaaatacatgctagctttaaaatgacctgaggtcaagttttttgttttgttttttaacctcaataacagggaacggatataaacaaaagctgtcatcacttagggacttcagccacataaaacaatgtcaggctagtcacttgcaccctcgcccctgcttccctactcaggacacactgctttgcactgagggagaagtgggtcaggtttcagttacgccaagaaagcctaactaagttaaaggtttatgaaaactctttctgatcttagtaggaaataacagcacattcccttttcatttattatcagccccttttgcctctccccttaaatattcccagaaaaataaagtgaagcaaaaaaaaagttttcctgaggcatatccagaaatgctatgaatctttatgcagtccctacaaaggtagaaatttgtccaattttctcccctgcaaccagaaggctgtgtctggctgctggcaggagaagaggacccagctcagcagtgaccacagatctgaaaatagcctcccagtagctaaccagcccagcagcccggagctctccaagggcggtgctggtactatgggcagtttacagtgcggccagctgagtgctacaacagctgcatgagtcagcaagcactgctggtaggaaagtgctgacatgctaaattactctcgtgtacttgagatgcacacacctacctggcaaaaacaaaaacagggtacatgcaaattagcaaacgggaacctctctacgcttgcagtttctattttccaaggttagaccaaaaatataaataatctatgccactgctcaaaaagaagtaacaactaataataattaatcatggtaataaacaactcactcttagtgttgctatgtgtggaacagctgcactgaaatctcacgagccagttaattttaactggttttaattttaactagatttaactgcttttcctcccttctgaaaaatcaaaatagttaccatatcgaccacaagaactggtaacagacaagcacagttcctgtttttcagaggggacttactttcaaacccacaatatcaacacgcttaacataagtggaaatttaaaatgtactgtttaatgtgggaaatttaaaacctgtatgctaattgagatctcatgtgccaggctttgtctgacaatgcctctcattcatctatgttctctcgttttatacgggacctaaaaatctgcaggaacactggttgtctggaactgagaatacattttcccacagaaatagggccaggccaatgagctaggattccttgatagtccgtgaaaatgtcttgaacttaaaatatgagaggttaaatttataatctaaaaagaaaatgatactacaatgatagttccaaaaccatttaaaagaaaatactcttgattaactgtgtttgaggaaatgtctaactacaggaggatgaagggacacagtcttccaagtgacactttcagacttcaactttagggtcattctggttctctaacatggtttcaattgatagtttcatttaaaatgcatagaattctcttactttggcataaagtattgttagaaaaaaaatctttatacttaccggttttaagtactgttttgttctccaaaaaaaaaattgagacttggaaaacaaaaaaggaggagaaacaagtacaaagagggggtactagagagagggaaacaaattaagtctggaacaaagaaagacacggaggtataactaaactgcaaaaacaaaggagaggtaggaactagagggcagttccccgctagacagtgtgttcccagagaaagaggactcttcatcatacccagctctggaggtgacagtgaagtcctgcaagacagttccacagactggcactagatggagccatcaactcaacatagcatggttgctggagaagggtatggtgggggagaggtgggactgaagggcgttgactctacagccaggtatttacctgccaacaactctatctaaaataagtatagtttaattaatcaaccaactctcctaatgtccagatgtcaccaccatgctgacaccactatgcttgtggtatgtcaaattgggacacaccaattttgaaataaatttatcaattcaatttgtatcaatgcaactggggtggggaggtaagtgaagttggatccgctgctttttttttcttctaaaattcaacatgcaaagataatatagaatttcaggttcattgctactgaataacaaaaatccctaaccacaaaccaaatggctttccctggaagctttgtttaaatgttaaataacataccatcttgctatagaggtttatgtgatcaactccaatgtacggcaaaaggcgggaaatgctcactgacaaatgtattattaaaaataatcttctctttgtattttaatactactttgatttaaatactgtaatccatttgcctatattctctgcctagggttgtgtttatttatcacgagccctctctccattcagaaatggtctcctatcaccaggttaccagtgtgcgaaattctattgtttttatctttagggttttacttctttggctttgtctcctattaacatgctgatgcttcagaaaagtaacacattaagtatgctcagttacttatatattagtaaaactgtgttcataaaatctttctctgagattggttttggaagggaaggacaaggactagttgaggggactgggtggccaaaaggtaagagagcatgaaacaaaaaagtgagcacagaaggaggatgggggaactggctgcaaaccgtgcctagcttctttacatctgggacacggaccatcatccctggcacttatcttcccaagaaaatgtatgaaaaggaagggttaactctgtctacattttcctcttgctgaatgggtaataatatctttcacagttaatttcatttttttttcagtttgactcttcagggcttattcatttgcataatatggaatcttgaacccacatagatattctacaaatcaatgcaagtaattctcacactaaatcagcagctttaatttaagctcaacattgtttgcatagaaatctttatgcactcatctgcttgattttttaaatcacttaaaacctccaacactgacacactaagcatctcccatttagctttctccaaaatttgaactaaatgctgaaaaataagcacagtactatacattcatacacttgatcatttcccaaattgagcttcaaatgtgtgcttaatgtttcaagtggctcctgagaatgatgcttcttgactaaagatgacaacttcggtgtctggcccaggcagagctgagtcagcattctaaacagtgaccctgcaaacctgaggtaattgggggttactgccataccaactgcctgagtcctttaaaaccattcaaatctccagctgagagttgcaacatgctaatctggcaagataatctcttcctgaaattgaccagaatgagaacaaaggttacctccttttatctgttactggtagctaatatttctaattaggatttctgatggaattagttctgaatgaacatcttcctccttggtagaatactctacctcttacaggtatagttttttaccttttcctacccaccaaaaaaacaaaaaacaaaaaacaaaacgcaaaaaacaaattccctccacctaacaagagggtaggagtgtgagttacaagtaaaccctggagacagagccatggtatttcagttatatgcctagtacttcttttgcctttatatgcatcacttttactttccgatccctaaatggacactaaaacctaaggaatgcaattattagaaagcaggccatgtgaaagacaggagatatactcactcagatttactgagaaattattttttaactttaagatagatgtcaacaaaacatccaatattttagagtgagatgacctttatttctacttctgggaactgctaaagagagttccaacttcaaatgaagaagaaaaggaaaagggagagccataacatggtaagagaacaggcccaagcatcagacagctagtgtccaactccagttctaccattcattagctgagcgacacctatgctgcggcttctagtgatcacacctagccctgggttgttctgaggattatgtgagttaatatgagcagcacacagaggaagctctcaatacaagttaactatcatcaaagaaaaagaaaatagaggggtgttagcatgaagtataatcaatttattttaaatagatgctgtcaaaattccttaattttgcatctaagaatggtctaaataagacgtgtccaatcttttggcttccctgggacacactggaagaaggagaactgtcttgggccacacataaaatacactcaacactaatgatacatgatgagctgaaacaagaaaaatagcaaaaaacaaaaaacaaacaaacaaaaacaaaaacaaaaaacctttgtgttggtccgcattcaacacgcaagaggcctgctggccatgggttggacaagcttggaataatcttcgggccacagaggatggagaccctctgctctggagtagccagggacttcagacagactatttagactcactttttcaccaaaggccctacacacatcagctgactgggagagaatatctttgtagcttctgatcattcaaatattgtcaaaaccaacctaaatatgttcaaaataagaatgttaacttgtattttttccaagtatggaaatgaacagtactcttggcagttaacttctgtttttatcaggttctaaagacccaggtaaataaatcaattctggactctgtatacaggaactattatttgccaaaatggccccagaggttccagcatggcttaggcaatactccaaagggccaaagatagtagtgaattaataggattaggaagctggagaaaaagtgaatctcaagtttcagactgtccctgatggaaggtcactccacaattcctcagggagggcttccccaacctcccgaccaggttaaatctgcccattagacactctggtgtatgaaatactttccttcacgagcagtgggttatctgttactaactgatcagtgccattcttcctaccagatgacgtgcttcatgagaccaggggccaggactgggtttgctccccattagcactgtggtcacttaacactatgcctgccatgtaagagatactcagtatatatttgtttaatgaatgaatgaggcatctgcctctaagcaacagtatttctggacacttggcccattttgcactatccacgagcttctgttgcttagaagaatacaggataggaaaaaaagaaaaattgccaaaaatctatggatactgaaatactaaggaaagatgctgagcatgtacattcactttgtttcctacttgtggaatggaaatcatcacattgggatctcccaactttaaaatccgaagtgaaggtctaagctgtctttgggttagactcctggaaagtcttgaggaaattcctgaagtatctgcagaaagtgacaggggagggagaatagaagatggcccaagactagagtgatggaagacttggaaactcgaaaagctttcttctaactaactgggactttgtctacatgccagctacaggctcaggcacacatgaagagaataatgagatgaatgggaggactggaaagtggaggatttaaatgcttaggaaaggagccaatgaaagctgacacaaggacaggagggacctagcaaccaagcgccggctctcatcacatcagcagcagcatgtcctacagccttcaggaaaagaacaaaaaggtcagggaggaaaatgacacatctcagaaccaaagggcaattcattatgaggctaaggaacaaaggagaagtcaaccagggaatatgctgaagaaacggtgattatgaagtcactggggaagactgagaggcattttggctgtagttccaatgactagaatgaaggatgatgtgaaatgcttttggattgggaagatttattattttggaaaaaaaatagctcaaggaaaaacaaatggcaaaattcctgcctgaattttgaagtagtgtcactagcaggatgaggttcaatttatacattctttagaaatgaaatggcccttggaaaagacatagtggtaagattcgcaggacatttccagccttacggaagctgagtagcatgctgatagtaaaattaagtttcagttttagatagactgacatttgaaattaacaaaaaaaaaagtaaagggaaaaaattaaaagaccctgaactgacaaaaaaaaagaaaaaaaaaagcaactactgtcttttttttttaaattaaatgtcatcacaaacaaaaaaaaaaaggtgaaagttgagttgtattttgggcaatcttactgagtttacaaaatgtttagttcatagcaggtttcagtttggacatgaacagtttgtaaatatttacataaaatttaaagataggaggacagcagaggtcatatattgctattaacaatacagaagcgattttccgtcattcccaaggccttggtgctgcgttcccatatgtggccccagctctgccaaaagcttgtcttcttttccaaagaaattccaatttttgcaaccagcattgacttctgaactgtgagtacctctgacagggtcatatgtcgctgaaacttcttcaacatccagacagggaaaggagaaaaacagggaggcagatttacagcgtctgctatctgaattgcagattttgacaaatatgttacattttatattgttctctgttctatgtgagggcagggaccatgttctctgtatgtcacagtcctacaccatgcccagtcattgattcaggactggactgtgtaatggaatggggaaataaccttcagacattcaagaaaacatgcactatattcagattaagttcattccaacatgagattagttcttccaactctgcagaatgggcaggcacgacacctacttcaaagggttgctttgaggaatcaatgaagtacattcaggcaaggtagtcagcactgggtctggcacatggtgcggattcagtaaatcaaaactattattttggtgagtgttctcaaatgtcaaactcccatggaggtcctcaggcattacccagccaagttaccccatctggtcagtaacaactaaatagagggcaggtggttcaaaagtaatggattattcacctgcaaggaatcacactgtactcatggtattaaattattcggcctttcatgtcgaattctctgttaaaaaggaagctgatcaatccctgagtgggactcaatgttgatttgaagttttgtttttttggcatctttctattttccaggtagttgtaaccattcattgggtgcatactcacaaatcatccactatatgccaggcctttagaaaacagagacacacaaagatattaaacaaaaaaagatgtttcagtctgttcagtagtgggagacaagcagcccccaggccgacactagctcttacatatgctttcatccaaaaattttttaaagatttgagccaatatttaaaaatcaggaaattccacataaatatccaatattcagcttcccctggaaaaatcaaatgatgtggcaacacaaagccagtagtcctaccaactgttccctagcaagagtctacaatgagttgagtaggggcggcctgccactccacactatgccctgctcctcaccagaaccaggtaagtacataatttgcagggctcagtgaaaaatgaaaacgaggggccctttgttcaaaaattattaagaatttccgaagaaaacagcagaaccttataccaaatatgaggtccttctgagcagggaagaggaagggggcctatgtaactgcacaggtcttatgcccatgaagctagtactggctctcaccccctggacacacaggaagatatttatttatctaagtattctctcattcattaacaatcaagcctgcatttacaataagctagatgtcacacccctgaaatctgaggttcaaaaactagagtagaggggccaggcacagcagagatagagagccactagggtctctttcctttttgttaagactggatccacaccagagacactgaaagttaatccaagtaaaattaaactgctctcaacaatacagattggcttgagcccttttgttggcatcacaggagcctcgattaggaattctgagaaacagctcacaagcgctaatgaataactaagtcctgtcggctgtgcagacagtgggcccagaagtgaagggctggcctaggagagatctgaacatgaacctgaccatctggccctctgtgactcactttgatcacaaaatgaattgcaacaaattgaagagcacatggctagagttaattgtctcatctgtaatctgaatctacttttaagcagttattattaccctctatcaggtggaaacatttcctaccatcactgcaaagtgcattttcctgatgaactataatggatcattaaattccatatctgaataacaatactgtgcacttattcagtgcctttcatccagggatttcaaggcagtttgcaaataattaagccccttacacagcagccagaggtgagctactggaaaagaattgcctgaagatactaagtcaaagggcataattcaataggaaaataataaatggctttctcccaggcactggtaatacagaaagtgaatcctgatcccctccctctctttcacctcaccccttcttcttcatagcagatcctgacatgcaacatacaaagaaccaaaaaagtaactaacaggagtgttcacaatttagctatgagttcagacacacacttaactgagaagtgtgtgtctccatgtaatcctggcaaacacactaccaactgacatttcagtccacctgcagaatagacagacagcagaagaatttactcaacacattcatgattaccaaatggcaaacctgaagcctcctgcaatgcaaaacgaaaatacggctctgcaccaataaagttatgttctaacaaaaatactttattccatggttgtgtgttccatttctgggacttcgctctatttcaatgatattcaggtttcgagagtaaaaaaaacgttggaaatgggcaatcaataaatttctttcaaaaaccagaatactagaagggaaaacatttcagccactcaaagttttgtggtgaaattataaactccagaaaaactgaatttataatggaaatgctgacagacctttcagtggagcagtttgaacgcaacactgtaatttggcaatctctcttacagactaaagactaattctaacaagatgtcattttgactcacgtttattattacctgcaagaatgaaaaacgccgtttactcgggaggtgcccgagaaccagggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactaggcaggaaaggatttttatctaaagtaattaccctttttagttaaatacactcaacagatgaaatttacagagagtgagagactgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccctcgtgggcacctagggtagcccgtgagcgccgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccggcggcggctgacagctgagcgcaaaggcgccgcggccaaggtcctcgcggagcagcccgggatgcgcacgccgagggttaaggaggaggccgcccggcctggagctgggatcgcaggctgggggccgggacacccgggcctcgccgggccgggggcagggccgcgggtctgacagctgctgcggctcgcgcggacgcgcgcctcctgcagcccgccctccccatgcctgacttattactctctgctcctcctccctctgctgttccaaaacacccttcgacgccagcaaaatacaatgcgcctcggccgccgtaaacagccgggagggagagcacacattcggcgcggcgcggccgccggctcggctcccacccccttcccgttcctagaaaatgccataaaagcgggcagggcgcggggagggcggctgcgcgcccggcggccggggctcccttcccgcgccgtttccccacgcctccccgcccgccccgcgcgcccgctccccccgcaaacttgccccgccaccccgcccagcggcggggcccggggcccggggcccgggactcacctcgccggagaactttgcgtccttttccgcctcctcttccccgcgtcttcccggctcgcagccccctcccggcagccggcgaggtgggcagttcgtgggtcaccgaaagctcgcggaggggacgcgcatcacatggcagctcgttcccagccccccgagtgcgccgggaagggggaggggaaggggcgaggggaggccggggggaaagcgagagcggggcggcggcgggagtgggcaggcggggtggcgagggcggcggccgctcacgttagcgctgtgcgaccgcagcccgggcgtgcacggccgctgctgccgctgctgctgctgctgctgctgctgaggcggcggcggctcggcgctgttt

SEQ ID NO: 1542 - DNA, 26448 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggtgagccgggcccgcggcccgccctggtcggtggcgccacctcgacggcaggcggcggggagtgggctgggccggggggacgcgaggcggcggggcccgggggtcggcgaaggcccctcgcgggcggacaccggctccgcgccccgccacacactcccgctgcgcccggacgagtccccgctccggacccgcccttgacaggcgtcggggcgaaaggaggccccgggattcggtggcccgggaagcgaccccgcagtggctccggtgccgtccacggctcgactccagggcggaaggccgggtgtccagcgctggcctcgcgctctagggctgggagaggggcggccggcctggtcagctccggaggccccggcccaccgtggcccctgctgcccgctcggcctccgggcccgggacccgcggcgcaccctgctgaccgcggactcgagggggacactcgcaagcttggatggtggttttggggggaattttaccgctcaagttctccaacttggttgaggggtatcttggctactgtcccatgttaggcacccaatgactctggaggctggtgtcaaaacattcatatatatatgtgtgtgtgtgtattttaaattaaaattgtattattgtttgaaagtgctttcaatatgaacgtatcctagtatgatttgtaaaataaaaaacagggtgtgcttctccccagcagtttctagagatctagactagagatctgagactgtcttacagttggccattgccttaccacattgcctcacactggagagaaagagaatgatacgtgtatatttataatggcattcgcttcctgccttgttatggtattaaaatacttaggatttgttaccagtacacaaataactgactaatgatactcttgtgaatacagcagaagtatgtctcatttacatacatgcaaggatatatacttcttaatccccaagagcatgaaatttgaaaatgtaaatttggaatgagtgtgttaattttcaaaaatcagagttagttatactattctttcaattttttataaatttgagctttcaggataaaaagtttttaaaataaatatgttatacttaaagctgaattgttaacgccgtctgggcaagataaaagcagcaaagagctggtaaattattttgaagatttaaaaactcaccaaattaaaactgctgtgtaacccattgttttagaagaaagacctgtattatttcccttcatctttatgcactttttgttttaacaatattgataaaactccggtgcccagcagtgagaccgtgtacaggcagcagtttacatttacgagagattagttgtatatttattcttgaaaattagtacaagaggctgtaattagctgggatgggcacagttacatatacctttttgtgtgtctgttccacccatttttgggtgaaactgacactcatttcaaaccacctttcttaggagtctgcgtggatgtacatgatctttagtgtggtttacaactattattttgaagccttcttcctgtagacatagggatagtggtatctgttggcagcctttgttgtgagtgaagatcaagtttgaacataaacattcccagcactttgttctcagcatgaaacttacccagcaagttgagatcttcctgtacccacctggtgcatgggttaggctgtgatttcataaaccttattaaaagaaaaaaagcaggtttagttaccattattcttgtcagcaaatacaaagaactactaaatcagaagtctgatgctgggaagatttatttgaaaatttcacggtcaaaattttaaagttgaaatgtccttgaagatctcttatgttaggcttctttattttctgaaacccagagagttcaggtgtgactttgaaggtcatccagctagtaccaacaacagggagagaactagtgtcaggaaagtcctaataagaggcagtgtgtctcttcagaagttggaagtgagtgttttgggaaactgaggcatgcaggctagaatacttgattatttttgtgccctcctggccaccaagttattgggtcactgacctctgtgctgaggttgcttggattttgatgatgggactgatgaactcaagaaaagagttccctttaccaagtgaatgacttgagacttgtcagcatggcaccaaaacttaaggagaaaactaacattcagcccatgagctgtttgtgcttcattgctttcaatcctgtgctttgacacacacaatatcaggttgcacttgtgtgagttacaccttactggagactaaatgtagtggaaaatccttgaatatcattttgtatttgaaattggcttctcaatgcataatgagaaaaaggcccttgcagaaaacaaagggcgattttggaggagctgagctgaggcccgtctgagcatcatcatcttcaagaggaaatgctgtcaatcagtaaaaagctgttcattgagcatgaggagctcaagagacgacctctcttttgggggaggactcagcttcaggatgtttaaaatttaatcacgttagtaagaaaatggaaagaaaagactagacctttgtattttatttcgtcttctactgccgtcttgcagttgatcttccgccttctcctgaagtagttaggacaactccctgttttcacagaggggcagagcgaaagcaagtatcttctgtcattgctgaagcaggacggctcccggcaaagatgctgggcttcatccagccccattctaagcagctgggcctccccacctgcagtcttcctggattttgattttctgcacacttgggcttcccactaatttggcaagttcataccagtccaggccctttcctggcagaggatggcattcagtgctggtgcagccactcctccaggctcctccctgaataaacagaggccggatgttctggagtgctgttcccgccaggcctccttgggatgagagggagaccttcctccctcatggagcagggccgctctagctccatggatcttgggggttaccagtctggcactctccagggagtcctgttaagaacacagattgtggctgtgtctcatcgcctccctgccccaaccccatgttcaaatctgaattgctcagtgtagggcccagaaaactattaagtccagaaagcttttttggtggttctgattctgctgcactggcagtgggagccacggatggccagtgatcccattttggggaggaggagctgcggcttagtgcctcctgaacatctatcctgcagagcattttcccaagcctccattttccttcttggggaaactccccaggtacgcgggcttctggaggtgtgaatatggggatgacatgggaagcgagccgagacagcaccttgcaaagtctggcagggtggctggcagtgcgagagtggggaggtggtccagagatcttcctggaccccaggaagaagcaagccagagccttttctttttgtcttgcccatctggcagaatctcaccataatcatttaacagattatactcaggcactgtgacagggagatagaaacatcctttcagataacactggaaatgtttcgagttatgattgaagtagagagacccatttattttgcttaaggttcagcagagcctcctgaattttcttaaagatgagatcgttttgctctttccagatctattgcaagctgttatgcctcttagcagaggcggagcacaatcaggaaatgagtggccgttctctccttcgtatttccagcaagttgcagttgtggctgagcaagttcctgtgcgactgcatgaaagtgatttgttggggggcagatgaacagcatggccagatgccttggagcccagctcatccaggactttcattttcccctctgaagaacagcctgtgttgttcacatgagaaccgactgcacctccgagaacatcatttgtcccgttttgtagggtagatttgccctttatgagggtggagcctgtacacaggacctgcggcagcgtttgacgttggccagggctgggaaggcttaactgttggatgctatcagggctgcttgtgagtcagaaagcttcataccacccatgaggcttgcttagtgctgtcctcgtttctggaatgacacacagtcaccttatataaaccactctacatgtttattactttctattgacatttaaaaatgatgttctgatgtttatcatccaaagtagaaaaccattcatcatccagacctactctttctcctttaagttttgctgttttaatattgctcttaaatgtttaagagagcttacagaagaaactgaagacaaaggccttgcttattaggatctttgagaccctctggcactggcgaacacgagtgaaccctgtgtcacacttgaccgtgttattctccagcccctcctgggttcccttttgttgtgagtcaagtagacacctctgatctgcttctgcctcagagcatagactcagctggccttcttttttttttttttttttttgagacggagtcgcactttgtctcccaggctggggtgccgtagtgcgatcttggctcactgcaacctccgtctcctgggttcaagcgattctcctgcctcagcctcccaagtagctaggattataggtgagcgccaccatgcccatcagccggccgtctgaggcaggctccagagccccttgttttgcaggtgcaggattcatctgtatgcatcatgtggcacatgtgataccatgtgaggtatctggtgttactaagtcgtcacgtatttcgatgaaggtatctttgggaccttggcagccttttaggaagccaggcagcttgcaaaagcttaggaagaatttggggggagaggaatgaatgtagtatttttctgtctgtcaacacacacacatatatatatatatgtgccagatatgagtgggtgcttttggtaaccttatctctaaatcctcaccagctctttgaactagaaactatgaagtgtcttacacatgggacagcagatttggagaggcagtgtgcctggcctgtgataaacagaaagacttctgtggctttacccccatctgagttcctgaaggggtgacagacagacttgcctttagcgggcctggctgctttatactccccaggcacggctgctttatactccccaggcacagcttgaggtgataaacagccctgagtccatctttgtatagttaatcagaaatgttggcctgtttcttgaacctgggtctggatttaggagatgggcccgactctttactcactcctttaccccatctgaaattcactgagtgcccacagtgtgcgagtcacagtgttaaatgccatatagaggacaagtctgcccactttgagactgttctccacaaagcatgtcctgcctctccctggtccgaagcaggctgtctctcttctggaacccatattattttaatttgaatctttttgcttaagctctgcacttttctgctttgtcttggggtcacacccctgttaggagttctggggcagagtctgtgtgcttcatcgctgcctcttgatgcctggcagggtccacaggctcagaaaagatggaacgagtgactgtggagaagggtagaacatgggcctgcccagagcgcgaaggcagatacagaagagctgcccgtgaaggatgcaggtgtgtcccgggaagccttccattggttcctaagaactgcagagttgtcctgggctcctaaaggtccccagaggcctgctcctttttgtcactttgtgaatggccttctctgcacaaaggacttcagtattgattccctaagttcatccttacaggtctggagaagctcttttttgtttctcccaatgacacagcatcttacagcagggctggagaggctgggagctggcagcagccagaccctacttccatagctgtgcagagagcagcccctggcactgtgaaaagagtctcttaaaaattttttttcgtgtggctggcagcaagatcagacaccgtatacgtgaaggttcttattcactgtcaattcagaaaagcctagaatcgcagagtgccagctctgtgcgtcaggagcctgtaaacagctcagctgtccaagagctcccagcacagagctgtgccccagtgaactggggagactttttacggaaaattccttagcattcaattggagaacaaacgtttgctgttttaaagtatcttcctcagtgtttattaaagtagaattatatatttttttcagttatttaaaaaattcttccttgacattgaatgaatgaataaatgaatggatggtttaaaaattcatacagtgggaggatgggaaggccccttcatgtgcagaagaaaagccagccccttcgctggcccaccctttcagggtcagttcagacccccagcatcccagcggggttagcactccttcctgggttggacggtgtcttccccggttctgacagcgctccatgccgggcgtccctgcagtcttggggctgtggtgactcagaattaagctgagtgctctcactctcgtgtaccctgcctggctggcctgatgactcagcatggagcgctggctccctgacccagagcacacttgaactgaatgttccaggtctgagcctcagccgagcgtggctgggcgaaatggaagcctttctctcctgctgcctctcctgctgcattttaccccgggagatgaaggttttggagacgttagtgacacatggatgttatcacagtgtacagctgtgacaggagtagcagaaaggttagcatctacctggccttaccatcagacaaacctgggttctagagatcttaggcaaagcacttacccttcttgagcctcagtctcccgttgtgtgaagtgggcatagcaacacttctgttagcagggttgggagaatcaaggaagatggtgtgtgggaggcgaacgtcccaaagcctgaactgatgcatgcgtggaactcccggaaacatatgcagcctgctctgtggagtagaagtgtgtttgtggataggtgtgtggcctctccacacagcagactgtcctggctgtccgtgggcctttcagctctcagagaggcctggggtcttgtttcttagaagcaaggcctcctcttatcccccttgtatggagtgtagctgactcccccgaccagtgtccaggtggcccttggagccctccctggggcttcccgtgccccttgtgagtggaggatgtaaaggaacagtaacagatgaagctgcggggccttcgggagccttgacccagctgccagaccctgcgccatgcgtccatagatgcatctccccatcctctgcccaagataggctgggtccttgtgtcctccactgtgctgtgtagagcgctggctttactcagcctcagctcctcaaggggagggtctccctcagctgtgtctgtgcagccgcaaagtaccaggcaggagctaggagcgctgcctgtgaggggggacatcagcccaccttactgaggggccgattacctgcacagctcttctggacccagctctcaggggtgtaaatgtcaccgcagatggaaggaaggaggggttttccaagtgccaccaccctcttctggggggtgtggctgctgtggaccgaatgcttgagaagccactgcaggtgggagcagagcccccccgggactcaggggtctcaccgtccatcagagagggtccccttgcctgcatggcagctgatgaactgaggatgtttttcttttggaaattgtattttgtacagaatacacgtccgctgatgtcctgtacactgagacctaacaggcacttgtagggtcgtgtctggaggatggacttgccaggtggctgaccattccatttagcatggaaatgtagcagttgagagaggtccttttccttgactctgtctaaattcagagtttgcttcctgggatggaaatttcagatagtttccatctgtgatttgtgactttggcttgattaaagcaggtggctccgctcttttttttttcccctgaagaagaggtaggtaggttctaacatgccctgaagctaacttcatgtgaccttgggccacattccagttcctacctctgccacatggaacccgtgaggcaggctgcagggctggggctgcagggaggctggatgctgactcaggtgcccccagcaggggaaataccagcagctgcggatggtgcctggcctggagacggctgacgtgtgccctggtgaggggccatcgaggatgttgaggagacgccagcagatgttctgctcccaggcggacccttctgtgccccagcctggcctggcttttctctctaggcctcagggagatgtgtcaaggaaccacagtcagtgcggctgggcgccctgctcagccaggagtttgtctgcagagcaggcctcttccccagagcagcggcccagcctgttggagaggtgggtcgtttagggctcaggtccctagagttgtctttggctctttgcttccaggctgtgaaactttagataaagtcttaagcagagaaagtgacatccttgctaattagtcctcttaagactctcagataaaggggcttctaattctaactgtcttactaccaacttggtgagacagactaaagaattaggctttgttgaacagggcgcggtggctcacacctgtaatcccagcactttgggaggccgaggcagatggatcacttgagcccgggagttcgagagcagcctgggccccatagtgagaccttgtctctaaaataaataaataaataaatatttttttaaaaaaagaattaggctttgtaaacggtaagcccaaccagctagtgctggagaaaagctgagtccatcaataactatttgtggaataaagaaatgcaattgtggctgggcgtggtggctcacggctgtcatcccagcactttgggaggctgaggcaggaagatcacttgagatcagaagttcgagaccatcctggccaacatggtgaaaccccatctttactaaaaatacaaaattagctgggtgtggtggcacatgcctgtaatcccagctactcaggaggctgaggcaggagaatcgcttgaacccgggaggcagaggttgtggtgagccgagatcatgcctttggactccagtctgggcaataagagtgaatcttcgtctcaaaaacaaaaacaaaaattagctgggcgtggtggcaggtgcctgtaatcccagctactcgggaggctgaggcatgagaattgcttgaactcgggaggcggaggttgcagtgagctgagattgtgccattgcactctagcctgggcaacagagcgagactcagtctccaaaaaaaagaaagaaagaaagaaaaagaaacccaattgtttagggcacagagcagctcagagtttacaaagacttgtaccttatttcgtaccttatttcacttaactcttgcaaaaacccctgggaaatatggggatctttacagctgcggaaacagtagcaaggagtcctgtccatggtcacacagctggtgagcatcaaggagggactggaacccagggtggcaccttgaagacccgggctcatgctggttcattcctgtttatttggacacagctgcaaagagaagcaatgttggtttcatcttctaaaaaaattttttttcccattgaaaacacatagggacagtcatctgtttattccaggataaaatgtatatatattttagtaacaggcatattagataaagcctccagtagcctgtgacttatgatagtttatagagtatgtggttggcacacacctcttgtcttaccaggagtctttggacaaagcctaactcctcaggtgtcctgtaagtggaatgtggacttagtttattattcagaattttccccaactctattatgtgcccaaaatagtgctgggggagtgggagagaccctgtattacaatccagtggggactgaagggattttgactttggctgtagggatgttaatggctgtttattgtgtatttcagtatcaaatgggcagtaatacttaattcattcatgcaccccatcatagcaagcagagagcttcggtagggtgctgaagctcgactccagttgcactttgttttttgttttggttgttgttttaattcagagcctcactctcttgcccaggctggagtgcaatggcatgatctcagctcactgcaacctctgcctcctgggttcaagcgattctcctgcctcagcctcctgagtacctgggattgcaggcccccgccaccatgcctggctatgttttttttttgttttttttttttttgtatttttagtagagacagggtttcaccatgttggccaagctggtcttgaactcctgacctcaagtgatccgcccgcctcggcctcccaaagtcttgggattacaggtgtaagccaccacgcccagttccagttgcactttggaagaaagtgtgttttgtttgtttcctgcctgatggaggcgagccaggccacttaattttgatccaggccttagccatatggggagttccaggatttctgtgttcttgcatcttttttctttgttttagaagttttgaagtgttcacttgacccatgtgaaggctcttctggcctaaaaacccagttaatacagtctgtgtcctacttaataccccaggcctgccaagtcggaagtgctacgagacagccctaagagttgcctttgttactgtttctcctagttcagaccagagtgatggaagctgtggtttgtagatgtggagcccactttttaaagagcactgtacctggccaggcgtggtggctcacgcctgtaatctcagcactttgggaggccgagatgggcagatcacgaggtcaggagatcgagaccatcctggccaatatagtgaaaccccgtctctactaaaaacacacacaaattagctgggcatggtggcgggcacctgtagtcccagctactcaggaggctaaggcaggagagtggcgtgaacgcgggaggcggaggttgcaatgagccgagatcgcgccactgcactccagcctaggcgacagagcgagactctgtctcaaaaataaaaataaaataaagagcactgtaccatggagccaagattggggctcacagaaggtgcccattttcgggtttcagtgaccactcagtgtgcagggagtcagttgtgggtgggtcaaggtagattcttctccacggctctttcatgaacatgtgcctggcgtacgcctctctaggcagacaccttgcaggtgcccaagggttgtggttcccaccctgcttttagggcacagggttgggggttagaggcttccttctcttcatttgtttttggttttgtttttttgttgttgtttttttaagacagagtctcactctgtcgcccaggctggagtgcagtgctgcaatcttggctcactgcaacctctcacccctgggttcaagcgattctcgtgcatcatcaacttcctaagcagctgggattatgatgcccaccgccacggccagctaatttttgtatttttagaagagacagggttttgtcattttggacaggctggtctcaaactcctgggaatggatctgacctcagatgatccacccgcctcggcctcccaaagtgctgggattacagacatgaaccaccggacccgggccctcctcttcatctgggacatgaaactttggggtgctctgagttctggcagttctgatatgatttgagtgtagttaggagtagtcgtttttagatttctgtgacattaacttttccttgtttgggggcttgtatagctgttgagagcttgaagggactttggaaatcaggccacgcagagtgtcagagctgaaaggaactttccatcatcgtttttctcactgcggacctttaggcttcctcacacacctacggaatcagacctacttgggttgggcttaagagtctgcaatgtttgcatttcctgggtgcttcgataccccaagtgctggagaaccactgctttctagaacatttttgggcctccccttcattttgcagctgagaaaacgaaagttcacagagggcatgtgagccacttccgtaacacatgtatttaggggcagagccagcgttaggaccaagtgcagcctcttccgagctctcctgctgttccctcagcgcccatgttgctgctaaaaaccactagtgcagtttagacctgctcttaagcaaacgagcccaacagctcaccaaagctcagaacctgacctcaggctttctctaatcataatatcttgtacataatagggcaaattttgactcatctggggtcatttttttcctgctttctatcttggccatctcatggagttgtttggtgccctgagacatgcctcagatttttcagatttttaatgcaatgcacaaacaagggggcagaattagccaattcattttataaattaatatagtgagataagcagtgagagtcaggactgagcccctgggctcttctttcctaattggattttgtataatatgtgttcctgatgtctttagccgagataaggataatgagctctgagctgcaggcgggccctgatgaggtggccatgaggatcagcagtcatctgcttggtcaccgtggttgcatcccagtccctgtcccatgatcacacagagctgtccccccaactttgaggaggcagattccgagctcccgcttgaatcaggaaggggcacatagtaagccttatctgagagatgctggtgtaaccaagaggcattatctggatgtgcttgaacttgaaaacacttagtagactgaagagacatgttttagtcagattctagaattataaatattacacattttttcttttgattcttttatttacaaaatatctctctttgctagattgtgttgaaaacaccatagaagagagaaagggcaatttaactcttccaggtggtgttttttgtgtgtgtgtgagagtttttttggcagagtttcactcttgtagcccaggctagagtgcaatggtgtgatcttagctcactgcaacctccgcctccagcttcaagcgattctcctgcctcagcctcccgagtagctgggattacaggcacccgccaccacacacagctaatttttgtttgtgtgtgtgtgtgtgtgtgtgtgtgtgtgtgtgtatatatatatatatatatttttttttttagttggagtcttgctctgtcgcccaggctggagtgcagtggtgcgatctcggctcactgcaagctccacctcccgggttcacgccattctcctgcctcagcctcccgagtagctgggactacaggtgcctgccaccatgcccagctaattttttttttgtatttttagtagagatggggtttcaccgtgttagccaggatggtctccatctcctgacctcgtgatccacccacctcagcctgccaaagtgctgggattacaggcgtgagccaccgcgcccagcctaatttttgtattttttttagtgaagatggggtttcatcacgttggccaggctggtcttgaactcctgacctcaggtgatccacccgcctcggcctcccaaagtgctgagatgacaggtgtgagccaccacgcctggcccaggtggtgttttttacttagtaaaagcggaagcatttgctgttgtgaccctaatgatagtggatgggaacattagaatgtggcatcagcattcctggcatagacctcattacgggtgggagtttcatttttcattggaattattcattcatgtagaagtgtttaattgcctattttgtgaaattcatgttttttttatttaaagcaattttttgttgttgttgtttttttttaaacaaaaccccaccagagtagaaggggagcctggaacgtcttttagatgcagtgctcacaaggagacacttggttttttattaaatggcaaaaatgggtcattaattcacccaagcccaggaatacagacctcgggactgttggagaagcagccaggccgcccttgcctgtcctgaccgtctctgctttccagctgtgccggcaggcttggcctgttcagtggacctcacgcacggtggagacctttccccttccccccacatgcctctcatttttctgggtgccctttaccctccaggccctctgccctgctttgtgctcatctcctcctccctgacgtccttcttcacttcccagcatgtcctggcttctcctttccagtccctctgtcttgctgaggcatctcctgtgatggttggaacactcagaagggtggacctcagcccccacttccagcctggcccctggtctctagcctcatctccctcagctcagcactgacccccaagcctgccccttgccactgcttcccaccactcttctgacaccactgcccctgcctgcagtgaccacattccttccccgtggaccaagccatgtctctggaaaggttgaatattggctccagcaagcagtctctgctgtcacagtcttgtgtgcagacagagttgtttttccttcctccctctctctcctgtcttattccccttctctttttcaatggaggcacaaaatgtgctcagcgagatgcacgaggtgctcagcgagatgcacgaggtgctcagcgagatgcatgaggtgctcagctcgtggctggctcaagggctttctggatccaggggcttcccccaggaggagctgcatctcctcaaggcctgtctgaggactccaagccctggaagggtctggctataaggggttgggatcagcagctctcccagttaaaaccagagagtgtgggtgggatgtggcagagtgggcagtgtgggggtttgatggagttttacacagccatacacccatttaccactgcccagaaaaagagaatattcccatcacctcagaaagctctttcgagacccttcccagccactaccatctcctccagaagtgaccaccattctggtttctagcaccatcgattcactttgtacttcactttttcttttttttcttctttttgagacaaagtcttgctctattgcccaggctggagtacagtggcatgatctcagctcactgccacctctgcctccggggttcaggtgattctcctgcctcagcctcctgaatagcagggactacaggtgccccccaccatgcccagctaatctttgtatttttagtagagatggggtttcaccatgttggttaggctggtcttgaactcctgacctcaggtgatctgcccgccttagcctcccaaagtgctggtattacaggcttgagccaccgtgcctggccctatccttcacttttgattcctttgacactttggagtctgaaaagcataattttgtgcgtatttagggagaaactcacatttattgccagtcttccgggcatccctcttgatatgcccttataaaacctcacaacatttctccagggcaggtgttggctagctccgttttctagaaaaggaagcgaaggcttacagaggtaagagaattacccaagctcacagaactgttagaaatagaggtacgaatcacacttagaccctacctagggcagcgtctaccctggaagagcctgtgcctttccccatccctcagggcctccgtgctttccaagtaattctgcttcttgtttgtttcctgcccccttagcccatcttctaagcccctgttggcagggagtgccccttgctggtttggtaaccccataggactcctcagcgggtggcaggatgttcccccaggtggtggatgagggtttgctcactgctggtccctgctgtgtggagtgtgcagatggttgaggcttttgtgcgtggctgggaagaaacaatgagcccctgggcagccagcaaaaatgacactgcaggactaatgcaggctccgatttcggctggaaggaggaggacctcagtgagtggacagaatgcccacaggcacgttatgactcaacactgagtagcagagggtttcttcagcgcctcttgctggctccctgtcagggccatctcacggcaggaattcagctctgaatgtgaggcctggacctgctcctgctcttgggtgacctgagagttaagcaggctaatgtaatgccgccgccctgagcacgtggctgttctaatctgagaatgcctgtctgcccatgtccccaaggacacagtgacacccatgcctttcctgtgtgctggaggccctccaagggcagggtctcagcaggagggaggcagttgatgggcctgaaagggctaaaccagggtcagccacctggtgcccacgcctgcacacaaatagaaacatcacagaattaatggtctgttctctcaaagtgcagagcagccctcagtatctgtccttacttttgattgattccgcagcagtagagattgtcccctgcaagctcatagattgttagcctttggcgtttgttcgccgtgcagacagctgccttcgtcaggaaagatcactccccttcttaagagttgccttacacagatatatgcaaatgacacttatcagtagctcccctcctgggaaaggaccctcggtgctcggggactgttaggacttctgttgcgcagcccagcttgctgagagatggcattgcccagtgagtgactggccagccttgttgtctgaaataagatctttcctgtggtacatctggaacttggccttctcaagggtcccaaaatagccaggccactgaagggagaacttcaagagaggacataagagaaggaccccaactgctccttgcccaagcaggctctgttgcgttgaagaaaaagttcttcagtgatacttgttaaagcacagtcaggaagatttattcggggccatcaagataggcacagggaccacggcagtggggtcgtgcagtcatgggtagagactgggcacaacttcaaatacaacacgggcgattgggaatttatagtcaaggagcagtgtggatggaaaattagaagaggaaacatcagggctaagggtgtttctggctatgctgaccaaacaggattcttgccgaagacaggccagggtgattagacagcacctggaggctgtggaagctgatcagatagtgaggctggggagggggtttctggctaaactgacttagcagtgtcttttgctaaaacttgactttacaaggaagtgcacagatgggcctaggagatgcttcggaagcctaagatttggtcaagcagagaatctttgtcagttggcatcgttaggcgacacagttaaccctgggtgcccctctctccctatgctgcctctgcatccctgtccttccccttcctgcaaattgttctaacaatactcctgaggaggcagccctcgctccccagcccacttctctgtaaagattcccaaactgtgtcctgtgtttgggcccagtacaagctctatattgctgggaaatgtgagggcctttttggaaacagagacgcttgctgtaatgtagaggttggagctgacccctgctcctggagctcatcttctgatccgggtctctgaaaatgcgggcatgggcagctctcctacactcaccgcttccctcagtcacccagaaaagaaacctgtcttaccagtttggagaattgggacctttcctttgcttaacagatacttttggctttctcctgatgcccctaattcctaaactgttggccaaatagcaacctctatggggtggggggtttggagggtacaggggctgggagctggctgacgctttgaggcccaagtcactcgggaagatcacaatgccaagcgccacagtgtttcctctgccaggagggttcacttcccagtttctaaccagcctgtgtttctccactttttatttcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgaggtaaggagaggccaggctcaccagcctgctggggagcaagccgctgtgcttcccaggccgggcccatcccctcaggacagtgccctgggccaggcacctgttcacatgcagggcatctgggtctagcctgcagcatcagaggtcacccagcaaagacagggtgatggccccacatcatcccccagcatctcatagggctgttcttcagtggggcagggcaggaatcatgtggcttctttttgtagctaaggaacggctcggaagggcacactgcagcctgcctgctccagatgcacacaggtggagggagcagagctgggaccggaagcctggcctgccttctggcgcctaatttccatgctccttattcacactgggctttctattcagaagcacagagatagctgtgcattattttgttcagttcaatgcttatggataaatcttaaccgcttgtggagctatgttgacaggaaaatgagaccccatgcctgccctcaccgtgcaccacagtttcaaaagaaataaggagtcaggaaggcagctgctttaagacagcattttaatcctgaagccaaacatctcagggatatgtcaatggattctgtgcattaatagctaaaaaatagttcttaatctggttcttagctgagatttgaggcattcctagtaggattcctaagcagtaagtcctctcattttcctgtctgcacatcatcctgtggtgtgtgccagcgttgttcctgggcacaaactcccgtgtcctatctgcaccctgagtcatgcttgcctctcagctccgtctgaatctgttcagcttcacacctgcttgagagtgaaagttacagttaatgtgggataccttttttcttttcttagagaggtagtacctggctgaggcaggtggatcacttgaggccaggaattcaagaccagcctggctaacacggtgaaaccccgtctctacaaaaaatacaaaaattagccgggcatggtggcacattcctgtaatcccagctactcaggaggctgaggcaggagaattgcttaaacccaggaggcagaggttgcagtgagccgagatcgcaccactgcactccagcctaggtgatagagcgagactgtctcaaaaataaaaaaataagtaatgcctatatttataatggttttgctgcaagaaatcaaagtgacacataaatgcgagacatcttcacaaatttaggctaacaaagcacttagaagaggaaatgctctcaatttcgaggtgaatagaaggtggcccagcagggaaaggtgcttgacctgccttgggccacacgggatgctggcagctcccagttgctcagccgagttctctgtagattggcagagaaagggtagtggggacaacacatcccttgtatgagcgcttcctgtgtgctggcctggggctgaggcacatgcccaggtgactgacctcatcttcagagcagcccagtgagggaggggcactcttcctatatttcaaatgaagcttagaaaatgattgaattactaggaatttgaacataggccccttgattccaaagccttcagtctttgttgtgtgtgtgtgtgttttgttttgttttgttttgttttgctttgtttgaggtggagtctctctctgttgcccagactggagtgcagtggtgtgatctcaaatcactgcaacctctgcctcctaggttcaagcaattcccctgcctcagcctcctgagtagctggcactacaggcatgcgccgccacacccagctaatttttgtatttttggtagagatggggtttcaccatgttggccaggctgctcttgaactcctgacctcaggtggtccactcacctaggcctcccaaagtgctgggattacaggtgtgagccaccgcgcccagccccagagctctcagtcttaaccgcacattttgaaaattgaaaattacagataggaggtcttacaatatggattgccctgaggaggtgcacagcagaaggcgtggtcaggatgccaagccaggggagtcatttgtggggtcatgccctctaccctgtgtctcttgcagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcaggtacgggaagttagtcgtcagcagactggttatggtggtatgtctccaggggtgcaggagctctgtgggtgccctgggttcccccttcatccctgcctatttaacatgcgtgtacctacaggcaagtgagattcgagaaattgctaggtattaacagaaatgcaggacagttgctcaggctgtgaaccctccgcactctgcagcttttgctgggctgatcattgtgcattgcggctgacttagagcagacgaaacagcttggcagaacttacatacctgggaccagcttccttagtgtccaccacaccctttcagggctcttcacacccccatccacaccgcagccacagcctcaccttgggtgtaggcagtgtgtcaccttccactcagttacccactccactctgcaggcccattctgctcattcccacccctgtgcctttgcccatgctgaacccgctccctgaaatgcccgcacagtataggttctccctgtcctctgagggacgagccagtcttgtctcctccatgaagcctactcatccttctcatctcatgatgcctcatatgagtcccttaatgagaactcccaacttgtatgagttcaacatgtcattattcggggcatttcagaagtgttcattttatctcttcagcttagggctgagcctgaccacagggcccatgtcttaacccccctcctccctttgtaatcaggtaccatgtggtctggctgaggcatcagccagctatggcggattggaagccgtgctggcctggggaaggttgtaggcaggggtctggttatcttccagtggagacacaaggtgcaggttcctggaagaggatgtcatttagtttaagcagctcacagcttagcagcaggacagtcagcagccctgggccccctgtggctgcaacttgagcagctgaatgctacagtttttaaaaaggaaagccccccgtgaacaaatgtgggatattctttcattacaaatggtcacactggccagggccctggaatagagcaccctcatcttaaaatgttgttttatttggaaataatttcaatctcatagaagagttgtgtgaatcatacagagccccacatatacttcatccagttcactgtttgtcaatatgtctgcattcgccttgtcatttcttctctcgtatattattgatgtgttttaactgtttgaaaattaattgcagacatcatgtcccttttcccctgaatagcaaatattttcctaagaggaagacattctcgttcataaccatggtagacttaccagattcaggaaatttcacattcttacaacattattatccagtacatttttgaatcttttttatagcagtttgcccccacttccaggatgtcttccaggactgaaacaaggatcatgagcaccgcatttagatgcaacttctcttcagtcttccctcagcctttctttgctttcacggccttgacggttttgaagaacacaggctgtggaacaccctctctaaagtgtttctaaagtcacttcttacacagccattgctgttagaacctaggaggggtgcgtggttgggttgtgagtggtaagggccaaagttgcgaatgtctgcattggcgaaagagatttgatggaaaaggaggttgctggagtgtagacagctacatcgatccatacttgggttcagcaatcctaggagggtcccatttgtagagagagggatattttctccacatcattcccatgtgtttctcatcatcagtgaaatgatatttcatcctgttcttaccattaaccgtgtttgtggtgacctcccttttagagctgattcaaagttcccttttgggaggctttccaggatttcaccaaactgaacgttatagtggaattgagtgttttaagctgggaatagtttagaaataatatagtccagttatttcccagttgatgaaattagggtgagattttaaaagaagtgttagatattcacttacatgaataagagccaagataaggccaagcgcagtggctcacgcctgtaatcctgtaatcctagcactttgggaggccgaggcgggggtatcacttaaggtcaggagttcaagactagcctggccaacatggtgaaaccccatctctactaaaaatacaaaaaaaaaagttaaccaggcatgttggtgggcgcctgtaatcccagctactcgggaggctggggtgggaggattgcttgaacttgggaggcagaggttgcagtgaactgagatcacaccactgcacactccagcctgggtgacagagcgaggctccgtctcaaaaacaaaaacaaaaacaaaaagcgtcaagatatttttgctttgagcatagctcattaaaaaatatatggcttactaggcgtggtggctcacacctataatcctagcactttgggaggccgaggtgggcagattgcttgagcttagaaattcaagaccagcctgggcagcatggtgaaaccctgtctctacaaaaaaatagaaaaattagccaggcatgatggtatgtgcctgtagttgcaactaatcatgaagctaaggtgagaggatcacttgaggccagaaggttgaggctgcattgagctgtgatagccccgctgcactccagcctgggcaacagagtgagaccctgtcccccacaaaaatctatatatctatatggctgtagtttatagtcacaggaaaacctgtgcagccagaggttagcacagaggcgctgtgtcattgctgaatgttaggctacagcacagctatcctgaagcaaaattgttctggagttaaccatttagagcatcttggctaatcctaaaaaaatacattggtctgggcagaaactactaggctgtcacggttttaaaaaaagaagatcgtatcttttctaaaacaggagacaagaagatcacaccgtgagcagactgtctgcacagtgtaaggaagaaggaccagaggcagcgactccaaggctgcaacacctgagagctggagtcactcaggactctgctctgagtcagcctagttcagcagtcagcatgagtttttgctatttttttccttctttccttccttccttccctccttccctccccctcccttccccccttccccttccccccttccctgcttccttcccccttcccccttccctccttccttcctgcccccttcccccttgcccccttctccccttccttccttccttccttccccccttccttccttccttcctccctccctcccttccttctttgagacaggatctcgctctgtcactcaggctggagtgcaatgacataatcgtggctcactacagccttgaattcctgggctcaagcgattcttccgcctcagccttctgagtagctgggactacgagtgcaagctcccacacctggctaatttttaaagattttttgtagggttggggtcttactatattgcccaggttagctattttcatttttgaaaattttattgggtttcttttcattgccattaagaataccatctacagagaaattcagtgagaggtaatagacaaatagcctggggtgatcaatggaagcctgactaatgattgggttacatacatgattaataccatgtttttattttgtaacagccattgattgactttgaaaatcttttatactattaaactttttttaaaaagccatttctcagttttctttctaatctgtactagctacaaacaatttctgtgactttcagtcagttattaaaaatatatttttgtgtccttttttcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaa

SEQ ID NO: 1543 - DNA, 11128 bp, Homo sapiens
ttatgcaaagcttaattttattgtctatgtagttagaaaacagtctgaaagaaaactcagtgttaaaacttatctatatataggtgttattgtatatctaaattataatctttgattcaatttttaaaaaggtgtccacaaatttaattttaaagtctgcttctgctttttaaagcaccttccttaaatgtaacctattttctttctaacaccactatttttgctatgcattggaggtgaaacatttctctataatccttagaaagtgcttatactaaaaaaaatccaatctttaaaaatttttaaagctaatatgccaatcttcttcatgtcggataaattcatcagtccatccagaaatgcaactcaatctcacaacctgaagtaatgttttctatagataatggcacgtattaaaaaaagttttagatacttcctactgaaaatttggaactccaaaatagcactcactactttaaaaaaattttattgttgatagcaaaatttccatttctatgtttttgcaattaataatagaaatatataggagacaatgtcaggaaacagataaaattgtaatttaaataaaaacaaacagtgagagcataagatttataaacatgtaaaattagtcaaattttgttttacaacaaaaagacaaatctggctaatggcccacttgttcaaatagcattaaaaacagaattgtcacacacaccaaaaataatttgttccagttatttcaactgtacattggtcctcattaaaagagaatgaaaagtacagagaaaatattttttaaaaatctcatcaggctaggtgaggtggctcgtgtctgtaatcccagcactttgggaggccacgctgggtaggttgcttgagtccaggagttcaagaccagcctggccaacatggcaaaacaccgtctctacaaaaataatacaaaaattagtgaggcatggtggcacacacttgtagtctcagctatattacttgagaggctgaggtgagaggatcacgtaagcatgggaggcagaagttgcagtgagcctagaatgcgccactgcactccagcctgggcgatagagcaagactgtctcaaaaaaaaaaaaaaaaaaaaaagaaaaaaggaaaaaatacctcatcaaattacatgtaataactgaggtttaggccaagatatttttctttaggaatgaaaatgattaagccaagaatgtgaaaatcctaacaaagtagtataattagtaaggttaattagaaatgaattttggcaaaccgagatcttaggtggctcacactccatcaagtgttcctccagtatcaaaaagaggctgtttacatgcctatacgacaatggagtggaaaagagatttttatttttctatattggcagttttcccatcagtgaccggttttattactgaacaggaacagcttaatgctgaaaatttgctgctgaatgactggcaaagactattagactcttgaaaatttctagcacaaatgcactgaggaaaaaacgttcttcctagtaagggtctattctcaaatagagatatattccctattaaaatcagtcttaaaatagaaaatatttaaaaaagtactgaaagaccttaaaaaggaaaaaaagaaattactaaaaagtacatgatcaacatgatttacagttagctatcctagaagtatgcttttttaattctaaaaatcctatttacaaagtatgcttacattgcattttaaaagacatgcatcaaatgtaaacaaatgattacagccattttataaaaagtcatattctttaaaacattttttgtcatcattaaaaattaaaaggcaataaagtgtcattgtcgtgaaacagtacgtgatcttaagggaagaaacatctcactagagtttgcacaagttccttcttcttctaactgtagatctggtggcaaaggaggagcccctgggtccccaggtctgggaagtgtagttgaagagaagatggtattttcagttctgcctacttctagaacaggcaaattcagagaagaattagtagaaaaaaagggcgtcgtgctggattctccttctggatggtacatgacagtggatgccctcagtttttcagagaaattactctcatctgaatttgatctggagaggttgttcgtggctccatctggaaaaggttcacaactgctacattttagtcctacaataaaattattcagatgtaaatgaaaaagtaactaaaaaaatggagtcactgtccatcttgtgacttgttaaagattacaagctagttaccccacaatcaaaatttaaatagcaacttgtaatttccgtcataatctatttcaaatctaatttgcttttctcaacaaccatgaagtatactattatttgcattttctatataacaaaatagtctcgtggaagttaaacgacatgctgtaattctcatttaaggtacagcgtacatataaacttaaccacctaaaattttttataaaataagaaatagctttcacaataaatattctttagtattctggtacaaaaaatattagctaataaaaaaatgtaaacggcagatgctaaaattctatctgttgatcaatgacaatggctaattcttgaataataggatattagaactaaaaggaattttagaggtcacctaggatagtctcttattattaaagacgagaaaaaagggcggggcatggtggctcacgcctgtaatcccagcactttgggaggccgaagtgggcagatcatgaggtcaggagtttgagatcagcctggccaacatggcgaaaccccatctctactaaaaatacagaaattagccaggcgtggtggcaggtgcctgcaatcgcagctactcaggaggctgaagtaggagaatcgcttgaacctgggaggcagaggttgcagtgagctgagatcatgccattgcactccagcctgggtgacaagagcaagactccgtctcaaaaaaaaaaaaaaaaaaagagaaaaaaaaggcacaggacagttaagtcatgtccaacattccaggactactttgtgggaaagtgagaactacaattcaatagataatgtcctgtttctcaacctcacagtttactcaaatgacagtggttgttcccattagctgtggtacgaatgtatccgccaaaagttcacatgttggaaacttggttgccactgcagcagtgttaggagctgaggcctttgggaggcaacagggtcatgagggctctgccctggactaatgccattatcacgggaatgggttagttattttgggagttcgactcctttttcttctctttcacactcttgccctcccttgctcttccatcttctgcccttccaccatgcatgacccttgccagatgctggcgccatggtcttggacttaaccagcctccagaactgtaagaaatgaatacatttcttttctttaaaagttacccagtctcaggtattgctacagcagaaaacaacttagataccatcaaagaattttatgatatccaaagggtatagttaaccattatccagaggattgaaagaataaacacaaacacaatttacccttctgttaggcttagcaaatattcaacctacaggcacagaaaccctgagttgacaatttttaggcaaaacctgcatagtctataaagggcacttacatgtcacttcttccactagtttttcaacctcacagtacagtcagcatgtctattccatgctatacaaactactttcttagatatggctcaaaagggaaaacttgtaatgtgtcccagcaaggggacacttatagactatgagttccttaagggcagagccctaaattattcttttctgtatccctaatgcctagaagagctgtagaacatcacatgcacatttatgtgctctggagagagacagtgaggaacagaggcaggagggggttggggatttaaattgtgtaggcaattccacacaatattccaatcagtgagtgtatattctggagtgagagtgaaatgggacaggtgaatctgctattctcttaatctgtttccatgctttcacatcttgccagactagtttaaagtcatgaatattttatgcaacgtgattcctataaacatatgccaattacttcatcttgtgatcaactggtgatcataagaaaaactagcagagttggacttttacaatactttgcctaaatactgttctttatgtgtgatgtacagtattttcagagcttactcttgaatagattaactttacattctactgactttagaaacaaatccttatgtatgcagggatttcataatagttttctataaatggtattaaatgaatacaaatacaggatattgagagatattccactttttcaatgtaatagtgtcaaataaggtaaaataagtgcaaattgaatataattttgaagtttaaactttttgaaagcaaaatgatcatttctgtttttgttttgcttttctgagacagggtcttgctctgttgcccagactggagtgcagtagcacaatcatggctcactatagcctcaatgtcccaggcttaagtgatcctcccacctcagcctcctgagtagctggaaacacaggtatgcaccatcatgcctggctaattttttaattttttgtagagacaaagtctcgctatgttgcccaggctggtctcaaaactcctgacctcaagcaatcctcctgccttggcctcctaaagtgcaggcacctggcctgctctgcattttttaaaagcattattacatttaaattagctcttagataattaagatatcttacctttcagatgttctagttttatatttctaagtttcagcacttcatctgtaatcttctgtatcaggaagttctgtgttttttctcgccgaatagattcaacaagggtgtccagaccttttgggttttcctgtaagtagtctaacaattttccagccctttttctacttgatgttcgacaagaaatttcttcagtgtcttctctactgagtattttttttgcacgtagatgatcaaaatgtctctcagctatgattttctcacacaggtatacacgtaaattttctaaggcctaaaagacataaaatatggttcaatgttatttttaacatctaagaaaatcacatacgtgactattagttggcagtcttagctggtgtgagacaatgttctaaagtcaggaggctcaggccttctaaaatgcatgctaattaagatgaaagtccaagtagacacaagtaggtcctagacattcctcactgctttgatctcaccttcaaacctaaaaaccaagaccaggctgttgtgaagagggaccagctgaatctagagggcctgggtccttggaaacagggaggtctgttgagggccatcttcgggagtaaagatgagggcaaacactactgtacattttagctatcagttggcaaggaatgcagaattagtcaggaccaataacttagtgagaggtctcacagtctgtaactttctcatgtttgttattaattactccatttccttaaactgttaaagacaaaaaacaaaaccctaaactgaaagagcccataatgtatctgtctttggggtcagctggaaagactacactctaactcagtgaatcagtcttggtggaagggagatggaaagatgtgtggggaatagggagtgttcgaaaaatgaaagaaataaagaaaaaggacaccacaaaaaagcaaacctagatttgagaagtgcctaagagcttaattagtagaaaatccatgttgatctcaataaatggcattaataatttggtaccggtgactgtattttagctcctctatttactagatatatgatcttgggcaagtaattaactcctctgtgcttgtttcctcagctgactgttatatgaggaataaagatatgcaaagtgcttagaaaagcgcttggtacatagtaagtgatcaatatatgttagtaataatgacaaaggtaatggcaggaaagtaggctaggtgaagggttcctgtggttcttggtctacgaagttccacatttacttgtttattcacatgacaagtattttacaaatctaaattcctaatatgccgagtgctgagcactgagtatacaaagatgaacaagatttgaatcctacatgcaaagggctcatggtctagctgggaatacatatcacaggtaataattataaaacaatgtgatcgggcccagaaaaaaaagattataggtcaaatacaggaaaagcacagagtgagcaaataactatgtccaggacctggtccttatcatatctggcatggactattaacaatagaaacctagctgcacttactacttccttccccctcctcaacatttctccttcaggagaaaatggaaatctggagtattatatgaattttactaaattttttttaaggatctcactctgtcacctaggctggagtgcagtggcttgatcatagctcactgcagcctggaatccctagactcaagtgatccccatcttagcctcttgagtagctaggactacaggtgtgagccaccatgcccggctaatttttaattttttttttttttttttgtagagaagggatctttgctacattacctaggctggtcttgaactcctggccttaagtgatcctcccaccttatcctcctgagttgttgggattataggtgtgggccactgtgcccagcaaattctaatattgaaattttgttaatttagaaaaaaaattaaaaacaatgttctgccctgtcttaaaggataaagttcctttacgtggcagaagagtagaaaagttaagggcatggctctaaagttggatcaacctcagtgcaaatcttgaatctagtactcacccttgtgagagctgggccaagttacttcaccactccaagctccaggtatgttattgataaaataaggattaaaaacttaactcacaggacatcaaggaggactaaatgggaatactatatatgaaggccacgcatagtctctgtacacagtaagtactcaataataactaattatggaagacaaggttcattgataatatggctcctacctacctctccagcttaatctatcactacctttgtcctgaaaatttatgctctacctaaaactatctgtctctctacatttccttacgtattttttgtctgcttttatcagaccctaaagcccctattcgtcctttaagatttaggtcagtggtcatcttctttggaaaggtttacctaactccccagaatgagttaggcaccccgtcctctgtccttgtagcaccttgtgtatacacttcatctttctatacaccaggactccacttctttcacctcatttcccaattcattcccagacatttccatcctgccccagtattcttctcgaagtcaccaatgacccccttattgccaaatattttcagtcttcatttcatttttcagctgcataaacacagttgactactccctccctgaaacaagaaaattgttacatgaataccacactctcctggttttcttcccatccctgtggatacaacttttcaatcattttcttgttgttgttgttaccctactttcaagctaacaattcactttttaaaattcttctctttaaagggttttacaccatttttctcttctagctcacagctttctaggtaaaatcattcaattccacacttacatttctagctcagatctctcttctgatctttgactttgcagatgtaattgctgatctgacatttccatgtactaatctaattacatcctcttcctcaactcccatgttcaatccatcaccaggtcatatcatttctatttcaaaaactgcatctggaattctgctccattcatctccactgccttcaccctgatccaaatcaccatcctcattcatctctatagattccaagagcctgctcactggcttccctgttcttattcttgttctcctcagtccatgaaacaggcagagggatctttaaactatacaattcttcaacaagtccctactatacttggggggaaaaaaaccccagatactttactaaaaggctcttcatgaaaatggctctagcccaccttcctaacttcacttcagattaccctctgccttcctccgatttccccaagtcaccagggtcttgcctattttaggtccttgacaaattctattctgcccagaatgctcttccctcagttctgtcaaatctttcaggaatcagtttaaatataacctctcctgaccatcctatctcaagtcgatttcccctattattgtcttggcactgtttgattccttcatagtaattgcaataatgaaaacaaaatttatttatttgttttaaactaacgtctctgtttgaagcaggcagctacgaggtatgttttagccaacactgtatatcctgcacttactagggcaccaagtagttaatgtttcagttgaatgcaaaactcactgcacttattttgtgatttaaaacaatccccctcaagaaattgagctcttttcaagttaggattgtgttttcatttttaatttttgaactgttagaaccaaccacagtatcagcctcacagtagcatgtaatccatatttattaaactgtactaaatccaactaacacaatgaggcaaataactagataggaggagggggagacactaaagaagtgggaggtcccaagacaaagggtggtagcacaccattcatcaagaaaggcaatacagcagcaacagtaagcaactttgggaaaaggatagtaaaagttcaatatttgacaaggtgagcaatctgtaggatataaaagtagatttccagtagacatttggaaataaggacctagagtggagagaaaagtccaaatatgtggataattttaaaactctctaagatcagaagacattttgaaaatatcatgaaaaaaacctctaagaaaaaagcatgcacatagtttctttcatagaccttttgaaacccatccatggtttcctcaaggttatttatttctgatataggcgtaaaatgaaatcctgaagacagataacatcaatgaattgacagagaagaacaaagacctggaagccactcttcacatctgtacttgtatacagatcttatttccttccacttgtaatttctcagttcctgttttattagctgtaaaatgggaatggcaattatcttctttagaggttgttgcgaaggttaagtgggaacattgtaaactgtgtgacacagcatctggaacataggaggcctagctcttggaagttcaaggttttactggcactcaccatgaataagacaacatttattctacagtagttatttatgttccattcttatctcaactagaatgtaaagcaggaaactgatcttcatttttttgtatccttccagacccaaggccagtgctttccatatagcaagtgctccataaatctctgttgaatgaggaaactaagcacaactcccagtcatatccagtttccttctgctggtgagtcacaccaattgtgagtacagtgtaataaaccttacagggaagaggaagggatttgaagtggatgaacatttaaaaagttgccatcctgtccagttcatcaaaatgactttgtaaaagtactgcagtgttcaataagaacacgtttcatgttgagtttctgtttttcatttgacttcagataaagtattttagtgatactcatataggtctcatctgacaaaacaagtaaacgcaaaggaaaaagaatgtcatatctcaacaaagccattcgttacgaataaatatgaaggtttatgtggttctgcaccatccgagaagagcataatttagctactgaatattttcgacgtttacctgtacattaattctcagctacgtgtattcactcccccaaccccaatttaaatatgtgggcgtctgcttactaggggaattccaggttgtgctttcagctgttgagcttcctcaagcccccttatgcaaaagagcttcacatttttggtccactgcttgggatccttcacctggtacagccttcgctctaggctgagtgagcagcctaggcagcctgacttaaggatgaatctgagccgccagtccctaacgaagcatctccaagaacccagttggggggaaagcatgaggagatgggtgaggagtgggcaagaatcaaaacaccacttggcaacaaagcccaagctctgcgtttagcgatgtaaaacctggattgacagatcactggaggatcactgccaccaaggtccctcggatgcagggctcgccacagtcctcctgtgctaggactttccgctcctccgacctggaggatcctccttgtcctcggactccaggcttccgctttcgtctcccgctgggctgcagcccgcccccgcccgccctgggcacagctgcgttactcacgtccttcttcacttcagtgaggtcctcctcggtgagggacggtgcggtgggctccatggtggaggcgggagatggcgcttcttccgggtccgggagctcgggctgcgccgccccgccctggctgggggcttcggcctccgggtaatggggaagaaggagaggaggcggagcgggtcgggagaaagacggccgccccttcgggaacagagggactcgggggtcaaaccgtagcgcttccggccccgcctctgaggtcgacggcgacgcgaatctacgcgacgcgacgcggagctcggagcagcgttccttccctctcgtagaggctcaggcgcaggcaccgccccacggcgaggcgcgtcgcttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcggtaagtggcccgggttagcttcctcataaggcatcgtttccgtgggtggggtccgtcagtgcccaggcagctggcactctcagcctttgctgcctgctcacttcggg

SEQ ID NO: 1544 - DNA, 98108 bp, Homo sapiens
ggcgggaagtgagccagggcttggcgcggcggccgtggttgcggcgcgggaagtttggatcctggttccgtccgctaggagtctgcgtgcgaggtgagtaccgcgcgcgtaactacgggtcggtccgcattgatctagccctgctctggcggcccggcccggagctggaggccgctcgggttcttccgtttcctgcactggttcgcctcggcccgctgagtcctctagtctggccaacatcctgggaggacagcagatacataaatacgttcccaaatggggaaacagaggcccggggcgggggcgaactctgccaaggtctcccggggcgtcggaggccgagcatgggctaggacctggcatgttgttgcccatatactccagtgcgtaacatgatgccctgcacagagtaatcccagcccagacctctggcactactacctccgtgtccctcctgaggaacaacgaaaacactttgtactttttctgtggccttccataatcacgagctgggctactcttgtttttgagtgtctactgtgtgccatgttcctggcacccttgatcttacaactgtagctttacgatatcccagcaaagcgaagtgcttaagaatactgcatcagattgcttgggttcgaattctggctccttcacatttagctctgtgtctactgcacgttactgaaacactaagtgtcttggttttcgtctgtcatatgggggaaatggtctcttctacttcctggcgtttttgttaggattaaacgacttaatatatgcaataataaatgcttcgaaggctacctgttacatagtacacagtaagggttctgttatcattacccagagaagcggatgaaattgtccccattttagacatggagaatctgaagtacaaagaggttgtctccgtacagaaagagcatttggtgattaagtgctagagatacaggatttgaactaagcgcctgattttaaagtatgtcccacaacattaggctttctcctatagccctcacctgtccttaggtcacacagaactttaggtacctcatggcgtgagatggagcaggtgactgacagctccttgtgccacccatgcagataaataacactggtgtgtcactgtcaagattaagggacaggaattcgagagactgcatgagagatcagaagatgaagaagcgggtaggcaaaagtattctgtttggggaatagtaaatagaattaattaaatcaacattttgttagctgggctgcttatactgtcagacagtagcttataatctactgggaagaaatgaaatttctgggtcctgtgtcactttcaatgccactcaccatgacaggtaccttataagtatagtttacagtcctatcagtaacctggagaagtagttatttccttcgttttactgaggaaaccaagagttaaaaaatcaggaaaagtgttagatgtgcagtagaacatcatcatgctgggaagttctacacatccgcttcaggacaggtggtattacctatgagcaggaagggaagggaaaaaggtaaggggaatgagtgatagtttattgttttgatttttaaatttttatctgttttttcctttttcatagtcattcctggaatgagtgagtttgtttttgtttttgtttttgggggatggagtctcgctctgtcgcccaggctggagtgcagtggcgcgatcttggctcactgcaagctccgcctcccgggttcatgccattctcctgcctcagcctcccaaatagctgggactacaggcacccaccaccacgcccagctaattttttgtatttttagtagagacggggtttcactgtgttagccaggatggtctcgatctcctgacctcgtgatccgcctgcctccgcctcccaaggtgctgggattacaggcgagccaccgcgcccggccatgagtgagattttaaatatatctgaaatgaggccaggcacagtggctcacacccataatcccagcactttgggaggatgaggcgggcgaatcacctgaggccaggagttcgagacttgcctcaccaacatggcgaaactccctctctatagtaaatacaaaattatctgggcgtggtggtgtgcgcctgtggttctagctactggggaggctgaggcacgagaatcgcttgaacccaggaggctgcagttagtcaagattgcaccactgcactccagcctgggtgacagagtgagagtccgtcagtcaatctacctgaaatgttttatgcctttaaaagagagagaatagggccgagtttaactttttaaatttggttggtgggtacatgggtgtaattctattttctgtatctttatgtaagaaatattaaaaattaaaagatatacatatatattttaatttacatatatatgtgtttttttctaagagaaaaatggatagaataaagaggtccaagataatcgtagaataatcctaggacttcagtgctgaaagcccctaagggtctccactacctgtaggataaaatctaaactccttggcatgataccagaggcttttgagcattctgtatcgctaacacatactattctacctcagcctttgtaccactagttcatagactactcttcttcacaacctcagtcctgtctgtaaagttccacttgtccttcaatatccaattcagtgttctttgaaaagcttctctatcatttgcctgtttttccttaatctgggaagccatagtcttttaagaaaagacttgattgtcagacttatctcgttgcattgtaattatttgttgacatgtctattttctgctagtctataagctccttgaaggcagtaataatgtctttcccatctctgtacttcagtgcctaccatgatgcctggcacagagtagtcactgtagatattagctgaatgaaaaatacaagttgaagacagagagtgaaagttcttggagttatgacatatggactttgttctctggaatgacagggaactattgagtttactttctttaaaaattcccgtattttattgaaacatattctcaatgtcaagaaaaatattccagtcataatcctatctttcaaacacttgaactatttttattttccatgagtcctttccaaatttcagctataaaattagttatacagatttagctatacagatttcttaggtagctgtagccttaatgtattcataacttagtgtttttcttttttctttctttttaaacctgacacttgaggaattttttttttcttttctttttttttgagatagggctcactgcagctccagcctcccgggctcaagtgatcctcccacctcagctgggagtacaggggtgtaccaccatgcctggctaattcttgtatttgttgtagagatgggcttttgattttttgtagagatagggtctcgccgtgttgttcaggctgatctcgaactcgtaggctcaagcagtttgcccacggagtgctgggactacaggtttgagcccaccgcacctggcctgcttttttcaatattaaattatttcctggctgggcgcggtagcacatgcctatgatcccagcactttgggaagccaaggttggggattgcttgagcctgggagttcaagaccagcctgggcaacatggcaaaaccccgtctctaccaaaaaataaaataaaaatctaaataaattatttattttagtgaatcagtctttatgcttgtcatttgtcttataaattttcgcaatattcctctctctttggtttaataggtatgaaatgatgctccatgttattattagaaaaatttcacaattttttcataaatttacttagtgtctgtatattctggtgagctgttgtgtttatattccctgaacatttgttcactggaactggatgttctttatgtgtttttaatattaatcatttatctgttatttgttgctaatttttcttttcttttttctttttttgagatggagtctcatcctgttgctgaggctgaagtgcagtggcgtgatctcagctcactgtaacctccgtctcccgagttcaatccattctcctgcctcagcctcctgggtagctgggattacaggcacccgccaccacgcccggctaatttttgtatttttggtacagatggggtttcaccatgtcaggctggtctcaaactcctgaccttaggtgatctacccactttggcttcccaaagtgctgggattacaggtgtgagccactgcatccagcctaatttttcttttaaaaatatttttattggccgggcacagtggctcgcgcctgtaatcccagcactttgggaggcctaggtgggcggatcatgaggtcaggagttcgagaccagtgtggccaacatgatgaaaccctgtgtctactaaaaatacaaaaatcagctgagcatggtggcacatgcctgtaatcccagctacttgggaggctgaggcaggagaatcacttgaacccaggaggcagagattgcagtgagccgagatcacaccactccactccagcctggcgacagagcaagactgcatctcaaaaaaaaaaaaattttctttattatgacaaccaagatacatttgtaaaaatatacataatttcgctggaaaccaagagttaaagtggctcacgcctgtaatcccagcactttaggaggctgaggcaggtggatcacttaagggcaggagttcgagaccagcctggccaacagggtgaaaccccatctctttttttttgagacagagtctcactctctctcccagtctggagtgcagtggcgcaatcttggctcactgaaagctccgcctcccagcttcatgccattctcctgcctcagcctcccaagtagctgggactacaggcacctgccaccaggcccggctaattttttgtatttttagtagagaccgggtttcactgtgttagccaggatggtctcgatctcctgacctcatgatccacccacctcggcctcccaaagtgctgggattacaggcatgagccgccgtgcccagcaaaaagcccatctctactaaaatacaaaaattagctggccatggtggcccatgtctgtaatcccagctacttgtgaagctgaggcaggagaatcacttgaacctgggcagcggaggttgcagtgagcctagatcaggatcacgccattgcactccagcctgggcaacagaatgagactctgtctcaaaaaaataaaataatttaaaaaaagttacataatttaaagaatagttacaaagaaattacaaagtttagttatgcataaaaattatattgtattcatggtaaattgaagactcattataaaattatagttacacataactatcatctagatcaagaaagaaatagaatattaccaggatcccaggaccccagaagtgtatctttctgatacctcctccctatgttagggataactattgtcccaattatgtatttatttattttgagacggagttttgctcttgttgcccattctggagtgcagtggcgcgatctcggctcactgcaacctctgcttcctgggttcaagcaattctcctgcctcagcctcccaagtagcttggattacaggcgcctgccaccatggctggctaattttttctatttttagtagagacggggttacatcatgttggccaggctggtcttaaactcctgacctcaggtaatctgcctgcctcggcctcccaaagtgctgggattacaggcatgagccaccgctcctggccctattgtcccaatttttgtgataatgcttttcttgtcttcatagtttgccctgatctatacatctataaataatatagctcagttttgcctggttttgagctctgtaaatgggataatactatatgcattctactgagtctttctagtttgcgttattatgtttgtgagattcttccacgttgtagatatagtttttcttttctttttttttttttttaatagtaattttggctgggcatggtagctcacttctgtaatcccagcactttgggaggctgaggaagcaagatctcttgaggccaggagttcaagaccagtctggcaacaatgggagacttgtctctataaaaaatttaaaaaattagttgagcatgatgtcatgcacctgtagttccagattctccagaggctgaggcaggaggatcacttgagcttaggagtctgaggctgcagtgaactatgattgtgccactgcgctctagcctgagtgacagagcaagaccttgtctctaaaaaaaaatttttttaaattgtttttcttaacctcttaacagagttttacatgtatagtaccacacagccacaatgttgtatggcagatctctagaatgcgttcattttgcattactgaaactttatactttttgattaacaactccccatttcctgaaagcccctaccctggcaaccactgtgcccctctttgcttctatgagtttgcctattttagatacctcgttgcagtggaatcatgtagtatttgtcctgtgactggcttacttcactttgcttaatggcttcaaggttcatctgtgtcatctcatgttgcaggattttttttttaattttttattatttaacttaattgtattgtattttattatttttcagacagggtcttgctcagctatccaggctggagtgcagtagaatgatcgttgctcactgcagcctctaactcctgggctcagatgatccttctgcctcagcctcccgagaaggtgagactacaggagtgtaccaccatgcttggctaacttttttattttttgtagatactgggtcttgctttgttgcctaggctggtctcaaactcctgggctcaagcgatactcctgccttggcctcccaaagtgctgggattacaagcatgagccacttcatctagtcaatttttttctttttaaaggctgaatatttcattctatgcgtataccactgtaaagaaaactccatttcctctctactctgtacccatataataattcctcacttctgtcaccaaatgtgtggtgttttttttccccacaatagttcagttctttagcagacactgggtgtcctacatttagctcaggtctgacactaactgccaggtgttagtgcagaccccaaatgttaagtcctccctgtccacccgcattccagaccccccacttcagactacaagcacaagtggtaagtcctccacattcagtcacagaacagtttccttactagattatcagcttattataaacaactcagaagcagccagctggaagaaatacacaggacaaggtatgtgggaaggggtgtggcacttccatgccctctccaggcacaccagcctcccaccatctctacatgttctcaccaacctagaagctccctgagccctatccttctgggtttttacgtaggcctccttacctagacatgattgattaaataattggccattggtgattaagtcactccccagcccctttgtcctacccagaggaagttttgttttgttttttgagaaggagtctcactctgtcgcccaggctggagtgcagtggtatgatcttggctcactgcaacctctaccagctgggttcaagagattctcatgtctcagcctactgaatagctggggttataggtgtgcaccatcatgcctggctaatttttgtatttttagtagagagagcgttttgccatgttgtccaggatggtctcaaactcctgacctcaggtgatctgcccgtctcggcctcccaaagtgctgggattacaggcataagccaccacgcccggcccccagaggaaggttttattgaattaattacaaactgataggtcaaagagtgtgtatgttttaccttactatgtaatactaaattgttttcaaaagtgcttgcactcccaccaatgtattagattttccgttgctctgcatgctggctaatactttatatttacatttttattttccaatctggtatattcatgtatagtagtattttctggtagcattcatttctctgattattagtgaagatgagtaccctgatgtgtttatgggctatttcctcttttttacagtccctttttttttttttgaggcggagtctcactctgttgcccaggctggagtgcagtggcaccatctcggctcactgcaagctccgcctcccgggttcacgccattcacctgcctcagcctcccaagtcccaagtagctgggactacaggcgcccgccaccatgcccggctaatttttttttttttttggattgttttagtagagacggggtttcactgtgttagccagggtggtctcaatctcctgacctcgtgatccacccgcctcggcctcccaaagtgctgggattacaggcgtgagccaccgcgcccagcctacagtccctttttttctgtcttctctattaagttgtctctgttttatgtacatataaacatatttatatatagttatctacatttttatatatacgtacatacacatttacataggtgtagcagatatcttctactttggctttttaagtggatttaacataattttagtcaatgactttttttatttttacatttctttaaagtgacataattgtaccccaacaatttatggggtacatagtgatattttgatacatatactgtataatgatcagatcagggtaattagcatatctatcatcttaaaacatttatcatttctttgtgttgggagcattcaatatcctccttctagctatttgaaactgtatagtacattattgttaactgtagtcatcctgtagtgctacagaacaccagaacttattcttcccatctagctgtaattttatattcttttctttcctttttttgagatgaagtttcactcttgttgcccaggctggagtgcaatggcacaatcttggctcactgcaacctctgcctcctgggttcaagcaattctcctgcctcagcctcccaagtagctaggattacaggcatgcgccaccatgcctggctaattttgcatttttagtagagacggggtttctccatgttggtcaggctgatctcaaactcctgacctcaggtgatccacccacctcggcctcccaaagtgctgggattacaggcatgagccaccacacccagccaattttgtattctttaacaaatctgcccctacccttcccagcctccagtgtcctctgttctagattttacttctatgagagcaacgatttttaggttccacatatgagtgagaacatatggtgtttaactttctgttctttattccacttaacacaatgtcctcaggttccatgttgctgtgaataacaggattttattcttttttatggctgaatagtattctgttgtataaatgtactataatttttttattcattcatcgcttgttgaacaccttggttgattccgtatcttggctattgtgaatagtgctgcagtaagcatgggggtgcagatgtctctttgatatactgacatcttttcctttggataagtgttcagtagtgggtttgctgaatcatatggtaggtctatttgtagttatttgaggaacttccatactgttctccatagtggctgtactagtttatattctcaccatcagtggaagtgtaagagttctcttttctctgcatcctcaccagcatttgttattttctgtctttttgataatagctttcttaactggggtaggatgatacttcattgtgtttttgtttttgtttttttaatttttaaaattttttgtagagacggagtcttgctgtgttgcccaagctggtcctgaactcctagcctcaagcaatcctcccgcctcagcctcctaaagtgctaggattcaaggcatgagccactgtgcctggccctaattgtggttttgatttgcactattttttttaacatcttttattgtgaattattgtatgttatatttcatagatataacttgtacgtgaatgagctaatatagtaggcctgaaactgttaccttcagaaaagcctgcttgcaaaattggtccctggctgtgtctgagaacttggcttttgaaacctttcctacactgatcaggttgttttactaatacctgttttccttctgagagtctgaaattttggtgggaggaaggtgcctaagtgaccagccctcaataaaacccctagattcagagtctctaaccagcttcttttgggcagaaacattgcacacacatagctgcattttcactgagagaacatgcactttctcaggggttagagagcattggaagcctgcacgtgaattcctacagacactacctgatgtgtttttttttcccttgctgatctggttgtgtatccttaaagtgttgatgatataataaatgttagctgtgagtacaactgtacactgagtcccatgagttcttccagcaaaatattgaacttagctgttaagttcctccagaaaaaaaaaaagctggaattttgattagaaatgcatcaagttatagatgaatttgaggagaattagcatctccatatcgtcttccaatgtgaatgtggttcatatgattgtttcctccctccttgacttctcttaacgactttcaattttcttttctttttttgagacagggtcttgctctctcacccaggctagagcaagtggtgcaatcacagcttactgcagcctcaacctcctgggctcaggtgatcctcccacctcagcctcctaagtagctgggaccataggcacatgccaccatgaccaacaaatatttgtatttttgtagagacagggttttgctgtgttgcccaggctgctctcaaactcctgggctcaagtgatctgcccaccttggcctcccaaagtgctgggattataggcatgagccactgtgcccagcccaattttctgaatagatatcaaggacataatttgttagatgtatttttaggtatatattattttctttaaattttttttgagacagggtctcactctgtcacccagactgaagtgcagtggcgtgatctcagctcaccgcaaccaccgccttccaggctcaagcaatattcctgcctcagcctcccgggtagctgggattataggcacgtgccactactgccaccacgttcagctaatttttatatatttagtagagacggggtttcaccatgttggccaggctggtctcgaactcctgacctcaaatgatccacccaccttggcctcccaaagtgctgagattacaggcatgagccactgcacccggccgggtatttaaatttttgatgtcatcttaaaaagttttctgacattttattttttgtttattgatgatatagaaaaacaatttatttttgtatattgaccttgtctccagcagtcttcctaaacacactgtcttagttttctatagctgctgtaataaattaccataaacttagtggcttaaaacaacatagaggccgggaacattggctcatgcctgtaatctcagcagtttgggaggccaaggtgggagtatcgcgggagcccagaaattcgagaccagtctgggcaacacggtgagtccctgtctctgtttaaaaataacaataacacacggtagctcacacctgtaatcccagcactttgagaggccgaggcgggcaggtcacctgaggtcgggagtttgagactagcctggccaacgtggcgaaactccatctctactaaaaatacaaaaattagccaggcatggtggtacgcgcttgtaatcccagctactcaggaggctgaggtaggagaattgcttgagcccaggagacagaggttgcagtttgccgagatcgcgccactgtactccagcctgggcaacaagagagaaactcagtttcaaaataaataaataaaataaataaaaacaacaacaacatagatttattatcttatagttctgtagttcagaagtctgaatgggtttcattgggctaaagtcaaggtgttggcaggctgagttcccttctggaggctcaagggcagaatccatttccttccccttttcagcttttagagactattcgtattccttgactcttggctttcctcctccattatcaaagccagcaactttgagtcctcctgaagttgccatctttctggtctgtcatcttatttcctcttccacttaaaaagacacttgtgattgcattgggtccatctggttagtccaggataatcttcctattttaaggtcagcttattagcagtcttaattccgtatgacagtaattcacctttgtcatgtaaccaagcatattcacaacatccaaggatcaggatatagacatctttggatgggtatgggagatggggatagtggtggtggtcacattattttgcctcctgcattcacttaagatttttatttttatttttatttttatttttgagacgaagtctcgctctatcgcccaggctggagtgcagtggcgtgatctcggctcactgcaacctccgcctcccgggttcaagcgattctcctgcctcaacctcccaagtagctgggattacaggtacgcgccaccatgaccacctaatttttttcttattttttatttttagtagagacagggtttcactatgttggccaggctgatctcgaactcctgacctcgtgatccacccacctcggcctcccaaagtgctgggattacaggcttgagccactgcatccagccaagaattttaataatttaatctgaagattcttttagatgttccacacacaaaattatagcctttgtgaatattaatgattttacatctttccagttaacacgccttttatttattgttcatgatctactgctctggcttggacttccagtatatatctgataaaagtattgatagtgggcattctggaattgttcctgatctaaaaagaaaagtttcctaaacttcaccttactgtattctctctgtcaggttatagaagttcctttctattcctgtttgataagagttgtgtttttttttgttgtttatttttgaggtggagtcttgctctgccacccaggctggagtgcagtggcgcaatcttggcccactgcaacttccgcctcccggttcaagtgattctcctgtctcagcctcccaagtagctgagactagaggctgcgtcactgcgcccagctaatttttgtattttaggtagagacagggtttcaccatattggccagactggtctcgaactcctgaccttgtgatctgcccgtctcagcctcccaaagtgctgggattacaggtatgagccaccatgcccggcgtgataagagttttcattatgaatggatttcactgtgaatggatgtttgattttatcatatgcttattctagaagtcttgagacgatatggttgttcagctttaatgttgtggtgaattatattaattgatttttaaatgttgaaccacttctgagtcattttttagacaacacaacttggtctcggtattttttattttatttatttatttatccttttagacagggtctcactctgttacccaggctggagtgcagtggtgtgacttcagctcactgcagccttgatctcccaagtcatcctcccatctcagcttcccaagtagctgggactataggcaagtgtcaccatgcccagttaatttttataaatttttgtggagatgagatttaatcacactgcccaggctggtctcaatcctgggctcaagcaatcctcctgccttggcctccaaaagcgctgggattataggtgtgagtcatcatgcccgtggctcttggtgtattttatacatggctagatttactttgctaacatattgtttgggacttttgcatctacatttatgaaaaagaattagcctggagtttttcactgaggagttgcccttacaggacttagtatcagagttatgctagcctcacagaatgagctggggagttggttctttctatattttggaatcgtttatgtaaaactggaatattttactgccataagtgcttagaagaactcacctgcgccactctggtcttgatgctatctttgtgggtagatttttgaccatcaataggacttctttaatggttataaggctattaggttttctgtttatttttgagtgagttttgataagttaatttttaaggaatgtgtccatctcatctaaattttaaaatttattgatgcaaagttgttcataacagcctaatgttatcttttaatgtctatagcatatgtaattaaatctcgtctttcaatctcttcttttttgtctttttacagaacaaacttggtttattgatcctctctattatatatctattattttttactcttaaaaatttttttaaaaatctatttatttatttattttgagaccggtttatgaaactggctaatttttgtatttttggtagagatgaggtttcaccatgttgccaaggctggtcttgaactcctggcctcaagtgatccacctgccttggcttcccaaagtgctgggattacaggcatgagccaatgcgtctgaccctcttctctttaaaactgcctcccttctattttcatcaggcttattttttcagtttcttttctaataattagggtcatccattttcttgtaactacttctttagttgcatattagatatttttatgtgtagatttccattattcagtttaaagtatatttgaatactcactatgatatcttacttgactgatggcttattcacaagtatatttcttgattttcaatacaaagggattttctagatctcattttctttattttgaaattttaaaaatctacagaaaagaaaacctacagaaaagttgaagaattagtgcagtatatcatcttcccaagtaaacaatttacattcataaaaatagttcatatattaggtaacaaggaaaacattagtaatttcataaagtagaaatattataattctgatcaccatgcaacaaaactagaaattaaaaatgaaatttataaaaaagcagaaaggcccttccatctggaaaattgaaaacaactattggatgtaaggaaaacagaaactgaaataaaggatttctgaaaattaacgaaatgaaaacacagcatatcagattcttaaaaaaaaaaaaaaggtaaggcactagtcaggggaaaatttataatcttcagtacatattataaatgaagaaagggaaataatgaaataaattccaaacttagaaagttaggaaaagaaaaacaagtaaatcgaaagcacaagagaataaataataaagataaaaagagaaattagtaagagaacaggaaaacatctgattcaaaaattaagatttttatcttggctgggcgcagtggctcatgccagtaatcccagcactttgggaggccgaagcaggcagatcacgaggtcaggagatcaagactatcctgtccaacacggtgaaaccccgtctctactaaatacaaaaacttagccaggcgtggtggcatgcacctgtaatcccagctactcgggatgctgaggcaggagaattgcttgaacctggaaggcagagtttgcagtgagccgagatcgtgccactgcactgcagcctgggtgacagagtgagactatgtctcaaaaaaattaaaaaaaaaagatgtgtatcttgaattgtttaatgaagcaaataaattagcctaatagaaattacaaatatacagaataagaaatggtaagtggtaagtaaccactgacacaggatagtttttataacaggattaatttatgtacctttacgtaaacaaatttgaaaactaaaatgaaatggataattatgtgtgaaaatctagtttaccaaaattgactcaagtagatgttggaagttaaatagctcaatttccattgaataagtttttaaagttatgaaataactgtctcactgaaaaataaaaaacatgaggtccaaatggtttaacaggaaaattctactacatttatggagtccaaataatcctaatgctaaataaattgttttagaacgtagaaaagaaggaaaacttccaaattctttattttccaaatggcttggtattgtaaatgctgatttagttgtctgtctccagttgttgaagggctgaagtgaaataaagtaaaacatcttaaaacactttttagttcttagaccctcttttttaaagtagctttattgatatagactgcacgtatttaaagtatacaatttgttcagttttgacatacacacatcatcaccataattcagttaatgaacatatccatcactctcaaaagtttcctcatcccccttaattctgccttcttgctctcttcttgccggtcaaccacttatctggtttctgtcactgtagaataattagcatgttctaggacttttaataaatgttataatacagtgtgtattcttttgtatctcacttcttttacacagcataattattttatatcggtttttatgaagcaagtataaaacaaatatttaacataaaaattaaaggtagcacaaagaaaattacagatgaatattatgtataaaaattatgtaaaagttctaaataaaatactaccaaacagaacagaatccagcactctattacaaaactattagctcatcaccaagatgtataccaggaatgcaaagatggtttaacattagaatcatcaatgtaattcaccatattaattaacctaaggagaacagtcatatatttacttttatatatgctgaaaaagcctttgacaagattcaacaccaatatatagtaaaaactcttaagaaattatattgtaatcaatacttctttttttttttttgagatggagtctcaccctgtcgcccaggctgaagtacagtagcatgacctcagctcactgcaacctccacctcccaggttcaagccattctcctgcctcagcctcccaagtcgctgggattacaggcgcccaccaccacacctggctaatttttgtatttttagtagagatgcggtttcaccatcttggccaggctggtctcaaagtcctgacctcaggtgatctgcccacctcggcctcccaaaatgctgggattacagatgtgagccaccatgcctggccaatcaatacttcttaatgatggtattctctctctctctctctgtctctgtctctcacgcacacatacacacacacgcgcgcacgcacgcacacacacacacacacacgcagagagagagagagagagagagagagagagagagagactttattcctaaatcctgtattttatctaataggaaaatactagaggcatttttactaagattgagaaaaatatagagatactcaccaactccacttgtatttaacattgtactgggggcttagccaatgcagttagataaatcaattagaggcacaagatttggaaaataaaaagtaatattgtccctacttgcaggtgatatggtagtgtgtctggaatactgcagaaaatcaataatgaaactaactaaacagaaaaggaattttataagaatatgcaaaaatcagtagtcttcatatacacaacaagtttgaatatataatgaagggtaaaatcccatttacagcaacaagaaaaagagaaaatatttaggaatttaaaaacatgtaaaacctaggtgaagaaatctttaaaacacttctgaataacaaaaatagccttaaacaaatgaaatcttttgttctaggacaggacaacaacatcataaaagtgcctaagttaatatatatatatatatatatatatatatatatatatttaagttaatacatatacctaagttaatatataaatttaatgcaatctcaatataaatatcaacagagttctggcactagacaagttgattctaaagttcatatagaaaaataaacatataagaataggaaaacagaagagctacaaagagaaagtagacttccagatattgtaacatgttgcaaagcttctatcatgataatattgtggtatagaccaatggtatagaatggaaagtcaataattagtctcctaaacacatgaagaatttagtgtatgataaaggtagttctgaaattattagggcagagatggactctttataaatagtgctgggacaacttgttagccacttgaaaaaacaaaattatatctatactttatatcagacacaggaataaactccaaatgaaccagaaatctaattttttttaaattacctactagaagaatacatagatgagttttctgtaacctggatgtggagaagggcaataaaagagggggaaaaattggctacattgaaaagcaaattcttgattacaaaaatgaaaaacaccataagcaaatttaaaagatagatgagaaaccaggaaaaaaatctgcaaaatacattttaaagacctactatccctagtctaaattgagagaaaaaaatactaaaatttggttaaaaaggcagaatacatgagcagatacaattttttaaaaagattcaaaaaccatccttaaatatgtgaagaaaatattcaatttcacctaaacaggaagtgtaaatttaaagctgcactgaaataccgtttctcacctatcagctctgcactaattagaaagcttcacaagaagccccattggtgaggctgtgaggaatgcaaacttgtaaaacctcctttgagggagaagttggcaatccagcagactacacatgcatttgccctttgacccagccattccacttgtagaaatattccctaaagatacattttcttttctttctttcctttttttttgagacagggtcttgcttgttgcccaggctgaagtgcagtagtgtgatcttggctcactgcagctcaaactcccaggctcaattgatcccaccttggcctctggagtagctgggaccacaagtgcatgccaccacgccttactaatttaaaaattttttttatagagacggagtctcaccatgttgcccaggctggtcttgaactcctggactcaagcaatcctgtctctgcctcccaaattgctgggatgacaggtgtgagccaccgtgcccggccttacgttttcaacagtagggaaatatgaatgcacaaagttatttgttgcagcattatttgtaattgtaaaatatcagggaataccttaaatgtccatacaggaaatttgttggtaaatatctacacaatggagtactgtacagctgtaaagaagaatgaggaaaatctttgcaaacgggtgtagagtgatttctaacatgaatggaaagcgtacatacagtgtgctattttttatgtaagaaagaagggaaaatatgagactctaatgtctgcttattttgcaaaaagaaaaacaggaaagataaatcagaaattattgaaattgataacccacaggaagtagatggcaaaggatggagagggaagaacacttctctgtggggaaaaacagtcttttatgtagttttaacttttagaactatgtaaatgttttatatattcaaaaatcaaatccacaagaacagtacaaacacaaactaatctaattcaaatgatgaatgtaatcaccctgaaggtgaggtgggactgaccaatcaagtaacttttgaatatagtactttaattatgtacccttaatctgaagaaagaaatgcaactgaattttgaactcttcttagtaggttttttttttttagtgacaggagtgtagcaatttgaaattacttcctatagtttcagattgaataaatgaataaatatatgatggttttttctatgaattttaagatagatggatagatcaatggatgtatagctgtagatacagaaatagatagaagtgtttatatttcctagatctgtctactaaaagggcctaggagcaatgatatgcaagtagcagatcatatctaatggccaggtcttagattttaaagatttttcctcattaaaataaatgaaggctgtttgaggaaatggtgattctatggctgaagcaggaaaagtaaatgaagaccatgaatgttgtgccaggtaataagaaagtgcctgatgggaacactttaaaggacagaggaaccaatggattaaagaagaaaacaagagacattagagtatatcttgagacaatgaaaacgaaaacacaacatgccaaaactcatggaatacagtgaaagcagtactagaaaggaaatttatagctacaaatgcttacattaaaaaagaaagatctgaaatcaacaatttaacttcacacttaaaggaacagtaaaaagaacaaaccaaacccaaagctacagaaacaaggaaataataaatattagggcagagataaacaaaacagggactagaaaagcagtagagaaattgacaaaacagaattgattctttgaaatgataaaaaaattgataaaactttagccagatggactaagaaaaaataagacaaattactaaaatcagaagtgaacaaggggacattataactgatttacagaagtaaaaagatttataagagaatattgtgagcaaatgtatgccaacaaatttgataacataaatgaaatggataaattcctcaaaacacataaccaccaagacagaatcatgaagaaacagaaaatctgaacagacctataactagtaaggagattgagttagtaatcaggtatcacccaacaaagaaaagctcagggccagatggcctcactggtcatttctaaccaatatttaaagaagaattaagtccaattttcctcaagctcttccaattaatgatatatttgataaagggttaatacccaggatatataaagaactcctcagcactttgggaggctgccgggacgggagaatttcttgagcctaggagttggagaccagcctaggcaacatggtgaaaccctggctctacaaaaaatttaaaaatttgccaggtgtgatggtactttgctgtggtcccagctactccgtaggctgaggtgggaggaccacttgagcccgggaggtcgaggcagccgtgagctgttgcactccagcctgggtgacagagtgaaaccctgtttcaaaaaacaaaacaaaacaaaacaaaacaaaacaaaacaaaaactcatacagctcaacaaataacccatttagaaaatagagaaaggactcgaatagacacttcaccaaagaagatatacaaatggccaataagcaaatgaaaagatgcctattatcactaatcattagagaaaggcaaatcaaaaccaggagataagacctcacacctgttagaatgcctgttataaaacaaaacaacaaccagaaaataacaagtgttgctgaggatgtggagaaattaggatgtggaaaaatgggaagccctgtgcattatttatagcaatgtgaaatggtgcaaccactgtggagaacagtgtggtggttccttaaaaattaaacataaattaccatatgattcagcaattctcaaaaagatatttgtacacccatgttcataacagcattattcacaatagccaaaaggtggaagcaaccctaacgtccttgaatggataagaaaatgtggtatgtatctacagttagatattattcagccttaaaaaggaaggagcggccaggcgcggtggctcacacttgtaatcccagccctttgggaggctgagacaggcagatcacaaggtcacaggttcaagaccagcctggccaacatggtgaaaccccgtctctactaaaaatacaaaacagaaaaattagctgggcttgatggcacgcacctgtaatcccagctactcaggaggctcgggcaggagaatcacttgaacccgggaggcagaggttgcagtgagctgagattgcgccactgcaccccagcctgggcaacagagcaagactccatctcaaaaaatattaataataataaaggaaggagcctggcatggtgactcatacctgtaatcccagctactccggaggcagaggtgggaggatcattagagctcaggagattgaggctgcagcgagctctgcacacaggaaattctgacacatgtctcacaacatagataaagcttgagaacactgtgctgagtgaaataagccagtcccgaaaaggcaaatactgtatgattccacttacagtgtgaatacattatgattcccatactgtatgagtctgctgatgacaaactattgtttttttgataatctggaagtgtctctatttcttgtggcattttaaataacagctgtattgtttttaaattattatttgtttatttttttgagacagggtcttgctctgttgcccaggttagagtgcagtggtgcaatcacagctcactgcagcctcgacttcctggttgagcagtcctcccacctcagcttcccaagtagctgggacaacaggcatgcaccatcattcctggctaatcttttgtattttttgtagagatggggtttcaccatattgcccaggctggtctccaactcctgggctcaagcgatccccccgcctcagccttccaaagggctgggattacaggcatgagctactgtgtctggcctgaatgacaggtctattgaaatacattacacatataaaattcacccattaaactgtacaatccaatggctttgagtatattcacagttatgcaaccatcaccgcaatcaatgttggaacattttcatcagcccacagagaaatttgcataccccttgccatcatccccaaatcctctcatctttcccaaccctaggcaatcagtagtctacactgtatccatggatatgtctattcttatacatttcatataaatggaatcatacactagttcatcttttgtggctggattctttcacttaacataatggtttcaaggctcgtcattactgtagcatttatcagtactatatttttttgtgtggccaaataacattttgttgaatggatatacacattttatttatccattcatcacttgatggacatttgagtggtttctgaatttggctattgtgaataatgctcctgtgaacaatttgtgtacaagtatttattttgagtacccatttttcactctttcgcatatatagctaggagtgaaattgctgggttacatggtgatatggtttgcctgtgtccccattgaaatctcatcttgaactgtggctcccataatccccatgtgtcatgggagggacctcgtgggaggtaattgaatcatgggtttttcccatgctgttcttgtgagagtgaataagtctcacgagagctgatggttttataaaaggcagttcccctgcacacactttcttgcctgccaccatataagatgtgcctttgcccctcctttgccttctgccatgattgtgaggcctccccagccatgtggaactgagtccattaaacctctttttctttataaattacccactctcaggtgtttcttcatagcagtatgaaaatggactagaacacgtggtgactatgtttcgttttttgaggtactgcttgactgttttccaaagtggctgtgccattttagagtcctaccagcagtgtatgagggttctgatttccccacattgttgccaacacttatctgttgcttttattatagctactttttaaaaataacagctttattgagatataattcatataccatgaaattcacctttaaaaacctagtgtacaattcactgcccttgatttgtgaaagatattttttctgggaaaagaattctgggttaatttctatcagcacatcgaagatatcattccactgtcttttgattttcatttttgctaaagagaaatcaattttttgtccatatggtacactgatatatttgggtgtggatttctttttatctctgcttggaattttttggctttctcaaatctgaaggttagtgtctttaattagtcctggaaaagtcccagctgttatcttttcaaatattaattcttccctattttctcttctttctggaactctggctagatttatgttagactttctactctgtcttccatgtctcctaacttctcatattttccatctgttttctctatctctctgtgtgtgcatctattaagtcaaaaactatgaagggtctgagattttaccctacatttatagctatatttatctttagccacttttctgaagttctaattatctattgttatgactgattttctttgggttgtattggtatattatcaagttgtctacatataatgataatctcatctcttctagtatttcctttttcgaatatttttgcattggcaagagcatccaatatgggagtgaaaatgagagaacaatattgtttttgctgttgtttttaatggattcacccctagtgtaaaatatatggtatttgttggttctagattttaaacacttgtaattttgtgttttaatgtgtttgttagacatggtttgagttttattaggtgccttttcaaaaatgcattgataatacatactgtgtgattctatatatatgaatcaagaagtttaagaaaccatgaacgaagagaacatatgacataaaattctgtcaaaaatctctctttgtctagaaattgtgtttgatgtttaattttatcagagaacagaaagttgcttgccccagtgccccagttaaggtaaagctgaggttcataaatacctcaacttaaaaaaatacaaaaagtagattttttgatcgttcttagttaggctcaccacctttgccccagggaaagtaactcctcccctttgaacagtcactgagtgaggcttacagagcgacgctctgtttttcaggaaccaccccctaaaatctccacttttagcagaagactggaaacagaaacatctaaatgttacttggcactgaatgtcttggagtagtctttttggcagtctatcccttgatagactgaaatagccatctttgacaacaaaatgaataaaaagtaaggtttgacctagtcttaattttgatagatccccaaccagtaactttagtgtcacttatttcaaagaaaaggcactctttttttctgctgtgtttttctccatcccatgtctctctctctctctcttttttttttaaaggtttattgtgtttacttttattctttttttatttttgagacagggtctctgttgcccaggctggagtgcagtggggtgatcatggctcactgaaacctcgacctcccgggctcaaatgatccttcccacctcagcctcctgagtaactgggactacaggcatgtgccacctcactcagctaatttttgtgtttttttgtagagacaggtcgtactttgttgcccaggctgctctgcagctcctgggctcaagcgatcctcccgctttggcttcccaaagtgctagtattacaagtgtgagccgccgtgcccagcctatttgaaaaattcttaatagccagttttaaaggtaatgcttgaagcttacatttcctgtgactttttttttttttttttttaaacacagggtctcactgtcaccccagctggagcagtggcacagaattgctcactgcagcctcgaactcctgggctcaagggatactcccacctcagcctccctgagtagttgggactgtaggtgtgtgccaccatgcctggctaaagatgggatctccctgtgttgcccaggctagtctcaaactcctgggctcaagccatccccctgcctcagcctcccaaagtgctgggattataggcgtgagccaccgctcctggcctgcttatttatattcttttgtaatggcatgataacttctttcatatatgtaggagaaaattttaatcattttccagattgaacttgtgattcttgtggtcattctaattcataggtttatttttttagtttctggttgctcattgcacccagaaattgttcctttttttaatattgtgaaacttcactagcctcaatttatttgttttcagttaatttttctcctttatcactggtctttgttattgtggatgaacaattttttttaagagatggggtctcacagtgttgcccaggctatagtgcagtggctgtttacaggtgtgatcatagtgcactacagccctgaactcctgggctcatgcaatcctcctgcctcagcctcctgagtagctgagactacaggcatgttggtgaacaattttctttttgtgtccaacaattgtatcgatattttgatggagtatgtacagaagagacacccttatggttcttagtactcaccaacttcctgaaagcattcccactgaggattttgagtaagaaaattatgtactcattaccatacttcagaatatgattctggctggagggtgctacctcgtgaggaataaccaaagagcagtgcattttaaaagcaggaagaggtcccctggagttaaggttgactgcatgctagctgtgaatccatagtgtaatcactacagttataaaatagttaatcaaacaattgtactcctgggatggctaagtagacatataaaaccatgctgtggagtaatgtaggaaatctcttattaaaatatcatggctagttttgatccaaaaataagtaagttatggaaggaatgtgggaaaagggtaagtaatgatgccatagaccactttgttctgcttagtgtcattaagactgaagatctgtgtacctctgcctccttgtcagtagtctactttgttgatgttgaaattcttagagggcaatagtctgacttcactctttatcacttcgtatttattcatgtgggaaagactcccacattgtacaggaccttgaagaggggacgcctcaacaaaagatcaaggcttttattttttatttatttatttattttttgagacagagtctagctctgtcaccaggctggagtgcagtggcacaatctcggttcactgcaacctctgcctcccgggttcaagcaattatcctgcctcagcttcccaagtaactgggattacaggcacatgccaccatgcccagctaattttgtatttttagtagagacagggattcaccatattggccaggttggtcttgatctcctgacctcatgatccgcccacctcggccttccaaagtgctgggattacaggcgtgagccaccgtgcccagccaagatcaatacttttaaactggattccaaatggtgaagtgccctaggaaatgcagagattaaggtcttaaaatattctccattaaaaagatcagggaggctgggcgcggtggctcacacctgcaatcccagcactttgggaggcggaggcaggaggatcccttgagcacaggagttcgaggccagcctgggaaacatggtgaaaccccatctctaccaaaaatacaaaaaaattagtggggcatggtggtgtgcacctgtggtccagctgtgtgggagggtgaggtgggaggaacacttgagctggggaggcggaggctgcagtgagtcaccactgcactccagcctgggcaacaaagtgagaccctgtctcaaaaaagaaaaagaaaacaagaattagggatgcttgacgaaatggccgattccaaatctggtgcaaaaaaatgcataaggtatgcctggaacatcttttgagaggaaagaagctctcaatgactcataaggttaagtcataaggactgaagagcccgcctgaaaagactcccactggccaaacatgaatcaatttgagaatcaataaggatgatcactgtattggattgaaacacacctaatatgtttaatccatgagttcataatgatactgaaaaaaaattcatcactatttgaaggtggtgaaagaatgaatatcattttttatttattattgttaatgtatgtaagggatacaagtgtagacttcttttttgttgttttttgaaacagggtcttgctctgttgcccaggctggagtgcagtggcacaatctcagctcactgcaatatctgcctcctaggctcaagcagtcctcccacctcagcctcctgagtagcagggaccacaggcccgcaccaccatgccaggctaatttttttatagttctttagagacagggttttgccatgttgcccagcctggtctcaaactcctgggctcaagcgatccgctcacctcagcctcctaaagtgctgggtctatgggcatgagccactgctgccagccacgtgaatatactgtatagtagtgaagtatgggcttttagtgtactgcatcattattttgaaacttacgataaaagtcttacagctggctacgcatggctcacacctgtaatcctagcactttggcaggctgaggtgggagaatgacttgagctcaggagttcgagaccagcctagtcaacatggtgagaccctgtctttaccaaacatttaaaaattagctgggttgtggtagtgtacacctgtagtcccagataactcaggaagctgaggtgggaggatcacttgagcccaagaggtcgaggctgcagtgagctgtgattgagccagtgtactccagcctgggcaacagatcaagaccctgtctcagaaagaaaacaaacaaacaaaaagtattcctgctaatgagtgaaagaagtaataacagaatcgaaatgtcaccattttggaggtggacttccaaaatggtggagtaaggacctcagggtgtatgtatagctgaaacaatattggatgagttgataattgttgaatctgggtgataggtatgtagggattcattccttccatctacttttttgggggtaataattaagatataattcacatgccagtgtgaattattcaatgtttattaaataactagctatattacctaaagcatgttaaagagggaaaagaagcagaaataattccttctggagaaagtgggacaaaagctgtattatgatcatgcttataaacatgaagatttctcaattggatgtaacttagtttcttctaaattctgattttcactgttatctaaagtcaagatggttgatagatatgggttaatgagtggaacacggcttatgcgaaacttcatatttctagaaatatcatctagtgttaaccctgcctcctaagatatatgctataaaataaaaatagatgtctagtaaaggtagggaaaagggtttatggggttataactatcagctaaagtgaggatttttttaactatgcatggattacagctaggatcttcctttagccccagtaattttaaggtggtttaagctgtttgttatcctgggctatagctcagcgttaccacagcttgttacacagagatataaatgtgcttggtaaacgtattctttcaggttgaaactagatgattatgaagcatagtatcttgctggtaaacctttgctctcattggtggtggtgttcctcctttccccagttctgcccttgtgcagaattcagttattcatttgttctttgggctttccgtgtgctttgatcatttcctcccacctcgctcccttccagctttcatttatccttccaggccaggtcccatttttctaaaagccctttcctaataatcccctccctaatgtcttttgtacttattttagcattgtggaggaagagagggggaacctggttattctgttattcaagtgagccttcagttagttgaagattatatatttcaagtgtcactagttgtaaatgtcaaaacagtctattgaccaaaaaaaaaaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccaggtgagattgtgtctcatctttgcatggttcctggcacataatatttgctcaataaagatttgttgagtaaatgaataattgatcttgtaaatttgggcaaataagtgttttttaagttttggggggtttttttgtttgttttgttttgttttgttttttcttttgagacggagtctcgctctgtcgcacaggctggagtgcagtggcgcgatcttggctcactgcaagctccgcctcctgggttcacgccattctcctgcctcagcctcccgagtagctgggactacaggcacctgccaccacgcctggctaatttttttttgtattttttagagacggtttcaccttgttagccaggatggtctcgatctcctgacctcatgatccacctgcctcggcctcccaaagtgctgggattacatgcatgagccaccgtgcccagcctttttttttttttcttttttgagacggagtttcgctcttcttgcccaggctggagtgccatggcacaatcttagctcaccgcaacctccgtcttccgggttcaagtgattctcctgcctcagcctcccaagtagctgggattacaggcatgcaccaccatgcctggctaattttgtatttttagtagagacaggatttgtccatgttgggcagactggtctcaaactcctgacctcaagtgatccgcccaccttggcctcccaaagtgctgggattacaggcgtgagccaccacgcccggccaattattttaatataattttatatactttcgaagaacagtttataaggaaactacagctctccagttctgcctctcctctaagctatactccagactccttctaatgatatctaataataatttatattataagtgatgcttttaccaggttgtagactttgttctgggtgcctggctttgaagtcaccactgactttgagatcattaaatccagcagatagccacgattcctgcgtcttttacttgtcctgcagattttaacagagttagcagtttttaactctttttcccctttaagttcttatcagagtagcaaaaagtagccatatttgaatctcttccgtttttcttttttctttttttttttttgagacagtctcgctctgtcacccaggctggagtgcggcagtatagtctcggctcactgtaacctccacctcctgggttcaagctattctcctgcctcagccttctgactagctagggcttcaggcatacaccactatgcccggctaattttttgtgtttttattagaggtggggtttcaccatgttggccaggctggtctcgaactcctgacctcaagcattccacctgcctcggcctcccaaagtgctgggattacaggcatgagccactgcacccggcctcttccctttttcatttatgctgtcaccccgctctggagatgctattaactaaggactactagcctgagaaataaagtagtgggaatgacctctcaaagccaaataattagcctctgaatgggaaggaccagagaacgaatacaatttaagttacctgataaatttaaaatcgagagagatggattctttgctcagttgggatacaattaatgtaacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaataatctgttggccacatttttgaggcaggacgtactgatgaaatggaaggttttagtctgctaatatagtttccaggatagctctgtgattttatacatgaagaaaatacaggagtttccccttgtccacagctttgcattctctgaggtttcagttacccgcagccggctgaggtctgaaaatattgcatcacttctcttgcgctttgggaccattattaagaaaacacaagccctgcaataccgcgacagtcaatctgataactgagaccactactaagtgattaacagcaacccaggtggacagatcaggtcggggcaagattttatcacactatactcaaaacagcttgaaactgaacacttatgaattaatttatttctgggattttccatttacatcacaatgcctacatcattcacctctcttcatctcatcatataggcattttttatcatcttatatctttacaaaggaagggtgagtagagtaagatattttgagcaagggagaccacagtcaaataacttttattgcagaatattgttataattgtgctatttcattagttgttcaccttttgctgtgcttaattaataaattaaactctatcataggtatgtatgtataggaaaacacatagtacttatcgggtttgatactatccgagatttcaggcatccaccggggtcttgtcacatatttcctgaagataagggggttgctgccgtaagatccatagaggttaaaatggtggttagtggtaaattggaaaatgaaactaagcctttctactgtaattcctttatggcttgttgccacctaatattgatgtataatgtgctctaattgcactattaaagtattataaattacattcaaagtttttcctggctagatcttgtaattatttaatgtccaaaattgagtaactgagattacccacatggggaagtaactcaccttatgaagcagttgcaaatatgagagtaaaatttttaaacccctgaatcccattaaggttactctagggtgagagagcactgaaaagtgattgacgataagcaaaactatagtctcatcaatgatgcctctgtttctgaagggaaaatttgttaaaagatagacagcaacaatttgggttgtgttttcccacatagtccaaaagagagacttaaataactgggaaactttgtgttaaagatgatttgtacaagcagccgtgtttgtgttattatcagacttatctgttgcactttacccttatttaaatatgagtgaaaagttaaaaactagaaacgtcaatagcaaatacgtgtttcgtaattaaccagagacagacatgaaaatccctaagcaaatcttcggcctcagtcgagcattcactggacttaatccacttgactcaatagtaatcatttatgaataaataagccagcattagcatgtaaagggagaggatccatacaaagtggtgtgattgtttgtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttaggtaaactagctaaataattagcattattatttgtttctgggatactttaaattgtttaatttagtttataatatcatttctatataaaagtattttgtgctttctacaattattttacattcaagtgaaagcctcaaaaaaaaaccctgtttatacatttaattggttgcattctaaagatgaagtcccattatgattaattacatgaaacttcaaacaattttaggtagctgatttttttttttttttgagacagtctcgctctgtcacccaggctggagtgaagtggtatgatcttggctcactgcagcctccacctcccgggttcaagtgattcttgtgcctcagcctcccaggtagctggaactacaggtgcacaccaccatgcctggctaattttttgtattttcagtagagacgaggttttgccatgttgcccaggctagtcttgaacccctgagctcaggcaatccgcccgccttggcctcccaaagtgctaggattacaggcataagccaccttgcctggccttatatagttgattttgacataaggaatatatttctaaaaatattatatttccaaacctgacctgaaatgacacaaagctaacccattatatgggaagtgaattaggacattagtactttttaaaaaaatcctacaggatagaattggccattgtatttgttattcactcaattttagcaaattggtgacatgattattgttaattggtagtattacgagaaaaatagatactccacacgactcatcaacagcttaaattgctaagtgtcaatgttaccttcgtcctcatcccagtctcactctcagaccagttgagtggtagagtatagtatatactaaactgagcaaaagtttatatagagtctcaattctaaaccagcattctcatttaccaggtgaaacagctgaggcccagggaggagcaaggaattgcccaggttgatacaatgaatgacaaatggactcagatccagtgtagtgccttccctggtgtcatactgattccttgttgaatgcctggcttttttctttactcattaaaaatgtgtgttacgcaaataatataatcattttaacaaggattctaaataagaaggaaggagcactgctgggtgcggtggcatggtagtggcctgtagtcccatctactcaggaggctgaggcaggaggatcccttaagcccaggagttcaaggctgtagtatgctgtgattatgcctgtgagtaaccattgcactccagcctgggcaacatagcgagaccctcatctctaaaaaattaaaaagagagagagaaggaatactagtagtcccacaattctgactgttttctttatccatcttcagttttgatacatgtgtgtttgatttctgcattgttgtaatcaacatgtaattataattttatattctactttatttctcttagcattatttctaaatcattttccaattgctacatatttaattccttttaatggctacataatttatcaaattgtcatatcataaataaatttacctagagtcttagcaattaaaaaagcttgttttacaaagtatttccaaggtagactctctttgtacatttcccattgtaacttagtatacatatgtgtatatattataaaactgaaatagaattttcacaatattttttgtgcaatgcacagcttaaattctatgctacattttatttcagttttaaaaaatactggttgtaacctctgaatttcagaagtcaagtggtcagacagtatataacagagaagagagacctgtttttcaaactcctcttttccaaaacctctgtagctggccctcaagattctccatcttctggccacaatttacctttttcagctttatctccacttatgcccttgcaataacccagtggttttaatgagtcaaaccaacaatctagaaagcatatcattttctttaattataatgttattgtttaaaaaataatattaaaaagttacactgttttgatttagttagaaagttgcattccaaaattattctttaggaaaatacagttgattcccagatgtcaagcaaatagaaatgtcctttttaaaatctttctttcatagtctgacactttccccatacttgtcattcagtttgcttaaatcttatctccttggcaaagccttctaaagttccaaaaaatgttacctttctttggatttccacagtatcctctctttaacactcattcagtactaatttattttgttatttgtaaagtattttttctatgtaatcagactgaccaggtttatatgttaatatgtttttgtataatctgtgtggtgaggtaattatatatgcagacacacaaaaacacatgtacatatatttgcataataagagaagtccagaaaaagtgctttgaaatctcagaaaaaagagacattaataatcacttgctggagaagtaatgctttggctggggctagaagaacaggtgtgatttgggtacgaagagattggaatggcaggttttccaaattgagaggatcagtggcaaaatccccaaaataggcaatgcagggcttatatgaagaatgtaagtggtacagtatgactgaagatttgtgttactgaaaggacataatcggagataatgttgaaaagggctctttctggacaactttgaggaccagctaaagaagttttataattgaggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacctgtggctgtatgttataaaatggcagatttgtagtttcttttcttctaatgtcataaccttgtttactggttagccagcatttgcctgaacaactcatgaactcatgctctcacaagggcgttcattccccattttgaaaatgctacttgttagaaatcatctctcatactgagccaagatctgcaactttaattctaggaggtttttaaatttttatttacaaatgagaacttccacaaaatcctgtgtttcagaaacacggaccacagagcgtaatctcatcataatagagtttccctccccctccttgactaaatattattaggtcttttaactctccttgctagaaattgctttcttgacctttcatcctccggttctcccttgtatatactctgagtctaggtctgggtcttgatgttcatttaaagctaaatacttgtttgcttgttttgtttctaattcattttttattttttattaaatatctagtgtaaataatcagatagcagtgcaagactttgataaacgacagtcccccttcccactcttggtgtctgctgctcagaggcaccttcagtctgaaaatatacatcctcttgtagacatttttctggcattatttctttttaccttctttttctctttttcactcttcctggaacttctatgatttgcatgttagacttccattaattatcttttctatttttcatctcttgattttctactttttaggatatttccttgattttatctttaactcttctgtggaatttttaaatttctatcaaggcaatttccgagagctcttctttgttctctggatatctctgtcgtgcattcgagtctgagggctgctgggcttttttagcgacgtctgcatgcatgtgcgggtcatgtgtgtagtgttctctgtgtgttgtttttgtttcctccagtttttttgtggtttattttggactcaatttattttagagatattcaggaggtgactgatgtgctgggcgctcttataaagtgccttacaatattaactaattcagtcatcaccataaactacctcaaactttaaggtagtttccttttttttttttttgagacggagtctcgctctgtcacccaggctggagtgcagtggcacaacctcagctcactgcagcctccgccttccaggatcaagtgattctcctgcctcagcctcctgattagctgggattacaggtgtgtaccaccatatctggctaattttttgtatttctaatagagacagggtttcaccattttagccaggatggtcttgatctcctgaccttgtgatccgcccacctcggccccccaaagtgctgggattacaggcgtgagccaccgcgcctggcccactttaaggtagtttctgttatccccatttaacagataatgaaactaaggtacaggagcgttaaatagttacacaccgtcatagaattagcctcagagctaggatctgaacacagcagtcttgaggcttttgagttttcattgataacaactgcattatactgtctctgtatcattaagtttcactaataaaatggttagctagaacaggggcaaggacagagttctacagcatgtcaatagaggcttccctcttggcttacaacagtccattcatcaccacttcttgttcagctagttacatatctgtcttcagaccatgtttctgttctttatccatggagacacaaaagacttgactatgtgactccaaaaagttagaggtgtgaggcagcaagaaggaatgggtgggacattgactctagagtcctacagacctgtaatagaaacctgtctcctcctactcttgactatgtgactatggcaaatagttaaacttctctggacttcagttttttcttctataaaatgaggagaatgatatctaccttgctgggtagttgtcaggattcaagataaagtgcctagtacactgcaggcctttcataaatgataactattgttatctgccagtctagtaatccttttaaaaaaggaaatacattaagacggatggtttgtttttatgaacttttgctaactctattattgtttcctcccccttagagctcacaaagcagctatttgataacaggctctagaattttgctttgaatttacatcaaatcaccagcctgtagtttttggcaatcactttcaaattttttgaaaattagaacaatgtttgtctgtcctcactttccatcagttctcttattcactagatgcctcacacacgtgtcagtgacaggggctctgagatcctgtttgcaggtttcctttgtactctgaggtataatctgtctagacaaggagtcttgggctagtctctgatagctaggtacccccttttatctccctctgagcctgtcttggctttcagttccatccgaccattgtgtattctctttccaatctgatgcttgttttccttgcagagaaaacagaagtaagataggaattcagcaattccattttacatctcatacctcacatttctctcagtcaccagaagtccaaatttcccaggccattcttgtgcagatgcccctcctcaccctgccatcttcactccctgttctgtcctcacttcctgtccttcctggcttgtaaaccatttaactgactgctctgtcagcaatgtccctgtagcctcatccgcttctctgatcattttcttccccttctttctctaattgttttctgaggatatgtactgtttcccctgcagcccacctaaactgttttttactctcacagactttaggcctgagaggtggcaaaggcatctgttgtccttgcttcctattgccattttttttcctttttttcatctttttttttttttctcgctctgtcacccaggctaaagtgcactggcgcaatctctgctcactgcaacctctgcctcccaggttcaagtgattctcctgcctcagcctcctgagtagctgggactacaggcatgcaccactatgcccagcttttttgtatttttattagagacagggtttcgccacgttgaccaggctggtgtcaaactcctgatctcaggtgatcctccagcctcagccttccaaagtgctgggattacaggcgtgagccaccatacccaggcgcagctgaggttttagatgaaggaaagggctggcacggtggctcacgcctgtaatcccagcactttgggagaccgaggtgagtggatcatttgaggtttaggagttcgagtccagcctgcccaatgtggcaaatccccatctctaataaaaatacaaaaaagccgagcgtggtagcgtgtgcttgtagtcccaggcactcaggaggctgaggcaggagaatcacttgaaccggggaaacggaggttgcagtaagccgacattgcaccactgcactccagcctggaagacagagcaagaatctgtctcaaaaaataaaataaaataaaacctctactgctttgaaattctatttattagttatggcttaatttttaaaatgggagtgggctggcaggattcagttgttcaaacatcatatcaggagttgctctgtctctcacttcccttctctctcctctcttctgtcccatctctccgggtcaaacctccatttctttctatgtgctttctacttttcctttgtatcaatcttatttgaaatctgtctttctttataaggtgacagaaatggccaccagaatcatattaagcttggaaaaagggaggtactttttcccagtcagccctaagtatttccagagttaattttcactgggctgccttgtgtcagatgcctactgagggagtgggaagggtaggtctaataggaaatcttggtaacagtatatgttaccattaaagggaagcctggattccaggcagatcaaaacaacaggtagggctcttgcctgtccaacgcttaacaatacactttgtgttggcacagtgagctttgcacatgaagttagttaaaaataaaatcatagttaactgataaacctttgttccagccaatgaccttgcttaccccaagaaatattatttattaaatattatgaaattaaatgaaaacagttatgagctcttatgataaagcgtagagacaacccaatttcaagttaattcacaggaagataataggacaatatatggttgtttatgatcttgtttttacactgcttcatattttacatatgtgactttcaaaatcttaagacttgactgggcacagtggctcacacctgtaatcctagcactttaggaggccaaggcgggaggatcacttgagcccaggagtttgagaccagcctgggcaacatggcaagaccctgtctctacaaaaaataattaattaaaaaaaaaaaaaagaagaagatgtgttgtgttgctgggcacagtggcataggcctgtagtctcacctacttggggaggctgaggcaggaggatctcttgagcccaagagtttgagggttcagtgagcagtgattgcaccactgcagtttaacctgggcaacagagccagaccccctttctttctttctttctttctttcttttttttgtgagacaaagtctcacttttgtcccccaggctggagtgcaatggcacgatctcagctcactgcaacctccacctcccaggttcaagcgattctcctgcctcagcctcccgagtagctgggattacagacacgcaccaccatgcccggctaatttttatattattagtaaagacggggtttcaccacattggccaggctggtctcgaactcctgacctcaggtgatctacccttcttggcctcccaaagtgttgggattacaggcgtgagccaccgtgcccagccccactttaaaaaaaaaaaaaaaaaagaaaaagaaatcaagatcttaagacttttttttttttttttagtgacagggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatcattgcctgaaaacattgttgctatgcaaatttctactgatgatatgaattacaaatcacaatttcaaaagcaagttgctcttttgtctctatagcagctgtagttttataaaatgtgtaattataacctattgtagtacggctctaaagtcattacaaatgtgatgtgcctttgaattaacattttttagttcctaaaacaaactcatgagggccaagtttttaatgattttgggatgggcaaaagcaaaaatggattcgcatgctaaaaatgtattttagaattctgtactgatgagaatcgattaatacaaagtagagaagcatgttttatgtgttaaaatgttaaaatatagggtagtctataaaggatatgaagtcaggagtgtcttaaatcagtcaaactacttctttgggtctaagggctcactgcatgccatgtgctatgttgggcgccgatcatttaaagatgaataacaaatactaagtagttcctgccctcctggagctcacagcttagtgagagagaagttttgagaggaatgaaattagccactgaaggctccagagaaaagccaaaaataattttaaaaccttacatcaaccctataaagttatcaaaagtattttttagctgaaataagtttataaagtacagccctccctatttttgccattgatgacttaataccacggaggtttttcttacagttacgctgctgacctttaaaacaacgattaatggatttatttttgtatcatgttagaatgtgtcatacttgatgtttgcaattatcttgagacagttgagtgttggggttagcgtaactgccagagctccgtgagtacctcttgttctctgtgctgaaccagagttgcgacagccaggctgcagagcaggggcacgtgtgagagatgttatgaaagaagagcctgaggaagctcagatgactccaaggtttcagacactgatgactgggaaaactgtgacaccagtaacacaaacaggggagtcaggaggcggagtcagatttggagaaaagctgagaagggctagtttaagtctagaggttaaagtgctggtaagtcattcaggtaccaatgtcttgcagacaacgggagctgtgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgtaccatagtgagaaagcatattactttatatcctttgttctggttgttgacatcatgaagtttatagccctgtaagattttcaactcgaagctcattgtgttgaactgatctagaatttttctttgggaatttttcttttttctagtctaagcagttttggaaatcaaacagaaaaatcgctgtcagagaccatgaccatttctggcagtttatttgcaacaatctggtgttgcatagtggttaaatcatatatgcatatatgcatagtggtccatcagctatggaccaaaggcctggacttaaagaacagctctgctgctcacagcagtgtggccacatgcaaggcactttactccctgggcccattttctcatgtgtgcaatggtgatagcagtaaagtacctggttcacagagtggcatgaggattaaatgaaaatcatttagcacgatattgtgttggccccactttaaagagtctaggacattcattgtgctgttaaagcttatgacagctgttcaatgatttatagtcattcacatgagaatattaaatcaacagggcagagcgcaaggagaatttgcagtttcagtacctatgtgtagtcctccctctgtctatcacctgacttgtgacctttagcaagttagctagtgctgtcattattgtataatgttgactgggcatctgaactttttcatcctggtttttagatttagatagccttggcttaataatcagcatttcaatttttattaatttattaatcactctgtgccttcctttcaaccctattttggtgtttcagaactctaacgctggaaaaaaccttggcaatgatctaatccattgattttttttttccagggcttcccattgtcctttagggtttcaagacggcatttttaaggtccttccaccccaatttcaaccacttgtgagagagagatatatataatatataattatatataatatgtatattgtattgtatataatatgtctattatatataattataatatatagtgtgtgtgtaaatattccaaataaggtttattttatttttatttcttattatttttgagacagggtctcttgatctgtcacccatgctggaatacagtggtgctatcacagctcactgcagcttcaactgggttcaaacaatcccccccaccttagcctcccaagaagctggggctacaggcatgtgccaccacacctggctaatttttaaattttttgtagagatgggatctcactgtgttgcccaagttgatctcaaattccctgggctcaagcagtccacctgcctcaggctcccaaagtgatgggatttataaataataaaagtaaataaacattatatagaaagtaattattttaatcctagtgtcatttttagagactcttctactactagaaataaaaactttactgtattccactacattttaagtttcctgccctaattcttgcctttgctattatatatgtctatataagatgtcctaggccgggcgcagtggcttgtgcctataatcccagcactttgggaggctgaggcaggtggattacctgaggtcaggagttcaagaccagcctggccaatgtctctactaaaaatacaaaaattagcaggatgtggtggtgcatgcctatagtcctagctactggggagggtaaggcatgacaattgcttgaacctgggaggtggagattgtagtgagctcagatggcaccactgcactccagcctgggcaacagaatgagactctgtctcaaagacaaaaacaaaaacaaaaaaaacactttttttttaaagatcatttttacacattatttaaattgcctaaatataatagtttgagtcatttgagtatggcaaattgttggcaccagggacaatatgccttggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctggataacctttttattaaatagttcgtgatttgtaaaaaataaagcacagcagttaaatttgcagttgaacagaagtctgaaaatttgatacagataacctctagttcaatctgtttttattctacaagaatgtatcttagtaagaacttttaaccaatgctattttttgctgatgtaaatttttttaacgaatagaaaatcatttcttttttcagtactgccaggtcggcatagttctctttcccttatatcttaaagtgcatacacacatgcatgcctgcacacatatatctttttttctcatggctgagtttaaggaagtaaatgaatgcattctacttaactcttcacaatgtagttgggggtggtggctcatgcctgtaatcccagtgacttggaaggcaaaggtgggaggattgcttgaggccaagaattcaagaccagcctgggcaacacagcaagactttctctacagaaaaataaaataagctggacatggtggtgaaaacctgtggtcccagctgcttaggaagctgagggaagagggtcgctagagcccaggagtttgaggctgcagtgggtcatgatcatgccactacaatctagccttggtgaaagcgagaccccgactcaatcacattgtgattaaaaagaactgttttaagagttatgagtcaccacccctcaataagaccactagtttggttttcttccaaagaatgtcttagtgcagtggtggtagccattgttcaaccatttgtcatattatggccccttcattgtcattaatctttaaaaccctgaaatacatttatctaaaaaaaagatgccatacagtaggactggaatatcttgtataccaaattcatatttatcttatttacaaagatgaaaaataaagcaagaaaaggaaataaataatgagaagaccattttgtgttatgcttttttttgttttgttttgttttgttttaagacagtcttgttctgttgcccaggctggagtgcggtggtgcaaccttggctcactgcaacctctgcctcccaagctccagcaattttcctgccttagcctcctgagtagctggaattacaggcacctgccaccacgccaggctaatttttgtattttcagtagagatggggtttctccgtgttggccatgctagtcttgaactcctgaccccaagtgatccacctgcctcagcctcccaaaatgctgaaattacaggcgtgagccaccacgccctgcctgagttatgcttaataagggttttttaaaatgtatgtacttacatacttgttatgttgagatatgtatttcctttgataggtttgatatgtgactaataaaatatttataaaacctaaggacaaatgtaattttgtcaggttaatgtataaaattgaaattgtttactacttttatacttagattccagctacatatctgacaggtgataagactgactcagaagctacaaatatttacctccagttatcaaaaaaagacccaatcataaaacttctatatgtcactccagaaaaggtttgtatttatatcattattttaaaatatattaaagaccactagaatacatatatttttaagattttaacaaaattttgtatacgtagtgcaaagaatttttgtacaactttcatccagaaaccccaaatggtaacattttactataattgctttgtattctctctctgcatatattttcctgacacatttgattgaaaattgcagacatggtatccttttaagccctaagtacttcactgtacatttcctaaaaacaacgtattctctcatataacctcagtacaatgatcaaaattaggagatgtacattgatgcagtactattacttaatctgtaaaccttattctggtttcactagttgtcccaataatgtcctttatagcaaaagaaaatcccagatcatgcatgcattccgttgtgcttctctgtaatcttgtaaacagtttctctctcttaatatctttcgtgattttgaagtttttgaaggccagtcgttttcggaattgtccctcaatttgagtttatcttgcttcctcctgcttagattcctgttactccttgaatatcacagaaacagtgatatgttctcatgcccactgtcaggaggcacttgatgtcgattcgtcccattactgacaatgttagttaactgatcgcttggttatggtagtgtctgatagacttctccgctgtaaagttactcatttctttttggcctttgtaattagtagatatcctgttgtgggatgctttgagactacgtaaataccctgctagtgatcagaattttacccacaagttttagtatccattgatgattcttccccaaatcagttattactatgatagatataaaattattttttaaatgtagttggtgttttgccataaggaagagttttcctgttggttacactttttttttctttttttttttttgaggtagagtctcactctgtcacccaggtgggagtgctcggctcactgcaatctcggctcactgcaacctgggttcaagtgattctcctgcctcagcctcccaagtagctaggaatacaggtgtgtgccatgatacctggctaatttttgtatttttagtagagatggggtttcaccatcttggccaggctggtctcaaactcctgacctcaggcgatctgcccacctcggcctcccaaagtgctgggattacaagcgtgagccactgtgcccagcccacatatttattgatactagcatgaactcgacttcttaatttattcaatgagttacattcaattatcaagtattttgatgttctaattgtcctacatgtgaccagtgagacatctctctcaagctggcttctctgtccttttgacatgtcccggtcaagatgtgagtgctacatgtgctcgttgctactgagatgtcattgcttctaggccctgttatgaagagagctataaaatatataatttttcccccagccaacacgcatccatataacccagatatgtaaccctgttgccaatgtaaatgtatggtggccctcagatgtcttgaagcagacaaaagtttgagaaccactaacctgctaaataagctgtttgcttaatgttggtgaacattctaaaatttgatctgctattttctattacttctgctgttctcttcatagattgaaataagaaccaattttatatggaggtgtttttgtttttgtttttgttttttcgagaccgagtttcggtattgttaccaggctggagtgcagtggcacgatcttggctcactgcaacctccacctcccgagttcaagcgattctcctgcctcagccttcctgagtagctgggattacaggcatgcaccaccacgcccggctaattttgtatttttagtaaaggtggggtttcaccatgttggttaggctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgcccaagttgtaacccgatggcagctaaatcagaacgtttggggctgagagccagtatttttttaaaaatccccaagtgattacaatgtgcagcagagtttgggaaccagagtcctagggcttttcttcacttactgaaattaaaactccttttcagtacctactttagaagtagggataaattgcatgccatatctatcatccctggtatagtcccagtaataaattaatttttacttatctaattttggcttccatatatcctagagtatacttcttgaaatgaaagatgaccctgctttgtcatttccccctaaggtcccagttgaatccaggatgttgaaaatagtccagatactatgtcgaatagcttttttactttgttttcttctcaacaacaaaatgcttcttgttgccaccaaatccataattcttcagtaacaaaatctactataaaagaaatccccccccccttttttttttttttgagatggagtctcgctctgtcgcccaggctggagtgcagtggcctgatctcggctcactccgagttctgcctcccggggttcacgccattctcccaccttagcctcccgagtagctgggactgtaggcgcccgccaccacgccaggctaattttttttgtatttttagtagagacggggtgtcactgtcttagccaggagggtctcgatctcctgacctcgtgatccgcccgccttggcctcccaaagtgctgggattacaggcgtgagccaccgtgcccggccaatccccacatatttatctaggctgtactggattattttatacttctacctgagtttgtagagatatggattctttggtaggtttattcactcagcaaatatttatttaacaactgttgtgtgccgagtttaaagtatttttttcttctgatttattagtgtgcactttagtttcagatgtaaacattaacatggtatgcctgaaggagtaatgactgaattggatattgaggtgaatttttaaagcacggcttttgttcatttgaaaataaagacaagctggtgctataaatattataagcagtaagaatagcaacagtatctcttagagggttatgagaagaactgaaggttccttatgaaggatatgaatgggtcatgtgattaagatagctacaaaagcttttgcaggttaaactggcagcttctaaattatctgatctaaatcaaggaattcaagcattttgggtttcttccagcctttaagttgtttggttccagcctagaattattttattgctagtagcactgttatatagcacaaatgaccatactcaagtgcaaggattttagagtcctcagaattttgtgtgtgtgatcacaaagtttggaatggaatattgtaatttaatctcacttgcagaggagtatttgtattaaatttggggaaaaatattttgcgtctataattgatatgcattataatgctatatttaagatgtcgtattaggctgggtgcagtggctcatgcctgtaatcccagcactttgggaggccgaggcaggtggatcgcctaaggtcaggagttcgagaccagcctggccaacgtggcgataccccatctctactaaaaatacaaaaattagccaggcctactggcgtgcgcctgtaatcgctgctactcaggaggctgaggcaggagaattgcttgaacccaggaggcggaggttgcagtgagccaagatcacgccactgtactccagcctgggcaacagagtaaggccctgtctcaaaaacaaaaaacaaaaaacaaaaaaaaagatgtcatattatactttagattctaataaataacctatttgcaagtaagtacttctgtaagtactacattgatctataatttttttttttttttttttttggagacaggtcttaccatgttgccatgttacccaagctggtctcgaactcctgggcttaaacagtcctcccatctcagccttcctaagtgctgagattcttctgtcctcttacgccggatgcaatctactgttcttttagatcagttacatcaatggcaaatgcctatagttaaatgataaaaaaaatttcttttccttttgaatgactttttgtaagtataggatttgtgatttatgtttgagtaaacagtgtacatatttatttatttatttagaggcaggcaccttgaatctgttttcttagtactgtggggaagagatctgcctgggaaagcaaggttgtggatttccagtctccagcacttggtacataattggcactcagtaataatcaataaatgaaaaatgtgaaggaatttgggtaaatgtaaaaatgtaggcatgtctgttgactccttaatgtgtttggcacttctctgcatttggaagtaggaaattttaaggaatactttctgggactctgtttcctgatcttttctgccagtaggccctggtttggattaaatttgctcaactgctgctatgtcgtggccctggcgaagtcaggtattcctaaggttgaagccacagcccctgtgctgctctcctcccgccagtctgtaataatattcttcctctttgggaaatataaggcacacaaaaaaggctttattccatttccttagggccttaaaatatgaactggaagagagcaaagagacaggcacatagagttaactataatagaacaataataatagctaacacttacatatccagcctactcagtgtgccaggcactgttgtcattttaagtgtatttacctccttgtccacacaaaagcaaggtaggtactcctattttcctcattctacaggtgaggaaattgagacacaaagagattatataacttcatatgcctagcaagggttggagtgagaacttaaaacaccagatagctggtttcagaatcctttaaatactaggtcaaattgcagaaagaagaaagcagtgatttgagatgtaaattacagctgcaggaactgaagaagacaagataagctagaacccccagtaacagctgttacaaggaggggtcagatcaagttttgtaaaggcactgggcattgtaggaggagtagtttatttaaaagcataggttgggcatggtgactcacgcctgtaatcccagcactttgggaggccaaggtgggcggatcacctgaggtcacgagttcaagaccagactgaccaacaaggagaaaccccgtctctactaaaaatacaaaactagccgggcctggtggtgcatacctgtaatcccagctactggggaagctgaggcaggagaatcacttgaacccgggaggcggaggttgcagggagccgagattgcaccactgcaccccagcctgggcaacaagagcgagactgtctcaaaaaaaaaaaaaaaaaaaaaaaagataaaagcgtagacagcagccgagcgcagtggctcacagctgtaatcccagcactttgggaggccaagggagacggatcacctgaggtcaggagttgaagaccagcctggccaacatgttgaaaccccatctctactaaaaatataaaaattaaccaggtgtggtggtgggcgcctgtaataccagctacttgaaaggctgagacaggaaaattggttgtacctgggaggcggaggttgcagtgatccaagatcatacgactgcactccagcctgggtgatagagcgagactccatctgaaaaacaaacaaacaaaaaaaggcttaaacagctgtattgaaataaaatttacataccataaaattcacctaaagttgacacttcaatggccttttttttttttttttttttttttagtttataaggttgtgcagccatcaccattatctaattttagaacatttttgtctctgttgaaagggagagtatacccattagcagtcaattcctactttctcactttccccattcttaggcaacccctcatctactttctgtctctgtaggtttgcgcctattctggacatttcatataaatggaatcacataacatgtggccttttgtgactgacttctttcactgagcatgtttttaaggttcctccatgttgtagcctgttttcagtatttcattcctttctattttcagataatattccattttatggatcctactttctgttttatttgcccattcatcatttgatggatgttcaagctgtttcagtgttttggtttttttgaataatgctgctgtgaacatttgtgtagaagttgttctgtggtcatcagttttatttctcttgggttgctgggtctgtggtaactgtatgattaaccttttcaattcaaggactactaaactagttttcaaagtgcctccgtcttttttttttttttttttttttttttgaggcggagtctcactctgtcacccaggctggagtgcagtggtgcaatctcggctcactacaacctccacctcctgggttcaagcgattctcctgcctcagcctcccaagtagctgggactatttttgtatttttgtatttttctaattttgtatttttagtagagatggggtttcaccatgttggccaggctgttctcaaactcctgacctcaggtgatccacccatctcgacctcccaaagtgctgggcttataggtgtgagccactgcacccgaccgcctccatcattttatattaccttcagcagtgtgtgggggttgcagtttttccacatgcttatcaacacttgttactgtctttttttattacagctatatgaagtggtaggtgaacggcattttagcaggcaaagagtgaaaattcagggctgaagtttctgttataaaagtacaggtcaggccaggctcggtggctcatgcctgtaatcccagcactttgggtggccgaggcgggtggatcacctgaggtcaggagttggagaccagcctggccaacatggtgaaaccccatctctactaaaaatacaaaaattagccgggcgtggtggcatgcacctatagtcgcagctactcgggaggctgagacaggagaattgcttgaaaccagaaagtggaggttgcagtgagccgagatcatgccactacactccagccaaaaaaaaaaaaaaaaagtacaggtcaggcccaaggaatggtgaataatccattggataagtggagaaacatagagaagggatgaccctgacaaggtggcttgacgccagatcatggaggatcttgcatataacgatggtaaaatgtttggactttattcttttggcactttaacctgggaagtggcttgatctgaactgtgtggatgaatgataaccctggcaagagaatagaggagaggatgagtgagagaacagaaagttagaggtagagcagcccttcaggaacttattgcctattgcagtcattgaggagagatgatgctggtggaaacagcagaagtggaaggaagaaacagagtcaagagagagggcaggaatggtaactaaatggaatgagaagagtggatacggttgaagtttatactagttcctggggcaggtgcctagaaccattgaccataaatggaatggaggaaggaagatgagtaataaatttgattttagatgcatgatgcctgggatgtttaagggatgagtggatgaccacgatagccatcttcataccttctttggtcacatgtacctcctgaaaaaatcctggaaaactatgtacctcctgcatatatacatatatgttttaaatatatatataatatatatgtattttatatatatgtgtgtttttattttttatatatatatgtgtgtgtgtgtgtgtgtgtattttagaccaagtttcactcttgtcgcccaggctggagtgcaatgacacgatctctgcaatctccacctcccgagttcaagtgattctcccgcctcagcctcctgagtagctgggactacaggcacttgccgccatgcccggctaatttttctatttttagtagagacggggtttcaccatgttggccaggctggtctcaaactcctaacctcaggtgatccacccgccccagcctcccaaagttctgggattacttgagccaccacgcccggccataagcatacattttgattgagaatgtatctcttaatgagataggccttttgtttgtttgtttgtttaagagatgaggtctcgttatattgttcgggttagtctggaattcctggcctcaagtgatcctcccaccttaatcttctaaatagtgtggactacaggtccacacccagctaggacttttgttgttcacttagttgacatatctggatgaattgggtccatttatatttcttatttttatggatgtaagcactaagaaatattgctcacataaacatgtagatgggaatggaaggcattttttgtagctgtaacaattatttgaattccttctgatgtatatgccaagattacgtaatgatcagtcatcaaaaattatttttaattatctgtcaattgacaactcaattaggtctttcaaatttgtggtaagcaaagaattggaaactctctgggaaaataagcaagatcaatcgttattcactttactttttctaggaaaaataccctaaaaaaaagctttaccaatacttacctaatgactattaagtagtcttattattctttcaacaagaatcttgttccctgtatccaatatgtatggaagagttggggaaatcaaaatactgttagtttcagtatacctttccaatatgatatttttgacaaaatacttttattgtgtgatacgcttttctaataacttttttgttgttgttttttgagacagagtcccaatctttcacccaggatggaataagtacagtggtgcgatctcggctcactgcaacctctgcctcccaggctcaatttatcctcctgcctcaacccgccaagtagccaggactacaggcgtgcaccaccatgcctggctaatttttatgttttttgtttgtgttgtttttttcgtagagacggagtttcaccatgttgcccagactggtctcgaactcctgagctcaaaggatctgcctgccccggcctcccaaagtgctgggattacaggcgtgagccaccattcccaaccatattgtgtgacatacttttaaatagagttttgtcaaaactgtggctatagattagctctttccaaaaatgggaaatgaccaccatataacctaattggtaaagccagtctttattgctaaattagacttcttttctttgtgggttttgttttgttttgttttgtttttgtttttgttttggagatggggtcttactctcactatgttgcccaggctggtcttgaactcctgggcttaagtgatgttcctgccctagcctcctgagtagctgggactacaggcacatactaccatgcctggctggcttcattttccttttcttttttgaggggggtggggggaatggagtttcactcttgttgcccaggctggagtacagtagctcaccgcaacctccacctccgggattcaagtgattctcctgcctcagcctcccaagtagctgggattacaggcgcccgccaccatgcccagctaattttttgtatttctggtagagacagggtttcaccatattgcgcaggctggtcttaaactcctgacctcaggtgatctgcccgcctcggcctctgaaagtgctgggattagaggcgtgagccactgcacctggcctcatttttcaattcacataaactatttagtacacatcccatgacaactattgtcaattccaaaagcaacaagctgagctctaattgactttgtttcctcacacaacactttgaaaagacatgagtttgacaccccaaacaggataatatttaccattttaatggtaatatccagcagaaccttagacaagaaacagtagaatctaacttttaagaaaactttattaaaatgtaattcacacactataaaattcatccatttaaagggtacaatttagtgggttgctttttttctgtattttcacagaattgtacaaccatccccaatatctaagtttacagcatttttatcaccccagcgagaaacctggtacccattagcagctgctccgcatcttctccctcttgtttgtgcccggcttctttcactgagcgtagttttcaagggtcatccatgttgtagcattggtcagtaagtacttcattcatttttatagctgaataatattgcagtgtatcagtattttgcattttatttatccatttatcaattgatgggaactgtctgtaactaggtatttggtaattccaaacatcttattttccaacaggcagagtaagatttgttacatgtaataaactccaagggtctattaactttttcattataacaaattgtgtaaatattgctttcagttagttacccacagtccttttgcagtagagatagttgtcttggttttaattggattcatgatctacaactttatgttctaatctcatgtcatttttattatttttagtaaaagtaatttgtttgactaaattaactggtaaacagttctgagctttttcaattgtgtctacaaattttaagaaattcagattatgtgccagatgtttttagtaacagctttgttgcggtataatccacataccatacaattcccatatttaaaaagtacaattcaaagtttttagtatattcagaattgtacaaccattgccagagttttagaacatttcatcaccctccaaaaacacccatgcccattgcagttcaatctccttttcccctcacatccccatcctgccagccctaggcaaccactaatctgctttctatgtatagatttgcctactctgggtatctcgtgtaaatagaatcatccaatatgtgatcttttttgtgactgtctacttagcataatgttttcacggtttattggtgaataatattccattgtagacgtctacgacattttattcatcagttgatattgggttgtttccatttttattttttactattatgaataatgctggtataatcatacatgtataaatttttgtgtggacatatgttttcatttctcttaggtatatgcccaggagtgaaattattgggtcatatagaaactctatgtttaaccctttcttttttttttttttgagacggagtctcactctgtagcccaggctggagtgcagtggtgcgatcttggctcactgcaacctccacctcccaggttcaagtgattcttctgcctcagcttcctgagtagctgagactacaggtgtgcgccaccacgcccagctaattttcgtatttttagtagagatgggggtttccccatattggccaggctggtcttgaactcctgacctcatgatccgcccaactcagcctcccaaagtgctggaattacaggcatgagccaccgtgcccagcctatgtttaacgttttaaagaactgtcgcactgttttccaaagtggctgtgccattttacattttcactagcgatgtatgagggttctaattttttcatatcctcaccaacacttgtttttgtctctctttttgacccaaagatttttttaaattaataaaacacttttctgaaaataaatatatttttttaatgtgggaaaaagcaataaggccattgttatgcccagtcaccatagcattcctatcggtggagagactcatgcaccgtttccaacttaagcccaaatcaactcaaatgcattttaagattttcttcatcatttgtattcctagacaattctttaatctactaccttttttgccacaatctgctacacattctgccttttcaagcactaaaaggactctaggagttttttgcaaagaaatgctgtcataagagtggtggtatcaaagtattgtttaacggtagtctcaaagactttcagggtaatgcattctgtgattatagagatgaaagaaacaacatcataaagtgaaggtcatcttcattcccaccaccttattctcagtatatctgaaatcagaacatcctaataaggaccaaaatactttgttcctagttattcttcacccttaacagaaataagtaaaacaccgaaagatatgaggccctcctaccaaggatttctagtgctttaattaaagaaaatttcacctacactcatactatttttcagtttgctttgtttggtgtcctggaggtttttacatcctggaacagtgcacagtggtaaaattcagaatggatgaaaagtaggattggtttgtttgttttcaggaagtgaggcaatcgtaaaagggaaaaatgggaaaggcgaaacaagcaggatgtctttttttttttttttttctttttagacagagtctcactcttcgcccaggctggagtgcagtggtgtgatgtcggctcactgcaacctccgcctctcaggttcaagcgattctcctgcctcagcctcctgagtagctggaattacaggcacgtgccaccatgcctggctagtttttgtatttttagtagagacagggtttcaccatgttggttaggctggtttcaaactccagatctcatgatctgcccgccttggcctcccaaagtgctgggattacaggcgtgagccaccgcgcccgtccaggatgtcttttttctaattagagacgagggtctcactttgttgcccaactggtcttgaattcctgggctcaagtgatcctcctgccttggccttccaaaatgttgagattattgatgtgagccaccacccctggccagaatttcttgtctgtgggagcattctcagatcagtcttatgaaaaaggacagccagcccttcctatctgcagtttctgcatctgcagattcacccaactgtatatcaaaaacatttgaaagaaaaatagtttctgaaagtttcaaaaagcaagatttgaatttgctgagcaccaagcgctatgctgtgtccacatgaatgaagtgatgtgtaggcatactctgctgtatcctcccgccaggacagaagaaaaatgtcacatagttactgacagtacagtgtagcaactatttacatggcatttatttaatacattgtattgagtattataagtaatctagagatggtttaaagtgtgcaggaggatgtgcataggttatatacatatactacaccattttatatcagggacttgagcatccttggatttaggtatccgaggaggccctagaaccaatcccccatgggaaaccaagggatgtgaaaattgagggtctgaatttgtttaagattcacagaacagactgaaaagacaagagaggagataatggagagaacaagctcactgaggaagtgggcgggaggaaatggggcaagaatagtagaccagaggaagaggaggagcacatctgtctcagagtcagccacattttatttggggccaagaacaaaaataaagtgactgtaatcagtagggctttaactccttctgctgtcctgcagttagctttttatgtatcctggggtgtccaatcttttggcttccctgggccatactagaagaagaacgattgtcttggaccacacataaaatacactaactggccgggtatggtggctcacacctgtaatcccagcactttgagaggccaaggtgggcagatcacctgaggtcaggagtttgagaccagcctggccaacatggtgaaaccccatctctactaaaaataacaaaaatgagctgggtgtggtggcgggcacctgtaattccagctattcaggaggctgaggcaggagaattgcttgaacccaggaggtagaggttgcagtgagccaagatcgcacccttgcactccagcctgggtgacaagcgcgagactccctctcaaaaaaataataatacactaacagtaacaatagctgatgagctttataaaagaatcataaaaaatctcactgttttaagagagcttatgaatttgtgttggaccacattcaaaaccatcctgggctgcatgtggcccgtgggctgcgggttggatgagcttgagtacctggtcaaaatttgggaacattgatggcctaaaaatacgtatatttcctgtgtgatttccttaatattttaaataatgttctaaccatctctgcttttagtcagcctcatcttggagtcaagagactgggctcctgacttactttgtctttctatatgttttctcttccacaatcctaattttttgtcatctagtcccataaacattccctctttatcaccattcttttctttaacccttagccttacttccatttcagtgttctattgtgtaagctgctagcgacaatattcaacttaagactacttggtaggctgggcccggtggctcatgcctgtaatcccagcactttgggaggccaaggcaagtggattgcttgaggtcaggagttcgagaccagcctggccaacatggtgaaactctgtctctactaaaaatacaaaaattagctgggcgcgatggtgggcatccataatcccagctacttgggaggctgaggcaggagaatggcttgaacccagcaggcagaggttgtagtgagccaagattgtgccactgcactccagcctgggcgacagagtgagactctgtctcaaaaaaaaacaaaacaaaacaaaacaaaaactacttgatattagcttgggctgctatgacagaatactgtagactgggtggcttaaacaacagaaatttatttctcttggttctgaaagccaggaagtccaagatcaagatgctggcagatcccaagtcagatgaagtccctcttcctggtttgcaagtggtagtattctctttgcatactgacatatgcgggtggggagagccagcaaggtctctacttatttttgagcacttatctcattcataactccacccctcatgacctaattatctcccggaggctccaactcctaataccatcacactgggggttaggattttaggggggacacatgtagtctataacaatacctaaagtcatattttctcataataactaaattttatgtttgggacttttttaggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaacattcctttttgcattatgacagcactaacttgctctttatagagcagactattgcaactctctcaattctggaaattataaaatctcatttggtttaataacaataaattctaacaaaaatatattaaatactccctcctacacacgtatattataacttttggtttcaatgtctttcctcaggcttctatcagtgtttgaattatacagctttttgttttagtgccttgtcccaagcctgtctgcctttgcattatgttaactaaaatgagattctgaaattcatagtagttttccatgtaaccccctttccacttttccatggagaatatttttggtatttctattttattttttagaaattagtatacatatttgtgtggacaaatcagtcagtagagatctaccaagaaaaagtcagtgatttccccgctcagactcacctcccccaggcagctaatgtcaatagcttcatgtgtatatctagacctttggctcagtcacagagagatgacttttcctttaatatcttttaatttccatttctaaaaataacacacataataataaatataatatatgctcattaaagaaaatttatatggccaggcactgtggttcacgcctgtaatctcagcattttgggaggccgaggtgggtgaatcacttgaggtcaggatttcaagaccagcctggccaaaacggtgaaaccccatctctacaaaaattatccagacgtggtggcacgcacctgtaattccagctattctggaggctgaggcagaagaactgcttgaacccgggaggcagaggttgcagtgagttgagatcgtgccactgcactccggcctgggcgacagagcaagactgtctcaaaaaacaaaaaagaaaatttagaaagcaacaaaaagaagaaacaaaagacaaacatcactcaatgagcaaaatcactgttatgttattattaatttctagtatttttctatgcatttttttctactagcatactatatacgtttctaccgttaatctactttatatatcatgagcattttcccatgtcttttaaaaacttagaaaacacttttgatagttatagtatattttatttcacagttccctgtatttgtttccctaatgttgctcagtaaaatctttgtaatttttaaagtttgaagtaaaacttttgtttatgtccttgtatcactttatttcctaatttcccagaaagaaactgagtcaaaggtatttctaagactcttgatacatactgccatatgcttttgacaaagtttgtgcaagaatggcttttcttttttttttttttttttttttttgaggctgagtctcactctatctccaggcaggagtgcggtggtgcgatctcggctcactgcaacctctacctcctgggttaaagtgattctcctgcctcagcctcctgactagctgggattacaggtgcccaccaccacacctggctgattttttttgtatttttagtgaagatagcttttcaccatgatgtccaggctggtctcgaactcccgacctcaaatgatctgccctccttggcctcccaaagtgctgggattacaggcatgagccaccgcgcccggccaaggatggcttttttatacccacatgtatctagtgtgaagtagagcccagagttcatccaggtccacctcacgagtcattagcagcgacaggattaaaagccacatctcatttccagcacacatgaattccttgcttgaattattcacgtgtgtggtcttccagcagtataagaacactacgggagatctatttatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactgaaatttaaaaaacagattttctttgagacttctaaagttgctttttctttcataaaaaaaatctgcttgagatataattcacatatcataaaatttatcctttcaaagcaaacaagttagtactttttagtttatttgcaaagttgtacaataatcatctctatctaattccagaatttttgatcaccataaaaagaaacctcatacccagtcacttcccccaccccctaatgcctggaaaccacaaatctactaactactgctaacctgtttctagagtttattactctgtacattgcatgtaaatagaatcatacagtatgtggtctttgtgacttttcttttttttttttttttccggagacagagtctcactctgtcgcccagactacagtgcagtagagagatcttcgcttactgcaacctccgcctcccaggttcaagtgattctcctgcctcagcctcctgagtagatgggattacagatgtgcgccaccatggccagctgatttttgtatttaatatttttagtggagactcaaactggtctcgaactcctggcctcaagtgatccacctgcctcagcctcccaaagtgctgggattataggcatgagccacctcgcctggcctgtttgcttttatttagcataattttttcaagatttatccatattttaggatatatgagtacttcatacctttttatggtcagataatattctgttatatggatataacacagtttgtttatctactcatcagctggttagacatttggcttgtttcgtttctttctttttttttttttttttttttttgagacagggtcttactctttcattcaggctagagtgcaatggcatgatctctgctcactgcagaccgtacctcaaacaatcctcccacttcccaagtagctaggacgacaggcgcaccactatgcctggctaatttttttattttttgtatagacgaggtctccctgtgttgcccagcctggtcttgaactcctgggctcaagtgataatcctgcctcaacctaccaaattcctgcgattataggtgtgagccaccatccccgatgtgtttctacttcttggctactatgaataatggctttgtgagcattcacgtacaagtttttccacggacatatgttttcagttctcttgggtagacacctgggagtggacttgctgggtcaaatggcaactctttgtttaacttttagaggaactgtgaaactgcttttcaaagtggctctgcagttctgcattctcaccagcaatgtatgaggtgccagtgtctccacgtcttcaccaatattttttattgtccagcttttttaatgtattcatccttgtgtgtgggaaatggtatctctttgtgggtttttttttatttacatggaagaccacacacgtgaataattcaagcaaggaattcacgtcacccaggctggagtgcagtggcgcaatcttggctcactggaacttccgcctcctggttcaagcaattctcctgcctcagcctcccaagtagccgggactataggcacatgccaccacacccagcttatttttgtatttttagtagagacagggtttcaccatattggccaggctggtcgtgaactcctgacctcatgatccgcccacctcagccccccaaagtgctgggatgacaggtgtgagccaccacgcctggccctctttgtggttttgatttgcatttccctagtaactaacaatattgggcatctgtttccgagatgagaaatttgccgtcacccaggtgggtggggaggaaagctgaaaatactttaggcatctcttttttttttttttttttttttttttttttgagacgggagtctcactctgtcgcccaggctggagtgcagtggcgcgatctcagctcactgcaagctccgcctctcgggttcacgccattctcctgcctcagcctcccgagtagctgggactataggcacccgccaccacgcccggctaatttttttttgtatgtttagtagagacgagggtttcaccacgttagccaggagggtctcgatctcctgacctcgtgatccgcccgcctcggcctcccaaaatgctgggattacaggcgtgagccaccgcacccagcctactttaggcatctcttattgtggtaaatgccagccttggatagatccctctaaatgaaaggatgaatttcagcaaaacaactaataattacttggagccaatgaaaagtttcagctcaggaaaaagtatttactttgaagattcagaggaaaaatatctctcaaaattgttttctctgggaaaacagaaaattttagaggatatcagtttagtatcccgagaaagatataagaagacttaatatacgtgaactagtaacaacttccataagatcacagggtgagatgaagggagaaataaaaatccagtttatggccaggtgcagtggctcacccctgtaatcccaccactttgagaggccgatgtggacggatcacctgagatcaaggagtttgagaccagcctggccaatatggtgaaaccctgtctctactaaaaatacaaaaattagccggacgtggtgatgggcatctgtagtcccagctactcaggaggctgaggcaggggaatcacttgaacctgggagccgaaggttgcagtgagccgagatcgtgccactgtactccagcctgggaaacagaacaagactctatgtcaaaaaaaaaaaaagaaagaaaaattcagcttatccaagtaagaaaaacaaaactaagagcagaattatatattaagacacaaatggaatgactcagtctcagtggagacaatagaatcagtgatgtagtgagtagcttgagaatgcaagggaaaaaagagattaaaatggggtggggtggaaattatctttgttgacaaaaggaggtaaggattcagcctaagaatagtaagtgtacccaagcaagaaagcaggataattgaaacagataagtgtgttataaataaatacataacaaatatataacaaaaataatagaagactgtcttcagaattggaagaaggaagactgggactgaagaatttcgtacccagctcactgtcatttatgttgaaaccaacaaaaggtcattttcagatatgcaaaaagtttagaaatacatcactcatttgtcttcactgaaatactgattttagtcttcccaaattagtttatatatttaacccaaatgccagtgttttgtttttttttttttttttttttttggttttttgttcttttccctttgataaactttttctaaagtttgcctggaagaatattcaagtgaaaataactaagagagtttggcaaaaaacctaataatacaggaacactagtttgcagtacattataggcagatcagtggaacaggaaaacatgtaaaaacaatacatgataaggaaaaagtttgcatgaaagggccaggcatggtggttcacacctgtaatcccagcactttgggaggccaaggtgggaagatcacttgagcctaggagttcaagaccagcccaggcaacatggcgaaaccccatctctacaaaaaatacaaaaattagcctggcatgctggtgcacacctgtagtcccagcttctcgggagtctgaggcaggagaatagcttgaaccctggaggtggaggttgcagtgagccaaaatcacgccactgcattccagcctgggcaacagaccgagactgtctcaaaaaaaaaaaaaaatgatttttttcaagtgctttaaatggttatgtatagtataaataatctacaatggagatatatatatatatatatataactttgataaaaaatatggttaaacaataggggtttataaaaacctaattatttctgctctcagactaattaatccttacagtcagcatgtaatattagcctacaccagctcgacagacttgatctcgttagattcatgagatagaataaaacttggccattattcttcacaaagaatgattgtggcttgaagttttaaaagcgcagaaataaagaaggaaatcacaattaaacaaagccacttttcccaatttcaagaaataagagctttcagaaagagttggcagccttgcatcctcatctggaggctgcaggcggtgcctcacagccctgtgcccgccctgatactgggagatgcacctggacttcatggaaccctgtgggtcatgcttccggacctgtcggctgacacatcttgctgtgcagcttctccacctgctctccatcactagaagctacaatagtctttctgtttccaaggagatttgcctttgatcagagtgccataaatgtagatggatgactaaccgagagcgcaggccactcaccgccattcctggtgttgataaatgtacccctttactgtccacatactccagagcttgcagttccttccgctggtactcacagttactgaaatcatgtcattagtctcagtctgcctgccagatatttcagatgcctttgaaatactgttcttgcagtagcaattcatttttttaagtgctaaaaaaaaacttgcagttttatttgtgaagtgtaattttgcctggagatataacattttggtctgggttaaatagctcctaaattctcaactgaaatggatatccttgaaaactgatttatcaagctcctgagagtgaactatcaccttgcttccactaagtaatttgtaaggtctaagatccgcagtccctggtgttttttttttttttttttttttttttttttttttttggtataagtagctctcagacttttacccacatgagtttccattaaaattgtacaagctttgactttaaatcagctgatgaatagaaggagttgatgtgtgatcagctggtgctattgggaaaactgatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattggcaattttattttagttcatttttattataaaagtggtaagtgcttattttgtaaaactcaaatgatacagatgtgtacaaggcagaaaatttacaaaccatgccttgtagttttgcccccaaaataactctagttattggtttcctttgtatcctttcagaccctatttctgcatgcattcttgcatgtaacacatatttcaaacatgcaggaagataaaaaggagaaaataatgagctgtcatatactaccatctggattaagaaataaaacacaatcaatcgagctgaacccctccccaccaccccatagcctctcttgtctcatccgtcctctcccattagaggcaggcaaatatcttgtatttggtatgtaccttttccaaatgcacatattttaaaatgtaaatgggattatattatacatactttatatatataatgacccgatttttttcagtcaacagtaggatgtaattatcattccaatgaatacatacagcctgactacctagaattccgtagtatggttattccatggttattaaactaatcccctcttactagatcttgtttattgtttttcactgttatcaacaatgcagtattgaacatccctccctatacaaatatctttgggcatttttgcagttacttatataagattttttttttttcaagaccgagtctcactctgtcacccaggctgcagtgcagtggcagaatcttggctcactgcaacctccgcctcccgggttcaagcgattttctcacttcagcttccagagtagctgggactacaggcatgtgctaccatgcccaactaatttttgtatttttagtagagacagggatttcaccatggtgtccaggctggtctcaaactcctgacctcaggtgatccgcccacctcagcctcccaaagtgttgggattacaggtgtgagccaccacgcccggccttataggataaatttctagagttaaacttgctgggtgaaagtgaatacatattttagaattttattacattctttgctcatttttctcctgggttgtgagagttaaatatatttcctaaatatatgtatttcttctgagaccacttttttttttcttttttttttttttgagacggagtctcgctcttgttgcctaggctgaagtgcaaaggctggaatgcaatggcacgatctcggcccactgcaacctctgcctcccagatgcaagcagttctcctgcctcagcctcctgagtagctgggattacaggctcccaccaccacacccagctaatttttgtatttttagtagagacagggtttcaccatgttggccaggctggtcttgaactcctgacctccagtgatctgtccgcctcagcctcccaaagttctgggattacaggcgtgagccactatgcccagccgagaccacttttaaattaactctggcagaagtacagtgcataggaaatggcacttaccaagcactgtgcccaacactgcatatatcacctcattaccttatttgttcaaaacaactaacttgtgatgtagaggtactcccataaaaagtgagcttcggaaaggttttgtaacttttccccaggatcactgatatggcaggagcaataagagtcgttgtagtagtagtataacaatggtaattattatagataagtgtttatttagcccttcctatgtgccattctaaatgccttacatgtatcatcaactaatttcatcttcacaataaccctcagagataaaacctttgctttcctcattttacagaggaggaaaatgaaatgcagaactagtaaatggtagagccctgacagaacccaagttcgtctgattccaaagtccatgttccttgcactataccaaagtgattctcagtgaagaaaattaaatatttacacttggtttgcccatttgtgttttttttaaaatctatattaaagctaggcccaaacatggccaggcatggtggctcacacctgtaatcccagcactttgggaggccgaggccaaaaaaaaaaaaaatttaggcccaaacaatttaatagatatttaagtcctgatagcagcaactatttgggggaaaaatactcataaactggaagaaaaaaataatattttttaaaaattattttcttttttttttttttgagacggagttgcgcttttgtcacccaggctggagtgtgatggcacgatctcagctcactacaacctccacctcctgggttcaagcgattctcagcctcagcctcccgactagcagggattacaggctcgcaccaccacacccagctaatttttgtattcttagcagagacagggttttgccatgttggccaggctggtctcaagctcccgacctcaggtgatccgcccaccttggcctcccaaagtgctaggattacaggcgtgagccaccgtacctggtgttaaaattcttaagtaacaacagttgcttactgatggaaagtatgccactgctgttctcacacattggaatcaaatccgacactgccaccctcatttcctgtttcacattgattttcttgagatacttctttttatcatagcaactgcgaaaaacccagctttgcaaagatgagatattgctaataggaatgtagcacaatctaatgttaataccattaactacctcaagctaataatttgggtgatgttcaacagatgttaggcattgctgtgtttcccttcatgtaaaatattctgtctctgtgagttcaccacagcacccccgggcttgttggcacacaattttggaaccactggtgtaactactttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttggaatggaaacatttaaaaagtaatttcatgcggtatcttttctttataattagaaccctgttaaaaaatataatggacatcagcatatccagaatattgagtttatatatgtgcactgatgattacagaatattttagaaatattaatatgcaaacatccaaaaagatccaacatgggcaggtagaatattttaaatttaatatattaatgttattaatataatacattatattaaaaatttaattgattaaattaaatatattaaaattgacgtattaatatttaatattttaaatatttaattaatatactaaaaatctcattctcaaaagagtaataactagtgtaccgtatgtttgaattcaaatcaattacattactctttttttttaactataaagaataacagtaactgcttgtggataaattcactattatctgtcctaaaatacccttggaaggttgttaaattcagtcattaggtacttattttacctatcttggtaattctacattttaatgtctactgtaacctactgcttactgagcattttcacgtttggtgtattatttacctatctgggagtattagacttatatgtgcaagatgctggagagccacaagtgaccatggtatggaccaattcatagactggagtggagaccgacatacatgtgttcatagaagtttaacactctggcttggcgcagtggctcatgcctgtaatcccagcactttgggaggccgaggcaggaggatcacctgaggtcaagagttcaagaccagcttgaccaacatggtgaaaccttgtctctactaaaaaaatacaaaattggtcggctgtggtggcccatgcctgtaatcccagctacttgggaagctgaggcaggagaatcgcttgaacctggtaggtggaggctgcagtgagccaagatcatgccattgcactccagcctgggcaacaagagcgaaactccatcaaaaaaaaaaaagtttagtactctcagtaagtatagttaaaaaatacagagcacagggcagaacagagggtagtctctctcagtgtggaactggcaaattcatgccatctcctcccaccccaccccatcccttaaacattgctatcagttccctcattcaacagatatttgttgggctgtgtaacaggcactgttgtaggaatttgggatacatcactaaacaaaatgaaaatccctgcccttgtggagcttacactctagcagagggaggccagttacaaacaatatacacaataaatatacatgaaaggataagagctgtggtgaatggcacagcagagtaaaaagacaggaggaatgggtagagtgcaggatgcagtattagacggggtggtccttggaagtctaactgagaagatgggagctgaggaaaatcttgaagaagggagttagctggcagctccctggatgtgagctttcctgcaagaagctttggctagagcaaaggccctaaggtgggggtgtgcctggtgtgttcgagagatggcaagggagcccatgtggctgagcaggattaagagccagtgaggggaagaggtgatggagagccagagcagtcagttgagggctagagtcccagagtaactggaggcctgagtaactggaaggatggagttatccttggctaagatgcagaaggctggttggcagagaagatcaggagtttggtttgggttacctaaattgggaatctaatattgaattacatattaagattcaaaaattctgaaaacagactggtggcacatgggtgatatttaaagcatggccatcagctgacagtcgggataagagaagggacggaagagaaaggagaaagtatgaaatagttgtctaggacaggggtcagtaaacttgcttttaaagggccacagcataaatattgtacacttcgcagccatagtctctgtcacaacgactcacagctttgccattgtagtctaaatgcagacataaataataaatacaccaattttctagtcatcttccatggctgtgttccaataaaactttatgcacaaaaacaggcatccagctcctgggccatagtttgctgacttctgttgtgagagaatggaggaatgataggctagggaagtataaagataatgattgcctacagcattaacagtccattcgagctttgtggccacgtagtgacagtgaaaatgccaagttcagccacataggtacagggacctatggagatggagaattggatccattatgttttgccaggtaatatgttgaagtgatctaagggcaagagagctgagggtctatgagaggtagtgattataatgatcgactggaatttcagctgagttaggaggacatctgaggttgaggatcagcagatgggcattcccaggggattgttggagtcagaataccacatggtatgagttggaaagataggatgtggtggtctgagaatggaggagttgccattattagtaagcttaaggtaggaagtgtgagcggctgatgtatgtggaggacaggatcattggagcagaggagatcaagaaccaaaagaccaaagtaagaggatcagctctgtatacctaatcaccaagaattaaggtagatggccaggtgcagtggctcacacctgtaatcccagcactttgggaggctgaggccggcggatcacctgaggtcaggagttaaagactagcctggccaacgtggtgaaaccccatctctactaaaaatacagacaaattagtcgggcatggtggcaggtgcctgtaaccccagctactcaggaggctgaggcaggagaatcgcttgaacctgggaggtggaggttgcagggagccaagattgcgccatcgcactccagcctgggcgacgagcgaaactccatctcaaaaaaaaaaaaaaaaaaaaaaaaaaaaaaattaagataggaatggagtgacagggcactttttcttgatgactctagatagggcctcagaatcacttgcagttgttagtgtaagaccagaaacctgttcatctccaggttattggtgtgtgcaaatgacaaggattagaaggtagggagggctgcatacacagaagcaccaagcatgatgcagctttttacacctgtgagtggtcagtattgatggtagagagaactaggggagagaaaggcaaaaagtcatctagtaacggggactctaaaaagtgggcaaagtttggggatagctgaaggaaatgagaaaggaaactagcaggagatgatgaaaagagcgttgactatggcaccaaagaccccagaggggttagaatccgtggatttacgtggcaccccacaggttcccacccagtatgtaacagagcactattctaggaggcatggaggatttaaattgtgtgtttgtgtgtgtgtctgtgtgttatatatgtgtttctacccacagagtgctatcaggtagttgaaagacaagacgtatctctgtgaaacagtaacaacatcgagtggtagttgttctagaacttagataagaatgaacatttgaaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaaagaaagtcaattattatactgttttatataatgtatatgtcactaagttgagatggtttcacatacaaagaagaaaataataaagcttatgcgagttcatctgagtgggtggaatgtaactattaaaatgtcagtaaggaaataaaatgaggattagacccataacagcatagagaataggagagagactattatcagattagtgccttaaaaatctctcaggggctgagcacagtggctcacacctgtaatcccagcactttgggaggccgaggcgggcggatcacctgagatcaggagtttgagatcagcctggccaacatggtgaaaccctgtctctactaaaaatacaaaaaattagccaggcatggtggcatgcacctgtaatcccagctactcgggaggctgaggcaggagaatcgctagaacccgggaagtgaagactgcagtgagctgagatcgcaccattgcactccagcctgggcaacaagagtgaaactgtgtctcaaaaataataaataaacaaacacacacaaaaattagccaggtgtggtggtgggcacctgtaatcccagctactcgggaggctgaggcaggagaatcgcttgaacctgggaggtggaggttgcagtgagccgaggtcacgccactgcactccagcctggcaacagagtgagactccatctcaaaaaaagaaagaaatggacagtaaagaggaagaccaaataaatagaatatttgaccctgggtgatagaaataattgaaaatagtagtttgggagagaggggagagaagactccttagtatcgtcttaaagagtttttaaaataaatacttaaataataattgaataatggaaaagaaataaaaatgagaaagagctgtcaattttaaatgattgacaaagtaaatttagtggagaggttggaaaataaagtcaagaaaatttaggaactgatcaaaatgatatatggaaaatagagaaagcatagaaaggattaatcctcagtagatgtaaaatctgacaaaaattttggaaatagaaaataaagggaattatcaaaccaatgatctaggaaaacttcctagagtggaagagataaaagttttggattaaaatgctcactgaatgccaaataagatgcctgtaaaaaaaaaaaaaaaaaaaaaaaaattaagacatatggccacgagatttgagaatactaagagttaaagacatgtcaaagaggaaaaacttttcctcaaccctcttaggttcagtgatggggcctgcaaattaaaccaacaaaaaacagattagcaagggaaaagacagatttagtcatgtgtggataggagttcacagaaaaatgtggttcaaaggggcagttagaatgtggggcttatataccatcttaatagaggaaggggagaaggaggggggcacttatggaaaaacaaatgactgttaggaaagacagatggactgttaggagaccagatgggagatacaaagtttttatgacaatgtctgtttaagtgtggtgtgaagtcttatctctgtttaaaagggtcagccttccctggtttttcccagggaggcaatttatgacaactgagttcttttgggaggccctgctttttggcagataagagatttcagatgccttctgctcaaaataatttttatgccacagtggcatattctggaccccttcagagacaattctgaaagctctggaaagaaaacaggaacccaaaccagactgacatcagcttaatatcagcaatcctggagactagcaggcaaagaaagtgagcacaggtcgtgatttgataagtggtggaacccacccatgggtccagtgaagaaaacccatagtcacagtcaggcagcagggccagtaagcaatctatgcagactaacaaaagtcaggaggaggctgggcacggtggctcacgcctgtaatcccagcactttgggaggctgaggcgggcggatcacaaggtcaggagttcgaggccagcctgaccaacatggagaaactccgtctctactaaaaatacaaaataagctgggcgtggtggcacacaccagtaatcccagctagtcgggaggctgaggcaggagaattgcttgaacccgggaggcagaggttgcagtgagccaagatcgtgccattgcactccagcgtgggcaacaagagtgaaactccatctcaaaaaaaaaagaaggaacagggcccacccaacgtagagagagagtaagaaaggaatggttttattgataacagtgaagaatgcaaatgttacttctcaaccaaaaaaaaggagagaggcccttagaaactccagggaaaagattatacaagagagcaagatcaaatataaaacaaaggaagttgtggccaggcacagtggctcatgcctgtaatcccagtactttgggaggccaaagtgggtggttcacttgaggtcaggagtttgagaccagcctggccaacatggcaaaacctcatctctacaaaaaaatacaaaaattagccgggactgatgttgtgcacctgtaatcccagctacgcaggaggccgaggcagaagaatcacttgaatctgggaggcggaggttgcagtgagctaagatcgcaccactgcactccagcctgggtgacagagcaagactccatctcaaaaaaaaaaaagttgtaaaaaaaaaaaaagttggtaaaatgtacaaaaaagtcatccatttgacatgatgggtaaacattctccttttggttccataagagtcatgacattgttccaattagggaaggaaatttgtcatcatgtaaacaacgattgaaatcaacatacagacctaaacaaggttacaggacagaacaagatgtaaatgttaatattgatgatataaaagtaaaagtacaatcgctaaaagtaaaagaaggcatacagggaaggcttgggtactaatgacatctcacatgtgggaaggggtagtggtcagaagttctattgaaagttagaaacataattagtacatgacccaacagtatcatataactagcaaaattcagagaagaataaaacaaagtgggggtggtatgaatgagataaaacctcatctttcataataaaggggcaaggacaatagataaatgtcaggcttttggacagaaggcaagatttcaggtccttctgtgtgtaggtagccacctgaagagctgaaaacaaaaactgtttaaaaagcgattcccttggggaagggaaggatgagtcaggggaatgttgcttttaattataaacctttctgtctgggtacagtggcccatgtctgtaattccagcactttgggaggccaagacagacggattgcttgagcccaggagttcaagatcagcctgagcaacctggcgaaaccctgtctctaccaaaaatacaaaaattaatcaggcatggtagcacgcacctgtagtgccagctactccagaggctgatgtgggaggatcacctgcgcccatgagatcgaggtggcagtgagctgtgatcccgccactgcacccccagcctgggcaacagagcaagaccctgactcaaaaaaaaaaaattgtatttcagccagctttcgtagttgtcctcagcagtaaggttggtccataccattcagcctatcattagcagaacggtagttctgtttctataatgtggcctttcagggatacaaattacttaaagaaaattttgaataattcaggatatatggccagaagccatttgaaatggacaataatataattatttggaactctttaaaacagagctaaagctttacgtaataaccattaattctgatttttataaatgtcacaaggtctcttaagtagattgttacaataaagttgtgtttataatgaagacattagcagtcacagcagcttatgaatgaaacaaaggatccagccaactgtggctctcggctagtaagagaaagagggaagtgtgtgtacatattcctgtcttcatctctccccttgagcatcttatagggtgttgtgcttttcttttagaatttgaataggcttcattagtgagggtgacaaaaagaatagacttaaatacttggattataaactagtagcagttttgataaccagggccagggatcatatttagaaaactgactgtcaaaaattgtttgtagccaggctcagtggctcatgcctgtaatcccaatactgtgagaagccagggtgggaggactgcttgaggccaggagttagagaccagcctgagcaatgtagtgagaccctcgtctctacaaaaaaattaaatattataaaataatgtaaagagtgtcattggattgtttgcaactcaatggataaatacctgagggaatggatggcccattctccatgatgtgcttacttcacactgtatgcctgtatcaaaatatctcatgtactacacaaatatatacacctactatgtacccacaaaaatttaaaaattaataaatactagatgcacttaaatatttaaaatttttaaattaggtgggtgtgatggcctgcacctgttatctcagctagtcaggaggctgaggcaggaggatcacttgagcccaggagtttgaggctgcagtgaaccatgattgcaccactgcactccaacctccacaatagagtgagaccctgtctctaaaaaaaaaaaaaaaaatgtagataagtaatgcacagttatcctaatacatagcacagtgataggaagctattatggtttatgtaaactctttctttgatttatttgctccaatataattttgctgctgttttttgtccatgtgtattgtaaaaagataaggaaaagtacatacaaccatagaaattttagcgttctactcaaatactctcatttaacagaaatgagtgtctgtgccggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggctattctatgcttgacactggagatacaaagatggagaatgcacagcccctgttcccagtgggctcactatctgcatgacagaatagaattgccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcaggtgggtacacatgtatcctttgttacgtggcacagattaataggccgaaagttaatcttgctagggaactccttaagtgataaatatatctcagtggtttgtttctttttggggtttgttttgagacggggtctcgctgtgtcacccgggctggagtgctgtggcatgatcatgactcactgcagcctcaacctcctgggctcaagtgatcttcccacctcaatttcccaagtagctgggactacaggtacacaccagcatgcccagctaatttttgtattttttcgtagagacagagtttcaccatgttgcccagtctggtctcgaactcttggcttcaagcaatcctcctgccttagcctgccagagtgctgggattacagataagcatgagccactgagcctggcctcagttgttttaattatttttatttaatctctggattaaaatctcagagaaacaattgaaacttattctttttttgtttgtttttgagacggagtttcactcttattgcccaggctggagtgcagtggcgcgatctcagctcatcacaacctccgcctcccaggttcaagcgattcttctgcctcagcctcccaagtagctgggattacaggcatgtgccaccacgcccggctaattgtgtatttttagtagagacagggtttctccacgttggtcaggctggtctcaaactcccaacctcaggtgatccacccacctcggcctcccaaagtgctgggattataggcgtgagccaccatgcgcggccgaaacttattcttttttttttaaggacatctgaagaccattgaatattaaactcattcttaagataaaatatgttctttaacatatatatagtactttgttatatatggtataatggtaccctatgtatgttatatatggtataattttaattatagctctgtgcctatatgaaaaatacatataatcaaagtaaatggtgggtgcatgcctgtaatcccagctactcgggaggttgaggcaggaaagtagcctgaacccaggaggcagaagttgcagatatttgtatataacacagctaaacactataaggcaggcaaataatcggcacaaataatgaagtgatgtctggttttagaaattacaatgatctggccggacacggtggctcacgcctgtaatcacagcactttgggaggccaaggcaggtggatcatgaggtcaggagttcaagaccagcctgcccaagatggcaaaacccgtctctactaaaaatacaaaaaatcagccaggtgtggtggtgggtgcctgtaatcccagctacttgggagactgaggcaggagaatcacttgaacccgcgaggcagggtttcaccatgttggccaggctagtctcgaactcctgacctcaggttatccccctgcctcagcctcccaaagtgctgggattacaggcatgagccaccgcatccggccggattattgtaatttctaaaacgagacattacttcattatttgtgctgattatttgcctgctttgtagtgtttagctgtgttatgtacaaatatctgcaacctccgcctcctgggttcaaacgattctcctgcctcaacctcccgagtagctgggattacaggcatgcgcccaccatttactttgattatatgtatttttcatataggcacagagctgtggataataaaaatcaatgtccaaatcagtaaaaaaaattctttcaataaaagcactgtgtcatagtttaattagcagaattttttcttccttaatagtccataaaataacagtatcttaatatagttggcatcttagatccaatgaaatattgtaatgaccaattgtaatattgtaatgggctgggggccgtggctcacgcctgtaatccctgcactttgggaggctgaggtggacggattgcctgaggtcaggagttcgagactagcctggccaacatggtaaaaccccgtctctactaagaatacaaaaattagccaggcgtggtggcgggcgcttgtaatcccggctacttgggaacctgaggcaggagaattggttgaacccaggaggtggaggttgcagtgagccaagatcgtgccactgccctccagcctgggcgacagagcgagactccatctcaaaaaaaaaaaaaaaaaaagtctgcaatgaagagctagtttccttatgaagagattatgttttatgcttctttgaatctggatctagcacactgctatgtctttagttaataaatacttactggtctgagttatttccatgggcagatagcccaacccagaatttcagtagtagagttcctggaaaacaacgtcttcatatagttggccagctgggctatattaccttccatattcttcttcataaaatctcataatcatcaccttctctcttcttcattccctctcctacgataatcggtcattacaatatttcactgactctaagatgccaactatattaagatactgttactttatggactattaaggaagaaaaaattctgctaattaaactatgacacagtgcttttattgaaaaaattgtgttttactgatttagacattgatttttattatccacagctgtgtgcctgtatgaaaaatacatataatcaaattaccgtaggtacttataaaagttcacattcaaagcctgactcttctgagtcactttttgactgagtcgtccatgtctttgtttttccctatgtcatcactaacattctcattagccataaggcatttccagagtgttccactattttccccaggatttaatcgaaatctctgttatcagttctgttttgaaggtggtggtttcttgatgataccagaaggtgtcaacagaaggttgtacatctctcagtaacaaaaatgtagtgcggcctcatctactttgggcatcttctttcttaggtcacgtaaagcacttggttgtacttgcgagaaactatggaattgggggcctgtgtcctcagagacaaatagtgcctgggttttttttgttttgctttgttttgtttttttggagataagatcttattctgtcgcccaggctgggtgcagtggttgaacacagctcactgcagcctagacctcctgggctcaagtgatcctcctaccccagcttcctgagtagctggaactacaggcatgtaccaccatgcttggctagcttttttatttttttgcagagacagggcctcactgttacccagactggtctcatactcttaggctgaagcaatccgccctgtctcagcctcccaaagtattgggattacaggcatgagctaccacgctcagccagatagtgcttttcttaataccaaatgtattccctgctactctgtttcagaacttttctgcattcacaatcacttttttaatgctaatcacagtatagtctttttgaagacatgtcatggcagttagactcaatacatgaggtacaaacagtgcagtgactttgttgacatgctgacagtactaatagctatgactaagttctcacaagcatgagcagtaacaaccgcaaggcagctgccatttagccatcagcagttctaagacatatcttgacctcaggaatgctaaattgtgaaaaggtgtgtgtcttagaattgatgaaatttggtattttatgatatgttatttctaggcgattagtgtagtttcttaactgtcctccttacctccagctgtgaatgtgatgtacattttaatctttcaaaacctagtaaaactacaacagcttcccagataaagtatacattttatcaagggtctacatttcttcctgcctctcctactttatctttcattaaacccccttcataaaccttctgttctgtccacagtctcttgcttttcctctaaacatgggaatgatgtgaaaatcacagatgggaaaggatttgaaatccactctttgctcagctcaaatacataggaatggttactccctcactacccagagccagtgcatcagtcagtcctacagagccagcctccaaaactcacccaagcttgcttcactgtgtctccactactgcattccagttcactccatcctcactcgctcctgcaatggcttccaccaggctcccggattctactctttcctttacagtcaagttcttaaacagcagccagggtggcctttaaatgacaggcttgtctagctgcaagactgatatgcgacctctatgcagaggactcagctggctgcttgttgcctcaacccacatggggaaagagtggaggaagaaaagtttgtgctggaggaagtaacaatttggttatgccgtctagggtggggtgtacaagtctggagtgcagagaagaggctggagctggaaatagaaatgcagcgttctcagtaaagagagggcacaccagtctcagctagatgagtactggccatgggaacagtgggcaagagcagatctgctccactccacgcacatggcacaggtcccaccctcagcttcctcctgccctggctcttgcccttgctctgccctggcctatgccgctggaattggatggtgggttcctgccctctgtgcctgtctgctgcctctgaggtgctaactttgccttttacaaaattggcctgtgttcccagtaccctgcagttagttggcacttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcctacacctcgtcacactgacatccaagtcagcccccagtggtgtgccagtcacctctgagaggacactagtgcttatgccccctgtgagtgccagttctgaacttactcataggatccaaaaggggacctttgggcccaggggttgctggttcccgtaatgcaagtgctcaagggatcagagccctgggtaccagttccagatctgccaccacgtcatgctgtgtggtctctagcaggccaccaatagcctctttgtgaatcaggttcctccaccaaggaaggaacatgttatctgacaaacatgtctaaagataaaatttaagactagtgtttaaatgttttggagaaatgagcatgcagctagaatgttattattgttagtcattgatagaacctgcctgagtgcatcattatcagacgttcccggagtcacgttaggcctgtcctgtggcacttctaatcatgagcttcatcatcattacagctttagaaatcattgacctgggggaaatgagaacaacaaagcattttgttgtaggaaatattgagagcacagaagtcttctgccctctgataacatcaccacgtaataggacacaacagacaggcccggttcagtgttcttcctgcttccagacaggcagtgtgggggtcttcccaaggatgatggaaatgatgagcaggatgagatagttcaagttctctctttacctagtcgctttttttttttttgacagagtctcactccaggctggagttcagtggcacaatcttggctcactatgcctcccagattcaagcaattatcccacctcagcctccccagtagctgagactacaggcatgcaccaccacacctgacttatttttgtatttttttggtagagttggggtttcactatgttggccaggctggtcttgaacttacgacctcaagtgatccacctgcctcagcctcctgaagtgctggggttacaggcatgagccaccacacctggtcaggttctcctaaattcttctatatggtaattagtccattaaaagccttgttccgaatacattttgacagtgagccagggttggagcagccatggtggagtcctgtgccctccatgctgctcctgtagggtggcctgtaggacaaggcagaccagccaggaaatggagactgggtccccgtgtgagctatctatagggaggtttcatgctttttgggtgccttgggatgcaaatacttatggaaattaccatcttctttgcaaatgtgtgctttcatgcggtctcacctcccgcataatatgtgacatgttcagccatattgtgcaaagacaagtttttttgtctgtaaagagtaaaataggatctagaattttcttatgttcatttactaagaaactattgttcaaagatgagatacaggaccgtttgtttcccttatattgagctgattttttcagcacatttaaaataagtaaaattgcctgccatctttatagcagttgatactttttgaattgcctaccagaactaactgcccaatcaacaacaggaacacaggccatatgcgacagtatgagctaaacctcatgtctctagttaacttcaagactatcacaaatttttttaatgaattctgattctcttttgttaaaaatgaattgccattgaacactttggggctttgtgcagtaaaaaaaggtttggttcttgctgaattgttgaatccatatggcagggaagcagctaggtatctgctaaaatgggcccctgcagcgtgtctcttcatatacactaaaaacacgtggaccagtgcgacatcacctgtaaacatctgcattttccatttgtagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaaggggtatgttttgtgacatctttttcaatatagggaacaagggaagaaaggacaaaagtgcaacagctctgccttgctttgaaggatttattaaaataagccattattaaatattgctaatggaatgacagttgttaatggagtgacaattaaggtttgatccaaaacaaaaatatttgcttcaagaaacaacaaaaaatatttgcttcagatgtttaaaacatctactgactaatagttatgactaaagttttctttctttttttaatttgaggacaaagtctgactctgttgcccaggctagagtgcagtggcacaatctcggctcactgcaacctctgcctcctgtactcaagtgatcctcccacctcagcctcctgagtagctgggactccaggtgtataccatcactcctggctaatttttgtattttttgtacagatggagtttccccatgttgcccaggctggtctcaaactcctgagctcaagtgatcagcccactttggtctccccaaagtgctggattacagacgtgagccaccgcactcagcctgactaatgtttcttgtttgcaaagatgtcttccatgttgatcttcccttagatatttgtttgcctgtttgggatgattgttcttcttaagagacttttccacctacaatactataaatcatacactagctgaataaataacaaagggttttgtgtcctcgtggcttttactattctgtcagtacttgctccgctgcttttattgctgcagaatcccatggatctccaccttgaagcacgtgcacactccctgcctttcattaacacctgggagaatcgacctcccagcctttgcaggggtagcaagaagaagccacaacagagaaaccaaaagttcagtcaagccaggcctctttaggggttgcgtaaatggcttctgtcttccccttcccatgttttcctgggccgctcgtctgggacatgtctgttctgggcgctttctgcacaccaggggaacaacaaagacagcatggtctgatatgtgtgatgatcttggcagtttccttctttcttcataattgcattgtttctgacagccgctttttgattttctgccagggcaccctctgccttctggctagtaggttaggcctggcaggagggagaccattccatcagtcttgagaacttgaccccaaagtaactgtatattgtaacagagttgcttgcagaaaaaagaaaccaaaaaaaagtccacagtcaacttttgcaagctgttgtgttttcttttgcagtttttctacctcttgtccttctgagtaataaaaaacaagaactgagtggggaaagagaaaggaaggcagacattaccaaattgtcattttcttgttaagtccataaacaaaatcttgtatgtgctaatcctcctgccagagtaccgaaattaaaggcattagaaaacgttagtttaattttgtggttttgagtgcgcaagtgatcagtaagtgctcttcagtgagaacattttcttatttccatcatttattcctccactttgggaaatactcatttcctcagtaactcacacagagccggagaccttaaaaggcatctggctcaacacccagggtttttgaagaggaagcttaggcctggcctggggagggcttatcggaggacaaccctgcctggtctcgatttcaaaggtagaagcggacactggcctgcccacacctgcccagagcacgttcacttctgcatgttgcctgtggagactcctaaaaaacacgcatggtcttccatctcatctttatgtattagaacaaagcaaaccatattgctattggctcccttatttaattttcacaacttttgtttgtaagagtgaagcactttgcagcatcatctggaacctaatctgataagaagcagtaaagctcacacttgtacccatttccatgcttgttttcagtgagcctgggtgtttaagatgggatttgttgttgttgttgtcgttatggagttttgctcttgtcacccaggctggagtgcagtggcaccatcttggctcactgcagcctctgcctcccgggttcaagctattctcctgcctcagcctcccaagtagctgggattatgggtgcacgccaccacgctgggctaatttttgtatttttagatggggtttcaccatgttggccaggctggtctcgaactcctgaccccaggtgatctacccaccttggctcccaaagtgctgggatgacaggcgtgagccactgtgcccagccaagatgggattcttttttaagccctaccagctaaagccagtgcactgtgtgactttgtgttacccttggagcagcctctttttgctccactctcctttccaccgacccagtgtgctccccggattgagagtccctgtgcagtgaaagaataaatgtggctctctgccagcaacctcacctccccaccctaccctcagagtttcacatcttcagaacaacacacaatgaaccagttgtgttctgggctctctgagtgggagtaaatggatggcccaggtgaaatggaggctgctgttggccgattcattctgtaaatcaacataaacagcaggttttctctctgggcttaatttctcagcaggaaatcagcatagggaaacttcaggctgcatctctgccagtctagcagatctctgccagttctgcagtaaaactgccttggagccagagtttaagtcatggagctccatcagaatgtcattacccacaggctgtggccctataccctcaattcagacgggaggctacttgtatgccctggtgccgtggaattagtgtggggcctgacatcagccggttacagagcagcaggaaaggcttctgcgggtaatgctgcccacagccatcactgtaaacatgccggccccatggttttgtttgtttttattttacttaagggtgggaagggagctgttatcttaaggtctgcaaggaaagtgagatgctggaaggacttggtaatcggctctggcggcttcttccttggctttagaaggcagcgagtgggagggagagctggcagatctctgggtgtaggcaggtgagccagggagctgctggacacggtcctaacagaaggccgcatctgcagccttcctggggcttcctggggctggccaggaagacgcccagctttgccactcctggccacccagctccaccccatgcatgctcaccccacagctgccttgctctggactgtgcaagtccagtcattccggggtgcctgtcagcagggagctggggccttacagcaaggtgtttcacttcttttatttggtcagaatagatgaggacatgtggacctcagctcctcttgcaggctctggttgtaggctgccgaaggtgtgggtggagagaggggcggtgggttggtcacaagtcagaaaattaagaaacagtcctgcacatttcagaaagacaaatccagaacaaatttatatgaagggccgcggtcctttattccataagtagtaaaggaaacttaccttacctagggggctcgtaggcagaaaatgcacaaggacacattaggcccagggaagtggtattgtagctctgtgcaggttgagaggaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaa

SEQ ID NO: 1545 - DNA, 79879 bp, Homo sapiens
ttatttttaaaaataaaaatatttatttggaaaatattagtagcatgataactcaacctcaccagatattaacagttcatcaggtcaggcaatagaacaagtccacatgagcttcttaaaaagaaatggatgaccacttcaatagctgactccatcttccattttattactggatgattcataatccaaaatatgaagttttgggactttttctcaaaaggagaaactttgggaaagtgtctgaagcaatggtattgatcttttttttccccctttatgaaactttaactgcatacttcagtctggtggaatcttttgtgttattctgactgtcaataagaaccaaaggactatgttgatgattcctgatgatttcagcaacacttccaaagtactagaggaagaaaacatagatgaattatactttggcatttgtgttaaatttgagctccactcctcccatcttctctcattctcaagttagtaaaagttattacaccccagctgacattctgcacaaaaaaatctagtttaacaaaggctgtaaccttcaaggtggcagaccttggactttgctgtattaagtacgaagaaaaacacactgacagcctcaattagcatagctacttagagagattacttcactgagttatgataaaatattatagtatattgctttttatttaccgttaaatgtaaaactatcatacaacgcatttttctacattctttacaaaacatagatcatctcttactttgcacaagtctcagatacaagaattgatgtaataaattaaccttagaaatttagtacaaggaaatagtcatctcctaaacaaaattatgttttgttttcttttttaaacaaataaagaaagctttataaaccttcatatttccatttttacttggttcctggtaagcttagagttaacttagtgcctaattaataatgaaatttcatgctaggctctctccatacatacttatttttccaaattttgatccttgttgtctatgggttttaatttaaaattatcacaaattttgttctgaaaaataattaaagttttgaaggaaagataaaaacaaatgtaacacagatcatgaaattaaattcattgagtatacaaaagtgctacaagttcacactcattaaatgtatttagaatcactttttaaaagtggtgattgttttacaacagtgccatgagtttagcagttactatcaattgattttattttctcgattttttagataaagacaaacatccacagtaaaatttttaagtgtttattaattgtttggatgacttccaagtagctacatattgaataaagtaaaatattcagaatattggccaacatttccaaatgaaataccagttgtcttttagataattggctagctgaatattcagtcagggagagaggtaagagacagggactttcaaatacctttagtctttattctttacttcctattcaatcattcagccatcttgcaattgccaaagaaattctttcattataaatcccattaaacattcattctgcttgtttggcataatatgttgctaaaccaaatgcagttgaaagttaaagttatggactcaagggccagaaaacgaaatagcacaatctctttgaagtggattacaagggaaaaagtgtgtcctgaacctaggaagcataggagaggattgctgtacttatacaaacaaatatctcattccgtccctctagtccctgaatatttgtgagtattgccttgttgtggtgttcggggattgaagtgtgtgcagtagggagttgagctgagttgaaacatttgaagtagggaatgaagttgaagaatatttgtgatttaatttaaaaaagaattgggcataacatagttacagcttcccctcactctcctttttttctgtttttattaattcagtgtatttgagacagatacattcagtgtatttgtggacagaaaaacaacgtattggccactaagataaagcagacagttgtcaaaactgtaaaattactcaatgttgtatcacacagtgccaaaatagctgcataaacagttaaatagttaatgaattggttactttttctagccatgtacacacaaatacacacagactttcagaaaaactccacatgattgacatcatgtaaccaacactttaattttccattcagatgttcagtgtataggggacataatctttttattatagatactttaagtaagagttttaattgactgtcagtacctccagatgctattatagtaatatattacttattttggaatccataggctgaatatgttggaagtgaggtgaagctctagtctattcattctaaagtggagatgaagattcatcaggccaagaggaattcctgtttaccagagtttcctagcaggacaacgaaatccagagcccctcagggagttcaaaatttgtgagagaatttcaggacctcgaaataggacagcttcttcacccacccttaagcctcttatagaaaagctagactgctggagaagctttaggatgttaaatgataatgcggtctacattttaaaaccaaagattggtcttgattagtgcccttagattcaagagttttgcattttaaaattatctgagactttgttaaaagcaaaataaaattccccaatataaaaattctagaagaaaatgtaggggggaaacaccatgacactggatttggcaatgattttttggatatgacattaaaagcataggcaaaaaaagcaaaaatagagaagacaatatcaagcttaaaagcttttgctcagcaaataacacaatcaacagagtggaaaggtaacctatggagtgggaaaaatatttgcaaatcatttatctgataaggggttaatatccagaaacataaagaactcctaaaactcagcaacaacaaaaatcaaataacctgattataaaatggaatagacatttctctgaaaatgacttacaagtagccaaaaaagcatatgaaaaatgttcaacatcactaatcatcagagaaatgcaaattttttttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagagaaatgcaaattaaaaccacaatgagctgtctatcaccttacacccatttggacggctactataaaacaacaacacaattcagaatataacaagtgctggtggggatgtgaagaagttaaaccctcgtgtgctgttggtggaactgtaaaatggtgcaactgctatggaaaaaagtatgggaggttctcaaaaaattaaaaatagaatacccatatcatccagcaatcccacttctgggtatatacccccaaataattgaaagcagtgtcctggagagatttgcacacccgtgtttatagcagcactattcacaatagccaagaggtagaagcaacacaaatgtccactgatggatgttagacacacaaaatgtggtatatagatacaatgagatactatgcagccttaaaaaggaaggaaatcctaacacatgctacaacatggatgagtctcaaggacatcatgctaagttaaataagctggtcctaaaggacaaatactgtgtgattccacttgtatgaggtatctaaaatattcaaattcataaaaatagaacgtggttgctaggggctgaagggagggggaaaagggaaactgttgttcagtgggtatagggttttagttctataagatgaacaagttctggagatctgtttcacaacaatgtaaatatacttattactgagctgtacacttaaaatgattaagatggtaaattttatatgtggttttttaaccacagttgtctaaaaggcaaaataaagaatacacatgactttttcagtttgttttgcaaatgctattctcctgcctgtaatcactcaaccaaatcaattcagttgcttaataattatttatcaagtgtacactgaagccagttactgtgctctgattctggaaatacagagatgaaaagacattgtccttggcttcatgtagtggggaagacagacacttcagcaatcatgacattttccaacaattcaaatattttctagcaggtgctgggtttggaatggtgtacctttttctgaaggaatcttgaaagtaaatatttcttaccttgaattttgtttatgctattttctctgcatagattgttcttcccatttttctccttctccatccctccaacttacattctacccatttaaattcaacccgtaattcaaaaccagaataagtatcactgcatttctagaccattcatgggttactccagctcatatttcagggttcatttataggagcaggctggctaaactgagatatggtaagcactgagtttggtccagattaaagaggcattaaagttaatgtttgattaatatttaagacccatgtgatttttttttcttgctccaggcccataagctcattctggtacaagggctatagtctaatgttttaactcaagtttctgcatctcttctggatccttccctggtaacctaccttggtacttgagttgagattttaggtcttgactttggaggtctggaacttgaccctaattcttacaaccttaattcaacttgacatttcaaccttgatttatatttgcccctggactaaaatcttgggtcagactgacctcattaaataactgaatgaaaggactagcatgtacatcacatgactttttccttttctgtgttcttataggatatactgcctaaatatagtattttatcttgttctctatgacatttatgcaagcattagaacaagtacttttgtatcctttctcctcatctctagcatctaatacagtatttgatgtcattatactcaatgcatagttatagaattgaatttaaaaagaaatcactgacctcttcaccatttttctttctgcccaaggcatattgttttgttgcttcaataaatcgcacaggaatattatatactcgcttattaaagaatacaactagtgtatatggttgtttggaatcatggccagagcttttccgaataagaaatgatccatcctgtttaattttttttaaaaaacataattatggttagtattacttatatttctacaggttcaaaaaatcattttgtgaagaacacctatattacattccaaaggtaaattatttagctacattatttttattattgattagcgcttgtcttcttattttctaagaaaatagtccaggaaaatatatactcatagaaaatcctgagtgagatcaatgcttgccttttttgaaaaaaaggtaataattaattaattatttttagaaacagtctcactttgttgcccaggctggtgtgcagtggtgcaatcacagtccactacagcctggaactcctgagttcaagcgatcctcccacctcagcctcctgagtacctgggactactggcatgcaccaccatgcccagctaaatgctagctttttaatgtgctaaataaggttttatgtttataaaatttagaaatatgtgaagggacacattaagatcaaatctagaggactctcttgaactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatagtggcgggcacctgtagtcccagctactcgggaggctgaggcagaagaatggcgtgaacccaggagacggagtttgcagtgagccaagatcgtgccactgcactccagcctgggtgacagagcgagacaacatcaaaaaaaaaaagaaagaaaaagaaaaagaaaaaaaaatccccaaactgtaagacagtaattcaaattttattaaattttttaataaaaatatttagaatcataaaataaaaaattacgaacaaaagatggacaaaaagcagaatgaaatgcaacaagagttgatcaaactcaggaaacaaactgaagaaaaagacaagcctatctcaacaaagaacaaattataagatgtccaagggacgagagcttcaaatgaagatttaagaaatgacacttgaaggaaggtgtggaaacaaccaggagagaaaatgggatttaataaaataagtaccatagaatcaaagacagtgatgggagaaaaaatgacaaaaaagatccaaaacgcatgtaaattgagtgcttgcagaagaaaaacaaataagggaacagaacaaccctttaagactatgatctaagaaaacttattggatataagagaaaacttaaatctacgtattgaaagggcttctgtctacttgagaaaattgatttggaattatcaactcagagatatattctggtaaaatgattagactttaaaaacaaaaagtctgcagagccaccagactaaagtatcaaattacatagaagggcaagaaagtcacattggtatcagacttctcaagagcttcatacagaacaacacaatctagtggagcaacacttttcaaactcaaattaaggattttatagccagccaagatttcttccaactactaggatatgaaaaaacagttttttaactctctttctctttttattcccccacagcagtctcactcttgttgcccaggctggagagcagtggcatgatctcggctcactgcaacttccgcctcctaggcccaaccgattctcctgcttcagcctccggaggagctgggattataggcgcccgccatcacgcctggctaatttttttattttcagtagagatgaggttttgccatcttggccaggctggtctcaaactcctgacctcaagtgatccactcacctcggccccccaaagtgctaggattacaggcataagccactgcgcctggctgagaaaatagttttgaatataaaggaactcagggaataatgtaaacacgatttttcctcagaatctactacaggtacacttcatcaaaggaaagagacaatggtggaagtccaccaaaggactgacggaacacactaatatatttacttgtagagctaggactaaaacaagggtgaggaagaacagtatgtaaatgctatatattctgacaaagtggagtgcaagaaaacaaagaaaaagaaaatgggaggagaagagagaaagaaaaagtgtcactttaatcttgaattgtccaagctgtccctggtgttcctacatgattgaagttgggctctccaaacatttacttccaggtattttttgtttgtttgtttgtttgccatcttgactcaaatttttaatcctgcacattgatccaaaatagcctgtcactgttcactcctcagtggagctcatgcagcaccaagccttccatagacctcccctggagctttctcgtctcccactgtttggagggcagtggaggctgtgggtccttgaggagatgaaaggacaagtagaaatgagatggaggaacttgaaagagaggaggggatagcagtttctcttgagtaagtaaaggaaaaagatccttgtatctacacttgttgcaattatttaattagcatatcataaggacgacaactgtgtctattacaggctgagggcaaaacgtgtgatttaaaaatgatcagaccttggccgggcgcggtggctcacgtctgtaatcccagcactttgggaggccaaggccgccaggcagatcaactgaggtcaggagttcgagagcagcctggccaacatggtaaaaccccgtctctactaaaaatacaaaaattagccgggcttgggggcacacacatgtaatcccagctgcttgggaggctgaggcatgagaatcacttgaacttgggaggcaggcagaggttgcagtgagctgagatcgagccactgcactccagtgaaactgcatcatctcaaaacaaataaataaaataaaataaaataaaaataataaataataaaaatgatcagaccttgtttgatctgtgcaatgcctcttcagcagactttcgatcacaggctccagcataccatggcttgcagagaacgccagcttcctgtgaaatggagggcactggtcagcatgggatggtccctacttaactctaatttctgtgtactagaaacaaagacccatttgcattatcaagacaggcctctacatttacaccaataattttaagatgagttttatttttcctttgatcaaacacaaggattataccgttaacttgttttttgtatttttttttcatttggccttagctaggttcctgaattatttctttctttctcctaaataagtaataatccccctttccattgtgctcttattgctcttactttgtggagtgctttacaatttccaaagcatttttacaaatattattttatttgattcttgcaagaaaggatatatgccttctttgaaggcaagaaggacacatgctattatccgtattttacatttttacatatatttgtatggaaacttagaaagacttgcccaagggcacacagagtcctttctctgtccctttataaactgtgctgtcttatatgtgatttaatatcatcagcctctacagatctatttggaggaaattacaaagtttaaataaaatctatgtgagaggaagaataatgaaaacacatttccttgctagttttgaggaaacattaactggagcaatgtcttagtcattgaaaaaaaacaacaactgggtattctgtccctattaccaaatgacagttcacataatgatgtaaaatacagtctctgttctcaaggttcactccaaatgtcttcttctcagaagacatgctctttcctgcagtttcctggtaacaatttagtgacatcaagagttcatttcatacctgttctgaaatagtggaattagatgaaaagctgggtaggggcccatccacagttgggtttcccccttctgtaaatcctgaaagggatcagaaaagtccttcaattaatcttcatatttcttgaactctttctatgcctatcccctaacactgtactaggtgctgccagggacacatccaccaaaaaaaatccttaaggcaatggttccaaaagtgtggtccaaggacccctggaaatctcgaaaatcctttcaggtggttcaagaggtcttttctttttgaattacctatcactatgaaacccaattttcctcatgtagttccaccagaaaaacattgcaacagatgaaatgtagaaacagagatgagaatccagcagtctctgttatgttgcagtaacatacattaaagagatttacaaaatgtaaactaatgccactcttttccctaaattgtttttgtttggaaaatatagttatttttcataaaaatattatttatgttaacatgtaatgagtttaatattatttttaaatggattaataaatgttttaaatgtctcagttttaattcttaaaatactaggtatcaatagaaacatgtaaaccaaagctctttgggtctacaattattttaagagtgttaaagtggttctgagaccaaaatgtctgagaattgctgacttcaggcatcaactccctcaaagagtttacagtctaaatgtggaaacatgtgaaatacgaaaaagacttatctgcattcattcattcattcattcattcattcattcttgtttctctgccatggatcaaaggcattggggatatacagcagttaacaaaacagcaaaatgccctgctctcctggaacttaaattttaatggattgagatgggcaataaagacataagtaaaaaatatatatataatgttagagggtcataaatgctatgaagaaaaataaatcaggaaaggaagaatatgtgggtgagatctgcaggtggagagggaggaggcactggacatcccaggaaagaatgtcccgggtagagggagctgtgaaggcaaggcctggcatatctaaggaatagcaagggtgccactgtgcctggagtacagtaagaaaaggggagaagagtaagagatacagtcagacaggaggcaatgaagggaccagatttataggacttggtggacccttaacatgactcaagagctgtaatgaacatgataagggaagcttttggagggttttgaacaggggggtaacatgatctgcctatgttttaacagggtcattccagctgctgggctggaaacagagggtggcaacagcagagtgggggaggccagttcggtgttcttgcaggagatgacagtgacttggacagatcacagcagtggaagcagtgagagtggttggattctggatctattttgaaggaatagctggaaggtgtgtgaagaaagcaagtgagaagtcaagggtgactctaaggtttttgacaacagcaaccagagttgtcctttattaagatggggaaatctgcaggagaaagaattctggataaactaagtgcttcagataatagtgccctggatgtttagagaaggcagccaccattgtaagaggagggggcagtgagggcttggcaggcccaacaaagatgggccaaaaggaaggatgtattctaataggaggggaacagcactcccaggtgagagcagcaaaggtgagtgagtgaacagactttccctaggtgcacagtgcagggcagtttgtggtttctgcagttctggcagttggaagagtacccatggctaatattttctgacacccgaatgtgctaggcctattctgttttcaacatgcgtgcatctcgtcctttcaccagctctttgtggaatgagctattatgcccattttatagaacaggccttctcagaccatcctgtctacagcagcagccctccctgcctccgttactctctgccacccacccctgctgctgcgctgtatttttctttatagcacttcagcatttacctgatatgatattatttgtgcgtttatttttactctctgtctccttcagtagaatataagtttcatgaggacagggtctttatttgtttcgttcatccttgtatctcctgtgcctagaacaatgcctggcacacggcatatggtcactaacaactgaatgaatgacttggtttgaaaaacggtaaaaggtataataaacctttttaaataatgaaaaataaatttctgtagccaaatcattttcactttgtgttgtcagaattttttttaaaaactagtaaaagtttcatttatttaagatgaatattattaaaaatttaaaaagccaatttatgtttagtaaaaaaaatgcataaaaattttgcatgtggacaattactgtttatttaaatggatttaagctttattattttggaatatatcccaaattatctatgtaaagcagagtttttttcttcctttttttcccacattgagttgcaggcaaattaaggtttgggcagttacgttctgtgagcctgacttatccgattcatatatttttagggtgatgtttgccttggaaaaattatccagatatttgccgtatcttctttttaaggtaccttttgtagacatattttgtgatctttaaaatatattttgacttaatttaaatcggtattatttgtttagaaccaaacactatagctggtgcttcccatatgttgttttacttgatcttattattttgaaaacagctgtattgtttttgtaaaaaaaaaaaaagttaaaaaaggatgcatgatcagtaaaatattaaatcgctactaaaaaaagtaaaaattgcctcaaatatatttacttttcaaaacaactctgtgaaataaacattcttggccccattttacaggtaaggaaacaagtgggagaagatgccaggataacgcagctggaagcgacagtgctgtgttagaacccaggcctatcagactctaggatccagcctcgaccactccctgatacactacatggcttcgttgtacttacttggcagaggtatgggtttttggtggatttgtctgcaagaaagaatttcagataattaaaggacaaagcacaatatgagtaagtttgactttttgtttacactgatgatgctgtgaacaggcacatcacaaataaatcaatacaaatggccaataaaatgtatctaaagataaaagagccaccaaaaccttaaagataagtaagactcttccttttagttttgaaaaaggaggaaatcttgactaaagtattgtattttagtcaagttcaataattaacccaattagtaggtctctgcaactctacacagttattttaaagttgctcaacaccttttaacacgtaactgcaaaacaatgaaatgttggatttttacctagcactgcaagtcagtgtcactgtgcagtgaaacaatgcacatgttaattcctgcagcaacaagaggaaactgatctttaaaggaaaggattcttacttctgggcaggaggaaacactggtgactgcacagcttcttgtctgtgacttgaccctcggtggcgttcagcaggtataggtttttctggatcaggaaaattatcatattaggattagagtgaaatgtctgtcctcatcccaaaacccagcaacatcagctgagaagaaccaaatttgatcagaagtcttcccgggaacatgtcttagttactgagatgtcatggatctgtgcacttgccagtctgttgatgtggttgtgctatgaggaccaggactccctcccagcagtgttacaggtacatcctaccacctctgcattcatccactggcaatgtacatagagactgaacccacgggccctgaaactttaagtgtgtgagtataggtggaagccagaagatgagaacattttagccaccctctaaacaactcaccctctacttgccatgtggcctccacacaggtggagacaacaccctggtgggtcttgattagtcataagacgtggtataagcagtgtgttactgataagaggcacactactgagttcataaatgatctctttttgcaaaattaattggatcaaattcaaggttatccctataataatgtaaatctcacttgcatttcagtgttttcctgagcagaagaggaaagggtgggaaatgagcataaacctgaagtgtaagaaatttatgttgaagcccatagtgaactctactgctgaaccattaataaatgtgatcacacattattttaatactttactctccctcaaatttgtcgttggggggtggggtgtgttaaaatcttggtatgttcatgtgtgagtctgcatggaagaaaggctgagaactacagaaaccccaaagaaataaaagtagtaagaactcaaagattcaaataaatggtaagatagacgtcagggtttcttaccattcagtggtgcactaaagcttggaaaccttgaacctctgaagattgtattttgaatttgtggcaagctacttcaaacctctatgttagatgttttgctcatgacattaaaacttggtaatttcagaaggagaaacaatgaacaccttaggtcttgccagcctataagctttgactacacctgctctgcctccgccatcctgattccttcctaggctagtagaggccactcactcactttgcatttggatggtaattgcctatgctcttgaaataaataacaaaggagggggcatgcctggcaggctcctgtactgggaaccctttgagaatgaggacacctaagcagcagtggacatgccttgggccctgcttctttcctggattttggaggctcttgtagccatgaagtctgcacaggttgtacttacttcctacagatgctcagagctcctgaagtcactatcactccacaacctggactcagcaggtctgagaggctgcaaggaatggaagtacagaaaagacaaaagcctcaaagggaaggcagaagaaagcaatacagcagaaaaggggtgatgcctcagaaatagcctagggaagcaagatatgggagacaggatgaaaaaacctaatggcgtcattaaagcagagaggtgagttgtagtgcatgctcagaaaagatccactgtccatcatcagagaaaggagagtgctttatgtagatatacgcacatcaactcagggaagagggagaatactcactacatttttaaccctgggtatcttcaagtatggaattaaatgggtacagggcatgaacttctatataatgttttaagtgctgatattatagatgattcttctatttttttccggtaatttccaaacacaattttttttaacatgagcagtttctaaaaatatatataagatttttgagtgatgataaaggaagaaattctaaattactcaggaggctgaggcagaaagacaacttgagcccaggaatttgaagctgcagtgagctataattatgcaccactgcactccagtctgggctacaaagtgagaccctaactcaaaaaaaaaaaaaaaaaggaagaaaagcaattgaagatgtactaagaagacagacaattgaactttgaaaacattatcttgaaaacttagcaaaagaacttgttcaaataaacagatttttaaagttttcattactttaagtaagctattagttctaaaacatgtgaatggctctacgttagttttcacatttatgtaaggtcctagcactattgcctggcaagtcatatctgtctgccaaaaggcaggtttttgcatgcattctgtagcctactctaaacatgctgaggttctgagctagttttgctgttcattgctcattgcaaaaactattttgtttagaaaattgagtttcatgtttacaattgccccaaaaataatgtaataaatgtgtacatacaaatccttaataaaataacttttagaggacatgctcatccttcaaaataatagattttaccttcacaaacacttgaagcattctgttgagaggcaactggagtctatgtaaaagaaaaaaaggcaaggttattcaatatagcagaatgtggaaataaatgtcagagcaatattattaaaataaatattttggcagcacttttctttgatgcattgctattctttcaatcacaacaacaattacaaacccacagtccctagcccaacctttgcattaagcaacaaacagccagaagtgtcctatgaaggagcaatgtcactgtggtggagaaacctccctgccttgtcaacagggttgatggaaatcatgacccccccagcagctgccacatagtaacccatgtacagcaggcatctggcatctgctttggtctcatgaccccccccttctgtgtgtttgctaaatgattgtaaatgtcaggcttcacagtagggactaggtccaggtgggctcccttatgtagtgttgtggcccaggttcaccatgttctggccagaatctgagtttagtgaggcctatgtgtgcctgatacacaatggtctaccattagctgtggtggggagtggacacagacgcttcctgtggagagggcagggaacctggctgcccctctgatctgctgcgcacactcagtgaagctgctgggatcaagtgaggatgagctccttctatgctccagggaggagcatcctccctggctacctgaggatttgaagcttctcttggactgcttgggcagcaacttcagttgctaagattgctgtgttcaccatagctggaagcattttcaactttaaataaatggataagaataaacactgcaggaaatatgaagcacttttaaatgcaaaattaacttactgtcttcagtggtgtcgttggttttttcctggggaataaaaagagatgagctttgttaaaacacaacgaagacaaaatggagctatttaccattattttagtctcaaatttaagctagaattatgaaagcgatacaagtgtgtagaagactatccttgcagggtggagagggatggaagtgggatttagttatgatcctcctaggctcagatggagtctgctgacagatggggaaggggtcaactggggataaagtagggcaccagtccggcagaactggactcttgcaccagttgcactaattacttggcgggtgaccttgggcctctttgtcttgagtgtgaggttagattcctcacctgtcaattgaggaccaggatcagtattttcagtgtttctgtggagccccctcttccccaacagctccctgtgggggttactgtccaggacagagggtagaggtaagagggtggtccagcaggtgaggttgcagctgcacttgcccactccagcttcctccctgtctctagggactattctccactgtcttctgtgcaggctttctttcagagagatccgaaaccaaaacaagtttgaaaaccactgatgtgtggtcctgaaggtacttgcctgcactaacattctagtttgcaaaatgattcaggtgctggagcttctgaaagtcggggtgtcttgtggaacactgtaagtcaatgaactcaagattccaatagagactggagtctaatattggtaaggttgtatgctccttttctgtgtgttaaatttcttaatttaaaaaccctcaccatatctctctctcgctttgttttcggctgagagctgaagtgtgggggaagaacactaagaattcctgagcacctgtaagatgcctggcactgggttaggctcctcaggtgctatttaaaccttacagtgacattttaaggtgaggaaactgaggctcagagagacgaagtagtttgcccaaagtgatacagctgaactaagagagacgtatgcagagttttggttaataaaccttcaacatggaggctttctttggtttacacagagacagaaataagattagagccattcaggccagctttagacatatttaaatttgctttccaaataacctgttgagccaacataattttacggggtgacgtttgtaatattaacacattacaatcgtcacctgactgtttacaaagcccttctaaattcaataagaaagaatgactgtcactttcgagaggaacttcagtcgtatggctttgagggagtgccctggtatgaccagcacatagtatatatctacacacttatttacagaccataaaactgagcagcagtaagtaaagacaaaacctgctagaggctctgaaaatgattcaggtgctggagcttctgaaagtcagggtgtcttgtggaacactgtaagttagtgaactcaagacttaactaaaacttcacaggaggaaatacttctagatttatttatttatttatttatttattcatttatttatttatttgagatggagtcttgctctgttgcccaggctggagtgcagtgctgtgatctcagctcactgcaacctgcagaggttcaagtgatcctcctgcctcagcctcccaagtagctgggattacaggtgtgtgccaccacgcctggctaatttttgtatttttagtagagacggggtttcgccatgttggccaggctggtcttgaactcctggcttcaagtgagctgcccgccttggcctcccaaagtgctgggatgacaggcctgagccaccatgcctggctcatttgatgttagcagggctccttactcttggtccaagttgcagcctgccatggggagaacttctaatgaagtcaacagggcagtggggtatcaccatcctcactccccagatctcaaaagctgcttcctgcaacaggtacttacccggcccgtggcaacggggatggtgcagctggtggaggtgacttggtttcccaggccccactgtttcgacctgcacaaacatatacactactcagtccccaagtcctgagccgggggctgatgctcacactgaggctggcctctctggcaggctcagaaatatttgcacatactgtgttgctttcagttaagcacatataggtagttatattgaagctattaaggaaaacttgtgggcaaaggtgatgacacattttaaaagtgtcagtgtataagctcagagctgggatgggggttagggactccaccttaacatttctaaaggaccttctccttacccgccccctgccccatggggcaagtcctgagcccactgattctgaggactcagtgaggacccccacagaggtccttcaggaagggagccaacagctcacacctacatctgtgcacactgcacaaatgtgcacggcagaggtgcccagagacagaggctccaacccaccactcctgacacagacctcagacagtgctcctttataagcacacttaaatacggtaaatgcctctaacttcacattcagaggatatttactcactcatctctgagttttcaagggctttcgccgacaggttttccttaatggacaaattgagacaagtgcaggctgctgcccaaatctcatcttctcaagtcatagaagggacccgaagggtcttgtcccctgcacccaacctcccttcctgtacctgaagatagatgccagacaatcgttatgagggaggaagtgaaagagaagcaggatggatcttcactgtgggacagagggcaggccaggaggggagaggccagagctgagccagccccctcagcatcccctagctgcctcagacatgatgctcacctgcttggacaccattgctcagtgagaccaaggggtctcttcatgaggctcttcattaacttaactgaactgaataaatgttttcttaagaacttactacacatacaagtccacaattccgtttttttttttttttttttttttgagacagggtcttgttctgtcacccaggctggagtgcagtggggagatcacagcttactggaggcttcaaactcctggactcaagtgatcctccccactaagtagctcctgagtagctgggactacaggcatgcaccaccacacctggctaattttttgtccagatgagattttgccatgttgcccaggctggccttgaactcctggactcaatccatccacctgccttggtctcccaaagtgctgggattacaggaatgagccacggtgcctggcctataattcctaatggatttatagggcatactctgtaagtacaggctggacctgctgccctcagtctgtactttcttagtttatgagatagagcacagataagcacacattgaaataataatccattaccaaggattattgaggacttggtacatgtaaagcacatgaaggcactgtgttaggggccgaggaagaggtgaagaagcagacataggcctctgccctctcagaatttataacagggaagatacatgcaccctccatatcatctcatccaaacacagacaagaaaaagaaaaggcctcaaaaagtattgaaatagagttcaggaagttccttcccatgtatgtcactggagagaggctcccaggcttctactcagagcccactgactcttttcctaaaccctcaaggatgggagcaacagcaaagagtgggtggtgtggattgtacctggaagccttccccagcaccctgggaagcaatgccccctccatgacagctgtcttccacggtacctgaactgggtctgattttttgaaacattttggaaaagagattgcgtttggaatgtttacatttcatgtgacaacatgaaaacaataaactgaaatgtcacctgaatgtgtagtaggagtctccctgtgtttaagtaactggtgtatcaaattgaatacttaagactgacactgttaaagtacccttgactgcaatagaatttgatggaagatctcagggaagtggaacaaaatcttgtatgaaaaataaggaagtagaaagaaggtctaagtctgaatttcatcccaggggttttccctcttctgaaatgttaagggctcctttggccactatattatctttgtcagaccttcctcctggcttttctactatgcttccttttcttgcatatctcagaatagtctgccaaaaccttccttttcctttccttccctataaataacttctgacaatcagaggacagcatgattgtcatggtggaacactgtcacggaggacactggtggaaagcctatggtcttgcctcaggaagacagagttctagggaaggatggagcatgactcttcatgggtcactggcccatgaaacaatattgttccctgataatatctgccagaatggtcatggatcaaggcaggttgaacaagggattctgaataataacaataataataacaaagcactagcattttatgagtgcaagtcatctatattgagtcacttaattctcatggtatctactcatgatacccctaggcataggtgccattttttcagaggaagaaactaagaaacagagatgacttcacttgttcaaagtccggcacctagcaaatgtcagagccaggacctaaacctctggctttggagtcggctaaatccattctactggcttctcaagcacagcggggacggcaggggctgtcactgcaccagatttactatatcaccctcggcaggcaccttattggctatcaaaggaccaagagcaatattgaccagaggaaactgatgtggtgtggtgctttgacagaaacaccaactaggcacctgatggacacttttgtgatgcccactgggggactatctgaagcctttaaaggggaatggatggttattcaaagacacaggctagtagtctgatcatttcttttgtaaaaataatctctgaaggttccactgtttgcacactcggaaacccactcggactgtttaggcttgtcccttcaaaattatttcacttcttcccccttcctgtaggtactcccacctgtatgtgataatcacataaccaggacattattttcttgtttagatttgctttcttcatctgatgaccctagtattaaaatacagctataccaggttaatagcaaacttatgagtaataaatccagctggctaaagccctgttggtgattctttaaatatttaatacaaccagtgtttgaggactcattcaccctctcaaccaactgacccctccacagtctcggcacctcccctgagccagatcctggggtaggccctggaaacagctgtgagcaaataaagacagaaatctcagggcatgtgcagggcactagagggatctgtcccagcttggggccaggtaaagcctcctgagcaatgacattgaaggcaaggtctccaaggagcttgcaatgtacttaggaagcgattagactgagacacaaagtaattagggaataagtacgggctaagtgtaagggggaagagacttcctgcaaaggagagctctctgagggctacagaaaccagaggagtcttcctggaggtggaggcctcaagctgggccttgaaggatgagtaggattaggtgtcctaaaagtgagaacacaaagaccaagaagcaagacccgtgacatacaggctgattggagtactgggtgtgttttaggaagaggaggtgcttgtaaggcagtgtgttttaggaagaggaggtccttgtaaggcaagtagagctttgtaagaggtaaacaccagatattagtaatctatttctctaaaggagggttgaggtcttcatttatttatttgttaaaggttttctattccagtaacaacagccctcatcctgagttatcgggagttaggagtctccatttctgctggggcctaagcaacctggtcacgatgttttagattggcatgtttgacctttgtctctccagagggtaagatgagctggctaagatggctctgagctccactccccacttataaagcgcttgtgggttctgaggagaggttaagtaaaaccagaacttgtgaagaaagtgaataatttcacaagaaatgagtccaggaaaagatttttaaaatactcgactgttctttcattttctgtgaaggagcctgtctctggaagcagagctcagcctctcaatgacttgtgttcagctctgtgagagaagagagtgtgtgtgtatgaatgtgtgtgtgtgtgtgcacacgcgcatatgtgtgcctaggggagagggacaaggggagagagggagaggaaatgcctgtgagaatgctggagagcaggctcctacacctctctgtgctgttaatgggggtcatgggcacccctcagtgtcttgggctcagccttgggggttgccaaaacctataggagcaaccaggaacattcatggtttgggggtaggggtgacatggcaaagactagctttgtggtgagatgaaactggtaacatctggaggagttcagcggctcagtccttgtcgctgaggagagagccaagaggcaggggtatggctgctggacaagaaggtgcaaggtggctgagtaaagaaagcccagactagggtggtcacagctaaaatggaacagcaaattcaggagaaaaaaaagcaggatttggagcatgtggcctggaggctctacgcattgagaaacaggggtgcccgcaggggagggaggagtgagtttagagtcctgtgtgggagcatcaaggtgttcagaagggaagtcaggttggggttggatgccagggagttaccagtgtagacttgagacatgaatccagattaatcgatgaacgctacagaagtgaaaaatcattctctctcctcagcacttagtgtgtaccaggcactcattaagagtttcgcattcacatttgcagaattctcctgtcacagagtaggggctatgagcaccatttacagaaaagaaaatctgatgcttggagaggtgaagtacaagcccaaggtggcatagctggtaacggggcacactggggttccaaccgaggtctgtctggctcaaaaccaagcttgtaaccatcatgatgttctgaaagaactgtgggttgagggctgagggctaaattccgggaccccctcagtcaaggaaggggacacagagaagccagcaaggtgcccaggaaggtagggtgaaaaccagaacttgtctagcagatgccaaaaggcctggggaaatggccacttccacacacgtgccaccagacagtgcatgaggatgaggactggccttctgttcccaatattaagacatttggaaatacaagtgattactcttcatagttgatctgtttttcttatttgaaatagacgtaaaaccaaaccaaatcacacatacactttacctgaagctgttcctggaggagaggcgggcgttgaggaatttggcttggttgatctattcaccatgggagcttaaacacagaaatgtgtgtgtatatatatatatatatatacataaaaccattacagatacatgccattgaggaaaattcacactcagggaaaaatgatgaccagaccagagaatttgcaaagaatgggagacacccttattagacacacaaaccaataaaagaagtcttcttagaagaaacatctttagaatgggaatatcaatgacagattcataatttgatatattattatttgattatttgatgatagagatcttgttaaagtgaataatggctttgaatttcatttgccaagtgggaggtctaagagataaaggagttttattgtttttgtttttcatcaagagtgtattgaaccccttactggaggggcccaattaatagctccacctcccctaccagatgcaatacacaccattgctctgggatttcatgggtttttttctgttcttttttgtttttttaaagaggggttggtaaggagggaatgtgtatttgttcttttgtggtaatgggtggcttgggaattcaggtgggtcttgaagctgttggtgataggtacggagtacgggagagggttgctacatgatggcggactgaaacctgaatatggctaccatggagttgagagtagtagatgagtaatgttacctgaagaggtatcacttgtactggatcatattctccatagtgactatattcagagtaaacataccctgtttccatgcctaatcttatgtagcactggctttttaaggtaattcattggtcatagcatttgttgttctgtgaagggtttacggatgaaatgtttcataggcttatcatactactaaatttaaagaaccaggactcagggcatatttcactctttcattttttcactcctctgcagaaactgttcttggtgcaatgtttacaaggccaacatggtggcttgtgacattgtattaggttttatgagaaatccatttgaagcgagggcagctgaagagaactacccaggtgctttcataatgtgagatgggaagattaaagcatggaagaggaaggggaaggcagggaagggctatgatacacagagatgggttgtcactgatgctgtctgcccaaccagccaaagaagcacacactgtggcccaggggagaaagtcctgggcactgtcatttctgagcctcttagtgcttactaccaaatactcttatacatcctgatcaactgctaaaaattttcaggtgcttaaggcgacaaactcttacctttttcaggtggaggtgaactgctttctgtgggatgaatatagttttcatcattatcttccacggggaccacataatcagcctaacagaaatacaaaactgaatgagaagaatgctgtacattcatagttgactgtatgggagggagtgatttttttaaaaagcattattgagacgcaattcacatatcataaaattctactatgtaaattgtacaatttggtgacttttagtatattcacagacatatacaaccatcaccacaatctaattttaggacatttttatgcaaaaagaaaccttgcacccattagtcactccccatccaccgcttccttgacctagtcgaccacaaatctactttctttctctatagattttgcccattctggacattgaatatgcacggaatcacacaatctgtagtcttttgagacttctttcacttagtataatgttttcaaggttttcctgtggtatagtatgtatcacaactcccgtctttttatggccaaataatagtctattttatgagtatgccacatttgtttatccattcatcagctgatggacatttgagtttttttccactttttggctgtaatgaataatggtgtcatgactattcatgtacaagtttttgtgtagacatgcatttctcttgggaatatcctagaagtgaaattgttgagtcatatggtagctctaagtttaacagtcggagaaactgccaaactgttttccaaagaggctgcaccatttttcattcctgccagcaatgtatgagggctccagttttttcatatcctcaccaacacttgttatcatcctttttattacagccatccttgtgtgtgcaaaatgatatctcattatagttttgatttgcatttccctgaagactaatgatgttgagtatctttttatatacttattgtcaatttttgtatattctttggagacatgtctattcaaatctttgcccatttttaattgggttgtttatctttttattgagttataagagttatctatatattctagttataagttcttcatcagatatacaatttacaaaacttttcttccattctgtaggttacttttttactttcttattggtatcattggtggcacaaaacgtttaaattttgaagtctgttttatttattcttttattgcttgtacttttgatgtcatatccaagaaaccattgcctaacccaaagccataaagactcatatctgtgttttcctctaagagttttacagttttagctcttacagttaggtctatgctacattttcagttaatttttgtgtatggtgcgagattagaagtccagtttcattcttttgcctgtggatacatctagcaccatttacctagcactatttgttttaaaaaagtatttctctattgaatcgtcttagcacttttgtcaataattaaatgacgataaatgcagggagggagagattttatattgacaagacacaaatgaggtaaccagatctcaaaactggtttttaccacctgccctggtgggcagccaagaagggtactaggagaaacaaaaacaaaaatttattgccaggtgttcttctaagtactttacatgttttttttctcatttaatcctctaacaacacaataagagagatatcaccattggctccatttccagatgaagaaactgaggcacagaaaaattaagtagtttgctcaagttgtcaagtttaaaagtggtagacccagaagggcacagtggctcgtgcctgtaatcccagaactttgggaggctgaggcaggtggatagataagagtccaggagttcaaaaccagcctgggcaacatggtgaaaccctgtctctacaaaaaatatagaaaaattagccaaacatattggtatgcacctgtagtcccagctactccagaggctgaggtgggaaggttgcttgagcccaggaagctgaggctgcagtgagttgtgattgcgcttggcaacagaatgagaccttgtctccaaaaaaaaaaaaaaaaagtggtagatccaggatttgaactcaagcagttcaataatttagcacccatacttttatccaccacattctagtaccttccatcctccccctcctctttctgtcttatctatcctctctttatttaattgctatttcttatctctttcttcacctctgaagctggccgagaggcaccagagagttctactcacacatctcaatctgcagttatatttagagatgatctggctgagggagatgaggctttggaatcatacagacctgggaggaaatctgtgcttgggtcttttctagatgtatgacctgtgggggagttaattgctgaatcatcggaagttctcctggattctgccattcagaggtgggcacttgctcctctgtggcacagggaacctggtcctcatctctgcttcgtctctggccccacagtgtcaaactatgaactcccgaagggcagggccttctccttctctgtgtttgtgtttccagtacctggccagtcgaatgcctcactgaattgaattgaaattgcctaacccaatagccaaggctgggatgggctgacttagcagctttgaataatgggatgttgagtggctgcggatccctgcaggacctttttggttctatgggttcaccttttcggattcattagtagccagagtgacatgctttataagaacccaacttctcttctaggcgttagttcctataaaaggagaggctgagcccccaggaggcatgccaccctcttaaaccctgtagtcaacaaaatccttcaatatcttatgtctgaacacagaatattggtattgacacttggcaatgatgcctgaatggatatagggaagttggaagctccaggccctaacccagtcctacttgaccacttcaaaatgtattctttcctctgtattcttaattttgtacttgttttgttctgcagtgcttgattacagaaaatgtttttatctgcagtgtttagaatctgagctgtttagagtcatgatgatataggagttaagaaaaaattacttaggcagatagtgagggtaagatgtccttggtaaggttttccttttaataaaaagcagccccaaaatcattttcttttctaacaaagagtagcctgtaaaatcaagctgctgatatagacaagcaagctggaagcttgcatgggtgaatgctggcagttgtgccaataggaaaacgctacctgtgactaggcatgatcaaaatggtggctctgtcttcccctctctttgccagccacctgtacagtaaggagcagacaagatggcactggccaagtagaaaacccatttgtataataagattagggtggggcgaccagcctcttctgcaccatgtaaatgtcactcctgatcaaaccaatctgtggaccctgtataaatcagatatcacctcctgaagcctgcctctaaaatctgctgtggtccacctcaggcttggttttcccttcagattccactgtcttgcaagagagagagagatgctctcctctctcctttcttctgtctattaaactttctgctccttaacccacccacacgtgtccatgtcattaatcttgtcagtgcgagacgacgaaccccaggtatttaccccagacaacgatgccacttcaatgatatttctggaatggagacatttgtattcccaaagaagactgataggaaaaaagactcgatccagtctcaacaaattctgtttgtagtgtctgcccaactttctcatctttatagggttttaggagaaggaatgtaaaatgtatattcccagcattgcaattcaatgctttaacgttgttattgctgaaataagtaaatgaccaagaaccatcacattttatgtcctttattaggacataatgtggtcttattgaccactttgacattgctgcagtgttttaataccaacccccttctttcatgaacaaaacacaaaaacttgacttcagtgaatcagtgattggtcttttgaagccaggtagattattatactaccatgacctacaggtattagaaatccttcttcaattattacaatgacatgattcaaaattaaaaatagattaaaaatcatcttagatcaactccaatgtttagatgtttcagtattaataagacacttgtcataattgtttacatgtttgcctccccctaggactacagatttgaaaaataggagtagcgtgaatttatcttattttcactttcccatcggctcataccctattacttagccggagtcattttgattagctattaaatgcccacatgggctgcatcctcattaccactcatataagcatttaaaagctttccatacattattttattgaattcttataaaaataccctctaaatatattccctctgtgaccttgggtaagtttcttagcccctttacacctttgtttcctcatctgtaaagtggggctgatgatagacttcatagggttagtgtgaggatttaatgagataatgcatacaaagtgctcagaacaccagtggatacacaacattctccaagtgttagcctctctcattatagcacagatgctccttcctcctaaatgtctttgccccacctccagctctctgtttagcctgtatctctgtattttgcctataacctgcagagcagggttaaacacttttatttatgcttgtacttgacttcttcttttcccaactaatggttcagccatatcttaatgttggcttctgtttgtttgtttatttgtttttacacctctttcttatattggctctctatctgcccattccagaacgcccccgccttcatacttctctttttcccactggtgcagacttgcctgagccacctccacaaggctgctattagcaaacctctgccctgactccctggggtccattctcagttatttacagaaatgaagagccttacataacccacagtattcatctgcattctatatctgaatttgtgtcttcatgtggaattgccaaatgctgaaataatttacagtgagatcctaacagctggtctccccatcctgtcccctcccctgctcagcttctctttgccaccctattcccacccttgaaaggacaacatcgcctctcagatgggtaggtaatagtaagaaggagtgtgtgcagggtgagggtgtgtacatgcactgtatgcattgtgggagctatgacaaatcaaaaaagagaccaggattcacagctgagagagagggggatgccctggggcccagttgctttgaggccatggctggcctggtgttgctagatcttcagttttcagaagaaactagaaaactggattttgtcaaggctctagaatatggtagaaaggaatccgacatatattaaacccctctgtgtgtgaggcactgtatttagtgctgtacatatgttcttttattaaattctcaaaataacagagatgaaaaacagactcatagaagttgtctagcttgccccaaatcatacacctagaagggccaaagcaggaatttgggcctagatgctgcatctatttttatttaaaagtccatcttttccatctcctgctgggctgcaaattttataaaggcggaatgaaggtcatttcacaacatgtgtgtaagccataagttttatcctctacaggcaagttatttcttagagaagctgcaggctggtctctgtccttatttaaaatgcagggacctctgggagccataacacattaggctttatcagttactacgacagcttggatgagtttacctattcattttcaaataggagctatttcatagggaaaacaacacaaagggctaggtgctgagacagggaagattgaggaggtaaacccagagttggatgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgcatctgagaagagggaagtggaggagcagagagaaaagaaggtggaggaaagaaagcaaggtggcgacagtgttacagtgggtataatagctagtcaggcatgagcagggcaggagagggctcccctgccccaggaatgtcaggagaccatcaggtgattgtcaggtggctgttaattgtctctctaaaataataattggttacagccagcgccagggaaaagcagtctcccaatagatagaaaaaacctgaaactggtgatgagcagtttccgataagatctcaggagttgggcaagtgggctcaagcatgcgcattaagaggcaaaatggcagcgtttaactggtacttgaccttctagaaacattcagctggtaaggcaagaatgcttcaagggatcgtgcgtacaactccggtaagcacactgcgcatgctcacctcccaaatgctagcagggcactgcacaagcggacagcccacacaaaggaagaatcaggggagaagggacaaaagaccccggaagtgtgctagtgtataaaaccccaactcaaaggtcaaacagcgcactggatctctcaagtcgtccgcttggccctcttctaagtgtacttgacttcttttcattcctgctctgaaacttgccttggtctctccttctgccttacgcccaggaggcaagaattgaggttgctgcagacccatatggatttgctgtcagtaacaacaggacagagaagcaaaggagaataaagagagaggaagaacatcttaggaaggaaagaagagattcacaggaaaccccagggaagaaggaggggataatatgaggggcacagactcagtattgatattttaccatacacctctagtaaactgacatatttacaataagccattttggagaaaaccaagtccctttggtataatagtggagagttagagggggcagtcaatagcaggttgtaaagaaggaggacagccagcgggcaggctgtcctggtcgcttgccccacccccctctgtgtcctgggaagcctttggcacagatttactttacctcatcctcaaggaggcctttgggtttgggtgggacttgaggtttctgcaaagcagtcagggccggcagggtggaggtgagccttgctttctctgaaggccagctgggcttactgggaagtgtcttgctgaagggtggggaatgcctctggcttgatcgattgtcttgaaaggaacaaacaaaaaacataacataaaagaggctctggatcatttcctgggtggaagccattgagatccagaaagtataaaaccacgggtgtctatgtagccacaaatgatccacggggcattccttgaaagagtaaagtgaaatgttaggcccaaaatttcaactgcttattgacttaaacgacaaaaactggaagaacgtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcacgtggatcaacttccatgctccttccctcagtgatttcgctccattcacagggaatctgtgggatccctttggtccaggactgtccttctcatcaggtatcagaaaaggagtcaggctctaaggccaactggatctgagttctgtcccttgctctgccactcactagctgtgctctttggggctggttattcaacctctctgggactcacattcttcattgttatttttaattttttaattttttatttttttgagacaaagtcttgctctgttgcccaggctggagtgcagtggcatgatctctggttactgcaacctccgcctcccaggttcaagtgattctcctgcctcagcctctgaagtagctgggattacaggcacccaccaccatgcctggctaatttttgtatttttagtagagatggggttttaccatgttggccaggctggttttgaactcctgaccccaagtgattcacccacctcagcctcctgaagtgttaggattacaggcatgagccaccacgcctggccaacattcttcatttttaaaatgaggatcgtaatatcgaccttagagatcttgaggggattaggaagattgcagtgaaggcagtaggtacagtgtgtctgcctaataagtagaacttatatcacctgtgccatgtgagagaggcgttaggcggcctcaagtctacccagtgattcagtgagctgagcatagattcagactgatgtgttttaggaaaatcttggcataggaataacctggcatgttcttcatactgggaacagcacaggtgctagcactggcctctggattgcatcactggcctcttgctgctgcttcctgtgacagccccacctcgcccggtgcagctgtccttgcctgttaggccctcgcctctatgctcctggtgcctgcccctgccctcagccctcactccttgttgaaggtatgtggttaacttcacctccgctgcctcctcagaagcctctttctggtggtgtggctgtactcaggcatgagggcatccttccttctgtgcctataactcttgtcagttttatttgcagctcctggagtttactcagatttctgagtaaacaaatatttaatgtaatatttaagcccatcagaagtagcaaaacacaggagacaggctttgaagagtgtgatttttttttttttttttgagacagagtttcactcttgttgcccaggctggagtgcagtggtgcgatcttggctcactgcaacctccgcctcccgggttcaagtgattctactgcctcagcctccctagtagctgggattactggcatgcaccaccatgcccggctaatttttttgtatttttaatagagacggggttctgccatgttggccaggctggtcttgaactcctgacgtcaggtgatccatccactgtggcctcccaaagtgctgggattacaggtgtgagccaccgcgcttggccaagagtgtgttcttgagtgagccacttaaccaccctgaattgcagtagccctttcctccccagggttgctgtgatgattgaaaaagatcattcaccaagtatggtgggtggtgcacagagccgagttgtgatgagctgggcttcggaagctgagagccctggcttgtatcccagctccatcacttagaggatcttggcccagtcagttcactcctctgacctctttcaggattatcgaggaggttaagtagacccccaggggaaagcactaaactgtaaattagaagatctctgggagtatgtgcatcttgagtgcagctgaatgctcagtgcttagcatagttctggtgcatggcaggtgctcaaaagatcaactgtggcaacccagtaagcccagctggccttcactttactttcattcagtgaagcaaggagcagtgcctggtacactgtaaggagggggttaatggcagtgagatattacatgtagagccggtccatacaaatgctggcatcgccatgaccatcacagacatacttgctctctgaacctttggggaacttagtcacctgccaagactggaacaaagatgggcattaaaatgcatacttggggccaggcgcagtggcttatgcctgtaatcccagcactttgggaggccgaggcggttgtatcacttgaggtcaggagtttgagaccagcctggccaacatgaggaaatcctgtctctactaaaaatacaaaagttagccaggcgtggtggtgggtgcctgtggacccagctactcgggaggctgaggcaggaggctggacccaggaggcagaggttgcagtgaagcgagttcatgccactgcactccagcctgggtgacagagtgagactctgtcgcaaaaaaacaaaacaaaacaaaaaaaaaaacagacccaagctgtgtccatttaacccatgaggcttattccaggcttggggctcctgagcacctgtatcccctggtaaaaccgcatagtctggactaggcatgggaggaaggtgaggcagacactgggatcctcgaaggtcattgttttgtacagacttcttaagagaaatcccagaaccttgagcacacgaagccctaaaagtgggactaatctcagggttgctttcccttggagtgttgggagggagcacaaccatcagggtatgctgggtttgttgtttgtttgtttgtttgtttgtttgtttatgcctgctttcaatgttcccaatctaggaaagacgcctcttcccctggaatgggaaagccctacagcttgggatcctttacctcggagcccagatcccctgcttggaggtggcgggagcgggcggctggcagaggccctcaagcagcagccaggtttgtccccaccccgcaatcttggacacccccacctccccatgggcctggaaggccgagtgcccaggtctgcgggggacctcacctatatactcgcctctggcgaagggcagggctgggtgaaccggcctggtttcctgctctactggaggcggctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccgtcaggaccattcctgccttgggaggccagagcagtgacaggagacaaggcttggagaggttgacttcaaaaggctaggcagccgataagaggcaaagctggggtttgaagcaggcctttctgcctccaaagtttatcgtctccaccactgcactgtccttgggggacacaggaactacttaacgctaatgggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtttgctctcttttttttctttttttttttttcctgtttttgagatggagtctcactctgttgcccagactggagtgcagtggcgcaatctcagctcactgcagcctctgcctcctgggttccagcgattctcctgccctagtctcccaagtagctgggattacaggcatgcaccaccgtgcctggctaatttttttttgaaaccgagtcttgctttgtcgcccaggctagagtgcagtggcaggatctcagctcactgcaacctctacttcctgggttcaagttattctcctgtctcagtctctggagtagctgggattacaaattgcaccaccacgcccagctaatttttgtatttttagtaaagctggggtttcaccatgttggccaggctggtctcaaactcctgacctcaggtgatctgccagcctcggcctcccaaagcgctgagattacaggcatgagccactgcgcctggcctgtttttttaaaatccacatttcatttaagtccacactgaaaatacattgtcacggtctgaagtccaaatggcttagaaggatataaagtgcagtctccttctcagcctctctgcttctcaccgcagaggcagaaagagtcactaggtttcttgtgcatgtttttcagaggtagtttatgtatataccgtttgtacatatattcatgtggaggaaatatttgactcaggacataagaggtcctctggcctctgtgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacaggcatacaacgtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtccgtctttatgagttcaagtgttttaatttttagctcctacaaatgaatgagaacatatagcaggatttttgtttaaaatcaagaaattctggaggctttattaacaagcctggatttcattctgcgtgcagtggggatccatctactgaagtcaaaagagctgtgagtgaatgcttactcagtctttagtacagctggtatcttcattttggttgtctgattttggggcaagtaattccttcctctccaggctgattttattttgtgctttctaagttcccttgtgtgctctttttcatccagccagcttgctcagttttcttctcttacctctgcatgtggaccaagcaatttctttgctttacatgtggctgtgtgtgtgtgtgtgtgtgtgtgtgtgtgtgttcgtgtgtgcacgcgcgtgcgcagccagcagggggcgcagctgcagtgcatctcagggagctgcggctgctgggccccaggaggagctccatgaccaagagatgggcagaaaagtcaccccttcccctcatttttcttttctttttctgcagttgaagaaggaggaactcctgtcttctgagactctgtataaactccaggtagtgtgcacagcccagggctgggcacaggactggaggtctgagtcctgggttctcattccactgaactgggtgattttcattctcttggcctcagttttcttatctgtgaaatgggtatgtggttgtatggaaggcttcttggatcccttccagatctaaaactcacaggttggagcaggctaacattctggatgaatttgatataagtgaggaataattattgtgaagaaaagtttttaggatgtcaggccttgcacatttcagagctacctcaaagagataattctgatacaacatccccagtgtcatcatggccaggtccctctctctgtggctccggagctctgctaatgttctcttgatcacagcaagcaccttggtggcaaagagcctggtcctgagatctgagggcctgggtctgaattgtggaactgcaagtgactgaaactttctagaccttggtcctggaggccccctgatgtgccagacacttattctttagttgttggttcgtttagggctcctgggcaggggtcaggcagtgatgggcactggggagtttagggcagaggcatttgctaactgatatggaaacatttaaacatttttacacctgttttggatgtgctggtgagtactctgaacaccagcactgaagttgggcataagaacacctacctcaaaggtttaaatgaggttatgtgtggaaagctcttagccaggcgcacactgagtgccagtcaagtcagctggtatgcagtatgccttgcctgtaggtgacctttccaagtcttccctcttgggacgtgcggctgaccaccagcatgtaattcagaaataagatcttcaaaaggcctcccatgggaccctgatgccctcctggtcccaggagcaaatacttacaaagtcatcggaccactgctcctcttcgtcagcagggctctctgcaacagcaggggagaagcagaaggcacaagtgtgagcctcagctggccagccccagcccatccacacacatttcgcacctgccttcccttccctttgggctttctggtgccatatacttgaccttgggttagttactacaatcatatgttcacttgcttttgactttttaaaaaatattaattctcaaagcatagagagaagtcccactgggcagagcaatgtgcgtctgatccatgtgtgggctttgttaagggacatttctgggtcccccagtagagacctacaattcatactatgtggcttctaaggacttcagaggatggcgtagtaggaacagcacaggacagggaatcagacagacctaagttcttatccaggctctgttccgaatgcgttggagtgtgggcaagacctctaacatctctgagcctcggtttccagatctatacaatgaggggatcatttctgtgatcatctctggctctaactttgacttttcttgttaaaaaaaaattatccaatgtcttagtatgtgccaggcaatattatcagagctttgccgtcttttagccctctcaaagacgctgtgaggggctgggcgttggggcttatgcctgtaatcccagcactgtagtcccagcactttgagaggccaaggcaggagggttgcttgagcccaggagttcaagaccagtctggacaacatggcaaggccccatctctacaaaaaataaaataattagctgggtgtggtggtccatatctgtagttccagctacttagcaggctgagatgggaggattgcttgagcccagggggtcgaggctgcagtgagctgtgattgtgccattgcactctagctgggatgacagagtaagaccctgtctcaaaaaaaaaaaaaaaaaaaaaaatcacctaaaccttgtgaggaaactgaggcctagagcagataagtcacatgcccaaggtcagatagtgtaataaatggcagagccaggagttgaaccctacaggttgccttccacgggcatgcgctgagcccccacatggtgctgcctcgctccaggggcaggaggtgccgtcctgggctctgcatgggcatagaaaaatggatatgacaggttgtggcccttaagtagtttatgagcttgtagaataaaataagtctgaattatgacagcccaggcgaatatttgacccctttccctccaaaacacatttagagtatgagaaacttagcatctagcctatcacataaactgaccttagaggttaaatgggattcactctgctgtgtaggaatcaagcagacacaggcccatgtggcagagtggctccatgacagcaccacagagggtcccagctccctcctgccccgctgagcagccactgccacagaggatccagtggatgttcctaaatttcccagaacctcaacagaaccttttctagttttatttttatgtttttgctattccccgctgagtagccactgccacagaggacccagtggatgttcctaaatttcccagaacctcaacagaacattttctagttttatttttatgtttttgctatttctacccctgccacagcagaccaccggactccagagagtcaaacatttggggtctccagaggcaccagcaaggaattgcagaggtgaaatggggtcaggaaggatactgtgggatcggagtggccacattttaagcaatggcggcagcagcaccctcttttgggaaaaacatgataggtgctaagaaagagcctcactctacaagccaaacatgggtcacactttgacgtgaacagaaaagaattcttacattattctttgggttgactaatgctgaattagagtgtactgcaatcactggggttggccaagaaactctagaagattgggtgaataaatcctcttcccaatatgattacctggcacaatgggggagtatgtttctttttcttttctagtctttttttttttttttgagacagagtctcactgtgttgcccaggtgggagtgcagtggcacaatcatggcttactgcagcctcaacctccttggtgcaagcgatcctgctacctcagcctcctgagtaactggcacgtgccaccatgcccagctaacttttgtattttttgtagagatggggttttgccatgttgcccaggctggtcttgaactcctgggttcaaatgactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcctttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctctgccttctgtcccaccaccgacttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtacttcgttctgtcctgtgctgtgattaagttgttcatgtctctctgtactgaaaataaggcctatctaatttatctttgcatctggacagaattttgcatttgtaattaatgtattaataaatgtgtgaactaataaatgactcaaacaaaggaacattaggatagcaacaatagattccatttactgaacacttcctatgtgctgggtgccaggctaagtgttataaaagtgtattcttataacagcactatgtggtaggtgttatttttatctctattttacagtggagaaacttggttttgaaagaggttgtaaaacctgcctgaggctacttggctagtgagtttgggagctgggttggaagccaggctgtgttggctcctgcagctgaaatctcatctgagccacttagccctctgctgagcacttagataaaaccttggtgaaacgagaatgacccaatccagacatcttggcacatggagacagaaaagagagaaaagcatcatacagtatgggatagaggttgtttgttggtgccccatcgattcctagctagactatctacttcaggtcccaagtgcaactcacagcatcatattcataaagttacagtcttgcaggcaattgccaagactaaaaagcatgggagtccgaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcaaataataaaatacatctgaagctcttagcaaagcctggcacacagtaatgctttagtaatgttaccgtcatcttgagcattgcaaagaatgcctcaattaacactcaaaacaccactgattctaatttactcccacgtcaatcacacactatggctaccacaaaggcatggatccaagaaagcctctattgtagtgagtaaaatttgggggagaagttcaagcttcatgtgggccaggtggattgattttgtttgtgtgattccatggtctctgccaggaagctgagatcctgggcgggccctcttgtcagttaaagcctttcctatggtgtggtttacctggtttggggcttatgctccatttaccatgtcataatcccatgccacacaatagagggactcctccctttgcctgacccaggttttaagattcatgtagccctccccagcctgtgggcacagcaccagacacaaggagatgtgagaatggccacagcggcccacatttgggcttaagctctggggtcagactgcctaacttagaatccttattctgccattttctaggagtgagatcttagctgaattgcttcacctctgggcctcagcttcccctttgctaaaatggacattattaatcgtgcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccaacccaggcctaaaggacctcagagtccaaggtcttctcaccaagccacacttcataatacaaataaagactaagggccagaagaatgaccacatgagactgggaaaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtcttcctccatcatctgagagaggggcttatgtgtcagccccagaagcagggcttagaggcagatgtgtgcagaatgaatgcgctgggctggagagggacaggagattctgctgagcgctcacacaaatctgatgtgctgccggccagtgggggctccagccatagtggacaccgcaggctccagtgacaagctgagatggggagctgatgaggttggtgtttaggaactcaggcatggaaagacgaaagctgatccagaccagggggtctgggaatgggaagggatggctggaaggacagtacaggactctgtggtggtggctggggcaaagggagtatgaatccagcctctcagttctgagtcaataggagcaccagagcccctggggcagatgctggtggcatcacagcatgtctgacattctgcctcagctgcagccctgatcctgctctggaggctacccggccgccagaccctgcccatctctcccccaacagagcaggtggtggcatgcagggagccagtgggaagaccgcagcaggacacagaaggaaggaaagagggagggtgggccagttgtggtggtggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttaggccaggcatggtgggctcacacctgtaatcccagcactttgggaggccagggcaggaggatcactggaggccgggaatttgagaacaccctggacaacatagtgagacattgtctctacaaaaaagattttagaaaattagccaggcatggtggcacatgcctgtggtcccagctactcaggaggctgaagcaggaggatcacttgagcccaggaggttgaggctgcagtgagccatgattgtacccctggaccccagcctgggtgacagggcgagaccccgtctcaaaaaaagaaaaaagaaatacttatcatcgtagaaactccctttgtctgtatgtctactcatcccttcacaggatcattaacagaggggtgggggtacagcaatgggggacatagtcctggctcagccatcacctcactgcatgacctcaggagtcactttgcctctctggtctccagttattcctaaaatgagaagcttgggttgggcaatccttcaggaatttctaagctttaaaatacctttgagcccaagtgtcattcctctattcttagttccctatggcaggactgatgttggatatagctctcccatgtcagcgtaagaccagtacctccaggggaatatggacagggagacagaaaaccaggtaaatgctggctccactaggagcaccaggcccatgacaaaagcaatgttaaatctcacttctttagtggacaaaggattgttatgcataccccatacttctgtgtgggcatttacccaagaatccctgtccaagtgccttctttgctctggatttttatttttttccatgtaagtgagtttgccacccctccaccctatatttgctctgatctcctccctgcatgatagcagagccagaggagtcacacgtggacctcccagggatgccaccccatcagagccctggacatcagagcccaagagtgcaagagaggggctctgttcagttctgactcctcaaggacttgtggggtaaccaatggggcatctgcagtgatcccagcagactctcgggcaccatgactggtctctccctgacctccatccccagccagacctcagacttcaaagataccgaaggctgttcaactgtgaaagctcaggaactgggaagcgagttcttgcattaatgtcaggagctctagtgccttcagaataagaaaaaagttcccccaaaagcatgaacacttgagcttgggtcaaagcaaggagctgcaaaatgggagtctgggatgggttttcctcttagtggctgcagtcaccttggacaggatacttaatgtccttgagacacattttcctcatctgcaaaaccgagatcgtaatttctatataacggtgctaatgagaagattaaatgagatatgtctgtgaagagcttagcttaatgcccagaacagagtcaatactcaacagattttggatatcttcccttcccacagcaatgccagctgcttggggcaatgcattctgcccagtgggccagcagttccttaggggcgatgtttcctcctcagggaaagactgaactgggattgctgggtctgaactgaaggcagcaggctccacactggcctgacctgcatccctggaggagacccagctctccattctttgtgtaattcaagctttgtccttctgtactctaactagggaagagggtatggtgactcttttactgacctcctgtggggcagttgctggtcctttctatcctctgctctctgaaggtcagcatcaccaaggtcaacacactcttggcttagagggttttgggaagccatttgtttccagaactggaaagaggacataaatccaatgtgtggggggaaaatggctggagcatttcaggagcctttggtggatcaagtgctccacagggcacgtgattggcctcccaggctcaggaggtctggtgggctctggcctccacacactacagtttccaagatcctaaagactccccaggttcaggaggagctctcagggctgatttctgaggccctggacgtgcagctgtgcagaaacctcaaggctcaggggaagcagctggaaatgctcctgggatgtgaactggggtgggggagagaacggcaagggaggatgctaactgcaggtggtgatggtggttttggaccatttccggggattgagtgtaagagcaggggaaactgggcaaggccccagtcatctggcaaagcaataagatgcatttccgagaccctggaacatcaatggatttgcaggggtcagggattgagggaataaaatctacgtgtctttcagttcaggaaaggcaatagggacagagatggtggtttatagcagggtttcttaaatatgatttacattcagatcccctggagatcttgctaaaatgtaaattctgatccagtagttctagggtggggccaagattctgcatttctaacaagctccagatgaggttgatgctatcttgctgggaatcaaactttgtgttgcaaaggcttagaagatcctgttgggccacacttctgcattccaggagagattaaatgttctgacatcaagactatttggaagggttccaggaaagggagcaggtgtctgaggacaaaaaagagaacacttcagagcatcagggatattggaagatgtgaatgcctaaagccagggaatgttaggagaggctcactttatcactgggccctgagccccagagatctgtgtttctgcaggagtgcagaataattagtattagaggggacctgacagatcttctagttcaggcctgcataatatagatgaggaaaggagcatgagatgcccaagattacacagccagttagtggctaagctgaaagaccttgtatgtgggctcagtggtttgcagttcctcttgttagcaatgtagagccatgaaaagatttaaagagaattttatttcagaacaattttctggtggaagttgagaggaccacatgcaatcaggaattaagcagattacttagagccttctaccctaggacaagcaagagatgatgaaggccttagctgtagcaatgggaatagagagggaaaaaatatttaagaggcatttaagagcaaatcaatgagatttggagattaatttttgtagaaggtgagggaaaaggaggcatcaaggttgatcccaagtgtgtgggttaggcaaaaggatgaataatagatggatgctacctcccttttccccacgcagaaatagagggaaaggagagggcctgggtgggtggatcagcaggcagacaggtgagtgtgaggggacaatcaggagggaggtccaccctgaaatcagatatgtcagtccacttaggtttccaacaattgactctgaactcctggaatctgtgtccagcatctctgatgctgttggttcatctaaaagtggcaaatattcctgcacatttgtccccgaatcctcaaattaaatgtcaccttctcagacagatcttcccacaccacctaagctcttctcctaccccacactgattccccaccattgcactcttccatcttccctcacagcaggtaccatgtttgctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctgtcccttgctagaccatgggaaaccatcacagaaagtgtccaagcagaagctgggccttgtgtgtggaggtgaatggtggtgggataggggttaagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtagatattaaagcccagaacagggtccctcttttagtgccagactgtactggcatcccctgaccaactgtctaaacttgctgactgattggcagggtgatgccaataactactctgtgaattagtgagtggtccaacaggcctgtaaccagacttgggcaggttggtcagcatttctcagtgtgataagattcccttaggaggaactgcactatctgacttattgctatcttgatcagtggccgaaaaaataaaataaaatagtaagcatcatttaaggttatggtttggttttaggctgttgccctgttgagaatcatcaatgatgtctgtagctctgtggttttcactgagggatattcaggaaatctttataattaatgctatagaaagagattttaaaactatcttccaacgtatttgttctaataaagaaatgtgtattgaatatttcacttggctcaccactgccagaaacactacaaatctcaaaactaacccttctttcctgccaaagttgatcctagttggaatgaggttgcaggctaaacttggagaggactgagagtcagcaatgtgccagcaataatttattacccccaccccttcaacaatcctcaaatatcaatttaaacagcttttgatggaggaagtagtctcttccccacttaccccacactcccagccacagattagattcattagtgctgctgtggaattccacccaactttgtgcttcccctatcactgaattgtaattacttttcttttctttcttttttttttttttgagacagggtctcactctgttgccctggctggattgcagtagcatgatcacatctcactgcagccttgacctcagtgatcctcccacctcagcctcctgagtagctgggactacaggtgcatgccaccacacctggataatttgcattttttgtagagacagggttttgccatgttgcccaggctgatctcaaactcctgggctcaagcaatctgccttcctcagcctcccaaaatgctaggattgcaggtgtgagccactgcacctgggcctataattacttttaacataattgatatggtttttctgtgtacccccccaaatctcatcttgcattgtagctcccataattcccacatgctgtgggagggaccttgtaggagataattgaatcatgagtgcagtttcccccgtaccgttctggtggcagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtatatctttatcagcagtgtgaaaacagactaatacaataatctatcttcccttctggactataaattcctcaaatgtatagtctatctttaacttttagcactgtattcctgcctcagatctgtgtgtgcctggcacatggaagatgtttaataagtgaccaataaataggtgggtggatggatggataaaaaaactacatctccactgtagtcaaaatgcctaatagatttagtcattcttgaaattagaaaagataccttttgttttcaaatgaggatagcgtatttccctttccataagcctaaatgtaaatatgaacattaaattagtcaagagtcagttaaagtatctgagaaataccttacctgaagcgtagtcccttcgaggaacacttggaggtgctttgacttttagcctggaaataacaaccatgagacaaaaggtcagtgagcagaacaatgatggtcaaagccgatgctagaagctgatatagacagaatagatagacaactaatagcataatggcttctcttggaccaatcaatggacagatttgatgtattgtaaatgtagtgaagccattagtcaggggttttccacctctccccatctccccagtgcatgcacaatgtggctatgacttggcaaaggtgaagtcaggtggagaagggctcagagaggtcagaatatgatagtaataagcactgagttcagaggttcaaggaagataaatgttgattggttggtaaggtaagtgttgataagaaggtaagataagatggactatattttaatgacttacaaatgtttaacaggaaaaaatcagctacaataagcgttttggttgtaggttgggctaaaattatgtttgcaccattttaaaaacgcaaataagccagacacactggctcatttctgtaatcccagcactttgggaggccaaggcaggaggatcacttgtgcctaggagttcaaaaccagcctgggtaacatagtgagactccatctctacaaaaaaataaacaaaatgagccagccatggtggcatgcacctgtggtcccagctacttgaggggctaaggtgggaggatcacttgggccccagaggtcaaagctgcagtgagccatgatcacgcccctgtactccagcttgggcgacagagcgagacactgtctttaaaaaggaaaaaaagccgaacaagtgaacagtgagtgtctcaggattggagattatgagacttagcatatttagtattcaacttgttttaagcactctcaaaactttactaaagtaaaggtgctttagtacctttatgcacatatgaaatgtgctagtcacaatccttcttcattcaataaaagaagaaaattgaaattacattttagaaaactattccaagttttgtaagttctgatacctccctttccactacttgaaatgagtaaggtttatagtcaattatttttaataattattacccattttaactaagaattatttgcttaatgaaatttaaaatatacataaataaaacttatatccagtagcctttatttactaaaatatcatatccttctatagaagcagtataactgctattatatacaaactttcatgttttgaaaaaaaaagcatagaaatttgtgtttgattaaaaaatgcacacaaaaacagtttacaaaccaaaattgtaatttgcaaaaataacaatatgtatatttacatagaaattctggttttctttttctcataggctctcaatatctattatttcattcaattctcctcacaagccagcagggtgggctgggaagatactatcattagtcccatgatgaggtatagagacagagatcatccaaggtgttgcaaggaagaaaaacaaaaacaaaactgggtctggtgcccaggttggttcaaggaatagtaaaatttccaaaagcacaaaccacctgttatccattattactatcatttcataaaagaaaaggaagggtattttactacccccaaataatctcagaataaaggaaaaactcactaaaggactgttggccactcaacactaggaataaaaggcgtagttgaactttgctctgtagctggctgctgtgcacaacccccaacacttcatgctccttattttctcatgcggccatagaccagtgaaaactctgtcacagtcttgtgttagggaaccagcgtgttcaagcgtgcttcctccgttcagggtagcacctgtggcctggcttcaagtaaaagtgtaactgcaagtcactttgagctaaagggcccctgacgtcacccggggtaatgactatggtggccataatttccaggctgagaagaaacatggtttgtcatgtaaaagtgctttggtcatccaatgggcagaatgtatgaaacagaggctgttataaaaaacttgagctccacagctgctgtaaatatgactggctatggaatagagagacattttatgcagaggcttcatgttattgagaactggtgtattgtaaaactggcaactgggggccatggaatagagaaacattttatgcagaggcttcatgttattgagaactggtgaactgtaaaactggcaattagaattgctagtgattgtaacaaggactgtctcataaagaatgagattctatctgtagcagaaataataagcaaaaatcatcacacacctctcccactcatcagacagaacatgaagccaaattctcctcctctgtaagatgaccaccacctcacaagcagaaggccatttatgtttgatgatgatcacttatgcatagagactcatttacatttcatagtctggaaataccaccaaaagtgatttcttatttttaattttagcatagattaaaacgaataaggatgctcttttgaatgcatagagaaatgaacttctataaactattttttggtccaaaatttggggagaaaaatttggtaatagcaattaaaactttaagggcacaacttcttccatttggaaatttcattttaggaatttagcctactggtatattcaaggtctgcaatgaacatttattaaagtattattcatgacatttaaattggaagaaacaaccagagaattttgattgctattatcaaattgctatccaaaaatgttgtaccggtttaaattcaaatccccccttaaagatggccaccaatatatagctagttaattgaattataatatatttaaggtagactattaaatcatctgttcagaaaagaatatggttaatttttacttactaacaaataaagatgtccatgaaatagcttaagtaaaaccaacaaagcaagttggtagaatggcgcatgcactatgataccatttatgacgaaaatgtatgtgtatagtatgtacaatgtcagtgtatgtatgtatgtgtttaagcacacacatacatacatatatacatacttatacacacatacatacatatatatacacacattgaacttaccatgacaatgtccctttctggggagtgggttaagatggagatataaggaaatgggagattttgacatcatacaattctggcctctttgattttttttccctggtgaatctgtattagttttatttaaaaaatttaaagacttaacagaataccatttcccattttctcttgaaagagacttacctactaaggtatataagacctactaaggtacgtctaccttagattttgagtggcaaatgcagatatgtacaatttttattctctttaaaaaaaaaagcttaagagtttttgatgtacaaggagttttgagatgctaggctttccctctccaagtgccaattgaaaagttcattttcaggtaataattcgaaaagcagaaatcaaaatatggaaaactggctgagcgcagtggctcttgtctgtaatcccagcactttgggaggctgaggcgggcggatcacctgaggtcaggagttcaagaccagcctgaccaacatgaagaaaccctgtctctactaaaaatacaaaattagccaggtatgctggcacgtgcctgtaatcccagctattcgctgggccgaggcaggagaatcgcttgaacccaggaggcagaggttgcggtgagctgatattgtgccattgcactccagcctgggcaacaagagcgaaactccatctcaaaaaaacaaaaaaacaaaatcaaaaacaaaaccccaaaaaaaggaaaactcacatggcatcttgaagaagctagggctgtgttttgtaacttttcatttggatttctccatacatgttttcatagcccttagctaaatggttatagaaatgattttcctgctttgacatttgttaggcaccttgaatgggcatagctcaccttccctgcagtgagaaggaaaatcaaagtccactgagtacaactgcactcacttgtcctgttccagaatgtagacctggccaccatggattccagccaatagtaaagaagggttacgtgctaaagaggtagaaacttctcatccaggtaacagagaaatttgttttcttccatgtagcacatgttgacttattttatataattaagtatttaaatagaggcgaacttactttttgattttattcattattccaccttcattgtttttaatatcatggaccatcttttgaagctgcctgtaaaaaacaaaattaaacataagatattaataaccagtctgactttttaaaaaaagtctcctactcttctcgaatacaaaaaaggggaaaaaactctaccaaaacaacctccaaataggatgaattatattgtatttaattaaattgaccatctgctactttagcgaaggagaagcatgactgattctataaggaatatggtcactgggctgtgtccccttccgttgggatgtctggaccagtctcaggctgtgaagaaagatattctgattccttgctcattgtcttagagcatctacgttacgaagatagatgctactctgtggacatagcagaggcttcaatcaggcccaaggttcttttttattaaatggtagtaggtagcatctattaaaacttccatttaaaagttactcctacctaggagtcataaagaaaatgactattaaatctggctgatatttgaaacttctgtagaacaaaaagtaatattgaggcaggagaatagggtctggagtcagggaacctaaggccaatttgcactgacttcctagaactgaatcaaatggaaaaccccacctctccatgcacaagtaacaaaaggatcagaggctactacctttgcactgcgttatagatgagaaatggaaagtgcctctgattgatcccctcctgtaaccaatcagactggtcccaggccaagtcttcctgtgtaactttgtaccttaacttcagcgtctgattgatcaccttctgcaaccaatcagactggtcgtgggccactccttcatttacataggatgtaaccaagtaaccaatgggaaacccctagaaggaaaattctgtaaccagtgctcttgagccacttggtcaagcccattcctactctgtggagtgtactttcatttcagtaaatctatgctttcattgtttcattcttctgttactttgtgcattttgtccaattctgtgttcaaaaggccaagaacctggaagactcatagtcaagaccctccactggtaacaatatgtatcaagaccctccactggtaagaatatgtacaaaatcaaaagataaatgacatgctgaaagaaatatttgcaacatatagtaataataataagaactacatattagtttgctgcaaaagtaatcacggtttttgccactggaagtaatggcaaaaactacgattatttttgcaccagcctttctcgatttacaaagaaatcttacaactcagtaagaaaaagagaaatagttcaatagaaaaatgagcaaaagatatgaacacacagctaacagaaaacaaatacaagtggtcaatagaccaatgaaaagatattgaacatcacttatatttaaacaaatctaaatctaaacaacagtgagatgtcttttcgcctatcagactggcaaaacataacaagtgtgataatatccagtgttgagaaagtaaattgttacaatcaaatctgtcaagatttaaaacgtccatgacttttgacccagcaattggactgctaagaatttgtcttatgaaaatggtcacaaaatgatatcagtatatacatataagcatgtttattgcagcgtgatgtgtaagaactctctaatcttctccctgcttcttctgccctccccacaaccataactctgaaaacaacccaatgctcattaatcattaaaagggaactagttaaataaattatgatagatccatgcaatggaatgccacagacccctaaaaaaaagaggaatatacatctatattgttgcctgaaacttctactttctaaaaaggggattattactttatgatgttttaaaatatttgaatttttatagcatgtgtagatatcatttgtattatctgtgttatacacaaatatggagaaaaatattataatgggaggatagggccatgttatgttttcctcataataattttctgacttaaaaaatgtataataaaatttcacgtggttcttccctgaaagagtaggacgttttaattcacctttcaggtaaatgcttcctttgttctgagaaaactatttgactggaccctttagataatgaactgtacacagctattgttcttgtaggaaatggtgatttccccacaatcctgaaagcagatttctctgactctgggagctaggccttgggttaggtaatagaaatagtttagcataggtctaggaaactgttggttgaggacatctgggagaaatactccttggccctttgtgaatttagaatgcccgtgcggtggaagggttactttttggtgcagcagtggagcagtttagagggtaagaggacagcttctcagaagaactctgcctgggcaggcctgtgggtgtcctctaccaagtgttaatttaaagctaaacaatgcagccatgctggtgctctgctgggtctgctctattgagggcaggccctctagcccttagggagtggagtgaaatttacaggatagggaattgggaaaagggagattgctcaaacgtaaaatgggaacttaggctgcagattttggggagatctctctccttctagggctaatggctgttaggcgctagagtgctgaagagcgcagacaaacctgagggattttcagtggtgggggtttgggcgatggcagggggtggtagccctgaatctgaggctgggtctgggcctctgctctgagaaaagccatagccagagccatcgctagctattttcaaccacataatccctctctgctgtccctgaatcttcagtaagatcttgtagtagctgcagcccggcctcagctgggccttggggaagagagtgttccactggcatggaagggtggagggaggacaggctggagtgtgaagtagaaggataggagaaacttcttttgggacagccgtatggctgcattttggagaattatctacgtaagtgaggtacccactgagggacccacgttcaaatgtatgtgtcaggggtctggtgccaagtcattgtaatttgggtaacaaaggaaatgagaccatattttatactccctagctagggaggccgggcacactgatgatacaagtgtaagagctcaggaaagagccaggcacatattatgggctcagtagcaaagagaaaaggatggttgagagacacacagagggtccctcagatgggcccttgagttgcctcagaactctacagttttctagaatttgttcacatatactctatgccaaacccttttctccttttcctgaggaactatagagaatcttcgagatagaggaaagaagaaaatgaaaataaggggtctggcagtggggagagagattgagagacagacagagagagagggggagagagagagagagagagaggaagagagaaagagagagagagagagaggttgaagtggattgattgcaaggaaattcaataatttcatatggagggcagagggcagctcgttgtaagctgactgtaactgaatggagtatctttaggctaagttaatgcttaaccaggttgaggagcaaaatgaggcagcagtgaagaatcctatcagaaatgtgtcaaaaatgggacacaggcagagtaatagggaaccaggggccaatttgcataagtgattttgctgtggatgtaaataaacagatgcaaaatgttgcaaaagaattggatgcaattttgtcatttgctcaatttggcatttggtgcttgcttggcatttcctaattactttttattgtgtattattataacaataacaattatactatgtaactatataattacagtaagttactgaagtgttgcataaactatactttttaaagttgatgcataatagcagtagatatttatggatgcatgtgatattttgatacatgcaaacaatgtgtaatgatcaaataagggtaattgggaaacccatcacctcacctcaaacatttatcatttctttgtgctgaacacattccaaatcttttcgtctagctattttgaaatatacaataaattatagttaactatagtcaccctagataaattacactttttatattttaaagttttcttctctctctgtatctcgttcacacaaattctgatgtctatagactgctttgttacaactgccaaacttctgtgatctgggaagacatagtgacccaaaaccaagatttgctgtgatgctgttagctcattatgtcaactgtccacgcatctggtgatgcacagctctgctgctctctagtattggccatttcattttgaagtgctttttgctccttattacaacttatagcacatgccatagcaaaagaatgcacaactggtctgttccaggaggggttgttctggattcaaacagcaatccttttactgagatgagttgtgtgtaggtaaagataggtaaggcataaaacagcttcactttgattatctcattcagagatatccttccatggtggggagatggataataaggtcacaatgtcctaatcttctaaagtcatagagagagagccatgctcatgtaacaaaataaaatgaagaacaaagcttatctaatacatgttttaaaatatataagtattgtaattttaagcagtatggcattttggtatttaaaaatggtgagcaggtcatataaataattataatacttgtgtaaaccaaatcaaattttatattctctcttttgtttttaattttcaagcttttgaattaagacacgtaacttagtcacactgtagtagtgtgaccctgggtaagtctgaatctcgagagatttaaattccaggaagcactgagagtagaaaagtcaccatttgaaagttacagcagtttcttccctttaaagtgccttactttagaatccgatagatctcaagagggctattggaccacaactggctgggcctcacccctggagattctcattgggttgtctgtggtgcgtcagaaaatctgcatttatgtttttatttttattattattattattttgagacggagtctcactcttgttgcccaggctggggtgcaatggcgtgatctcggctcactgcaacctctgcctcccagattcaagcgattctcctgcctcagcctcccgagtagctgagaatacaggcacctgccaccatgccgggctaattttttgtatttttagtagagacagggtttcattatgttggccaggctggtcttgaactcctgacctcgtgatctgcctgccccgggctcccaaagtgctgggattacaggcatgagccaccatgcccagctcctgcatttctaacaaattcccaggtggtgctgatgctaccagttgggagaccatcctttgtgcatgtctatgatagatcatgcctttttctattgtgggccttttagttgtgcccaagtaaagcaaatacctgtttgggggaaaaactaagttctcattaactcaagtgcaaagtttcagacaaataaattgggtggtcaattggaagcataatttgggtgtgcgcttttcagtctgtagcttctttgcaggactgttgacttttctctgtatgaattcagactaacctctgcttatatattttaatttattttatagtcatgtactttcttcttgagccacagtttgcaaaactgtagaatggagatgaagtgactgcaggcagaacatgcccctctccttgcgtgacaatggaaaagggactggcccttcttggagcagagtgccatggtcgggaccattttgccattgctattataatatggtgctctaagtgactaacagaatgcagtggcggtggcactaagactcgacctcatccctgttggtgggggataggctgtctttgctgtcactcatcctgcaaagactccaacctagaaaaaggatgtaagaaaatgaggatgtggcaggcaggcctcaggcttggtactgtgatgtttcctgtcttcccggggcctcctggttgttggtccctgtgctgcaggttgaatagaggaatcttctagaaggattcccattgaatagccttccaatttttactacccatgcataagatgtacagattttacacaactaagatcactcttgacattttgaaatctgtgtgttccacttactatattgtgaatattttcataagtgagcaccatccttaggctttatctgcatctttctttcctctgctatctgaggggcttttaaatagctgaaactctgatccaagtaggcgtgacaagaagcagtgaatcaggacccctcagcttgagggagcagagagatgaccagaccacatggcaatctgagaccaggagaagcaaaggctgtgtgagaataagtgccgaatgccttgcttctgggagcctgggatcaagaggcttggacctcaggggcagagagggaggggacaatctcaggttccctcttgtttcttcaaacccagcctctcttccagatcaccctctgaaacagtgttttctagagtaaggtctaaagattgcctgtatttatttattagaaattcagatcactggaccctaaaccatatcaatagaataaaaattccagatagagcccagcaatctgctttttaacaaattttctaggcctggtgactcttatgcacacagaaggttgacagccatttttaaaggattaggccaggctgggtgcgatggctcacgcctgtaatcccagcactttgggaggccaaggcgggccgatcatgaggtcaggagatcgagaccatcttggctaacacggtgaaaccccatctctactaaaaatacaaaaaaaaaaaattagccgggcatggtggcgggcgcctgtagtcccagctactcgggaggctgagacaggagaatggcatggacccaggaggtggagcttgcagtgagccgagatcgtgccactgcactccagcctgggcgacagagcaagactctgtctcaaaaaaaataaaaaaaattaaaaaaataaaaaaaaggaaaaaaaaaaggattaggccaggtttatccccttctaggctaagtttaaatggaaagagcaaaagagacgacttcccaacctccagagtatcttcccccatccaccatagcctggaatagctttaacagcaaatcttactattttctccataatgagtggccaaaggcttacccaggcattctccccaggaaaggaaagacactggcaatggaattttagtcaatggtatgatgtctgctttcaacaaggggaagacagcagaaggaatcggctgtggttgccaatggccaggcattcacctttacctggactcagattaatacaagtcgggcacagtgatgcttccagcctgcctgccttctcttcccaggcagcctggtgtcagagcagggactctaacccgaggagctgactgtgtacagctcagccttcttcaatgagttttttttttgttttgttttgtttttttgagatgaagtctcgctcttgtcccccaggctggagtgcaatagcacgatctcagctcactgcaacctccgcctcccaggttcaagtgattctcctacctcagcctcccgagtagctgggattacaggcgcctgccaccacgcctggctaacttttgtatttttagtagagacggggtttcaccatgttggccaggctggtctcgaacttctgacctcaggtaatccgcccacctcggcctcccaaattgctgggattacaggcatgagccaccacacctggcccttcaatgagtcttttatgaattgaagtttagaccttacatcaattggcagtctttctacatctccttcttggatgaaaaggtaggttaaagaaatcgtcttgactttggctgcacattagaatcacttaggggacttttaataatcttgacacccaggccttgcccccgaccatttaaaccagagtcattgactctcaggggatccaatgtgcagccaaggttaagaaccactgacagtgttctcaggataggagaactttgtacataccccagggaagttcgtctggccaagagagcacaaggagaggaatccatagtgagaatccacagaagggtatctgcagactgagaacagccccaggcacatagaaggataaacaagttcaggaaggatggagtttaaggacagcgagctcttccagggccaagagggcacggggagggcagctgcatgcagatatttcggccagatcaccagaggtgtccaagaaattacatatttgacaaaaacacttttccaataatttttattaaatacaggagatgatttaacagatgatattatctgtaagaagtacttttttaaaaagtttagtagaaataagatcataaaacatcttgttttccttgtagctctttagtgctgtcacagaggacaatgataggcaggtttcaggattttttttttttcatttgtctttcagaaagggtggaatgcaaagtattgctaatcagagaaaatccctgtttaatctgcatgtaggaatggattaaagagtgtctcaggtgaaagtgactctttgtaaacaaacagaataaataaatccttccttcttcatcccccgcatcttaacctcaggtccagttcttgagtttcatcctttcagtgttcataggctggtcctcctctctgagccaagatctaagcctacactttcccctttacaacaggaaaatgcagcagctggcagcagggccctcccatccatgctgtgagggcttgttagggcctctttcagcaaatgtttctaaaacctggatttcaacgatcactccttcctcaagagtgcagcagctccccggtatctactgaatcaagcctgagctttttgtcatggctcagtcactcagtctcaccctgagctccatgcccatatagaaattttatttttgttactaaattttaaaacagctcgatgatagaaaattgaacactgccaataagaaaaaggaaaagggccaggcgtggtggttcatgcctgtaatcccagcactttgggaggctgaggagggtggatcacttgaggtcaggagttcaagtactgcaagaacccctgggggctgctggctcagccctttgctttatccacgtatacttgggtatccttagaacatctgtgctggtgcaattgacctggtatctccaatttatatgtttctaaaatcaatttggagtagaaatctctgtaatgttttccttggcatatatagaaacaaaaatgcatccatgaatactttttactatgaatggatttttaaaaacacttttttaaacttaaaatttaaatacatttaaatgcatttaatttaaaaataaaaaaattaatgttcatcattaggtctgctgattctctagttgacttcctccttttttaggtgtttaatgtaattgactctgggtttctttttaagatgctactaatatagtatattttatttttgttactaaattttaaaacagctatatgatagaaaattgaaaactgacaataagaaaaagaaaaagggccgggtatggtggctcatgcctgtaatcccagcactttgggaagccaaggagggtggatcacttgaggtcaggagttcaagaccagcctggccaacatggtgaaacctttgctctactaaaaatagaaaaatcggctggcagtggtggcgtgtgcctgtaatcccagctacttgggaggctgaggcctgagaatcacttgaacccgggaggcagaggttgcagtgagacaagattgcaccactgcactccagcctgggcgacagagtgagactccatctcaaaaaaaaaaaaaaaaaaagcagcagaagaagaagcaaatggaatttataagctggcatccttggatcttcaggcttgaaacttctgaatgttctttaaccctttctctctctctttgactcttcatctcacatctctagtcacatcaaaagggtgaggaacagcagccaggtatcaggaacagcagccaggtatcaggaacagcaagtgcaaaggctcagaggtgaaactgtctgagatgtttcgggtccagtgagcagctgagagtgtcaggaaagtaggtgttgagaggatgtttacaagacaaggatgagaccgctgggagcagagacagatagtcaagggacctgttaggccaaggagatggggggttacaggcttcctgctggaagcccttggagacctttcctcggggtgtgtcatgatgagggtggaagaatggaggaggatctcggcctgggacagtggtggctgggacaccagtatggaggcaactgtgccaggcccaagcctcgagctcgtgacagcgtggtaccaaaggcaatggaataacactaggagtgccctgtgggcctcagctgtgcgaaaggaccaacaactctcaaagaggacattactgagacaaagtgccatgttggccatactggggcctgagacaaagtaaatcagcaggactgattctgtcttcatctaaaattccagtagtttcttcatcatggatttctgggcattcattttgatttttaaaatattatattaaatactatttgtatcaatttattaatgagggttaccccttaaaatttaatgtcatgctttgctgttttatacatgactcgttttgttttattccacaaatattcagtgtgtgcacactgggcatggcacatgcaggccacagagctaacctgaacacaaacccgaccctcttgtaatgcaggaaaggggctcctttcaccaccttatcacatgacagaaaccttctggcctatgtgaagccaggggacagatataggcagaccggagaattctctgattcacacaaaacatcctcctctcaggtcactcctgtcttaaagctgaagttttcagccaccaacccatcgttttgaagcagcatgatactttttagtgactatcctgttacttgcatgctgcaggactcctatgacaacttctccccctccactctttctaaagccttgtcatttctggcaccggcttcctaatgctcacttcctccagcctggccttgctatgaaataacaggaattatatttagatttgcgaattcagcactgcaggctgcttccttctggggagtgagctcatggtggagctggcagagttttgacagctttggcagtcccttccatggtgtgataatgtgaacaagcccctcaaggtcgagttagtggccttctcctccatttcacagatgcagatactgaagcccaaagagatcagagatcatgagtgtctcagactatacagctgactccgaattttgcctacaattaaggtagtcacagaaatttggaagtgagagagactttgggaatatcctgggtcaacctcctcttatgccaagggaggaaattaaattccagggaaattttgtgattgccctgagattaatttagttgaggactcctccaactcttttagtcatacctgttccttccccttccacataaggcttgagccccctgctagagaaggtggggggtacctccatggccagaggtaacccccaccttcttatgccatagttcagagctgtgattatagtacaagcccagtaagccattgctgagagaagcatcatgcatgccagtgatcagacttggaaaatcaataacggtaaaagccagcatttattgagcatgtactacgtgctaggtactttgtgtgcattatctcattaaccctcacaactaccctgtgagggaggtcctattatccccatgtttatattatgataaaaaacacataacaaaaaatttaccatcttaaccatttttaagtatccagttcaatagcattaatatattcacatagttgtagttatccctgtttttatagatgagaaaatttgactcagagaggttaaataatttgcccagatcctacagcaaataagtgatagagctggaattcaaaatcaggtctgattccggagcctatgctctcaacccactctggatgatacaggctaacttgtttcaacttggcccctcaccagggcaggcgactggcttcagcacctacgttgcctctttggataccttcctctctgtccctggagacagcacccattccctctaccaacccagtaatctttactgtgacacatgtgcccccacccctgccttgctattggtccccaaggttagacattttgctagaggggagcgtcagctcttaagggcctgtttcagactttgggaggaagagggagagtaaaaagaggaaaggacagatggcaggggaaatgggaaggagagggggtaaggcacatgggaggcaggagggaatgcggtagcggccctctggggtctggaatatgctcagaagtagggtggctgaacagagcagctggaaggacgccaccataatccatgcatcctttctcaacacccgaggcagaaaggccccctgagggtcctggagtggaggggctgtgttcccttacacacaagcatcttgctgccagggctgtttcttactatccacttattaaccgtataaagtaatttataagtttctccaaacagttcacaccctacctttttttttttttttttttttttgcttgtttcttttttttcctactgagatctgcaaatattttgtggtagtctttggcatgtctgaacggctgagcttggttataagcagtcagaaattgggctgacttggcacaagcaggagtagggatgattctactaataccctgtgtccttcaaaaaccctggtaggacttaccctatcagaggcagttatgcatcaggcacaccaccctgagactgatgagatggcaaggaaatgatgctatacctgccttaagaagttcttagaagttttgtcacttgatttgacagctgaaattggcatggcccttcccctctctgactttaggggccagtggtccttggggcctccaggaatacaacacttctctttcctttagcacattggaatgcttgctggactctgctctcaccacccacctggcagaggtcttgaataaaggaaaacttcctcacaaaactacataaaagcagattgcaaaaaccaaaaaagttaagggagactcctgtgttcatagatgacacagactcttgggtttggaagaacactaagaggtcatgtcatttagtcccttcactgtgtctgactctgatgtgctcattgttctgatgaggtgctgacagctgcaccgtgcatgtgttcactgtctgtcctctaccagcataaaaatgcaaaactgacgtctcttaaatcgaaccagctgccaataggtttgtaaaaccaagcgactgagaagtagttctagtcatgtttctgaaaatgcaattctacataattccagaaaataaaagtgtcttaagaatttgaatatgttcttttaaaaattaacttaatgggggaaaaaggaactttggctatatctacatggcatgatatatatatagtattgtcatctacttgtcctggcatccatttctgcaggtaaaagcaaagatattttcaggaagtaaagagtgattttgagggatggcattcaagaactcatatattgaaaaagtttgacccagttaaattcttcttagctctgagaaaacaaagatattgggaatgtcttgtatgtaggggtaggggtgaaaggaagcattgtaattcattaaaagcatctacaaatgtttgtcaataatacatttaaataaaaattttgaagcaatatctttttttttttttgagacagggtctcactctgtcacccaggctggggtatagtggcgttatctcggctcactaaagcctcaacctccctggctcaagtgatcctcccacctcagcctcctgagtagctggaactacaggcatgtgccatcatgcccagctaattttttgtattttttgtagagacagggtttcgccatgttgcccagactggtctcaaactcctgagctcaagggctttgtccacgtcggcctcccaaagtactgggattacaggtatgagctactgtgcctggccaacaatatctagtgggtcaaaaaaatatataatcgtgggtccccaaaatacactcatttatggtaaatataggaaattgtttaattatcaatttttaaattgtggtaaaacatacataatgtaaaattcaccatttcacccatttcaaattgtacaactcagtggcatttagtaaattcacaatattgtgcaatcaccaccactgcctagttccagaatattttcatcacccctaaataaaaccccagacccatgaagcagtcattggcaattttaaagcagattttcaaaataatttacttttgaggtattttcatgaatagcttttgttttcatcatgctaagaggttgttaatagaatttaccctaataggtagcatcgggtatattaagcccaatcatctaagatcggtttggcaactgtgatgatcttcgagtatgaagatgatgtgaaatctgaagtcctgccatggtaaaaaagagaactctgaccttgaacaggctgtaaagatcatctaaaagccaaaacaatcatatatatgtacagagttcatttttttcaatgattttatattacatttgccattttcttttttgaaattatagttctcatgtttgtatgtgattctcatagttatttgcagtgcaatgaaatactcttcctagtatgttcaatattgagtagggacattaatacactttttatgcttaaaaaattatttttcataatgaagtttttatactttgaaccaagtaagattgtaaaatgaaggggtaaaaaatggaatggggctgggggtcatttcactctaggtacgagctcagactttcttgtcttctactccaagcacccttggtcatagcctccctctggggaactcccgtttacttaggtgtggtctcccacctctggcctttccctccttatcaccatgttcctgaacaatgatccatttatccagctaggctgttgattgaaccacctctgtgagtgggtaggagagctctctgcccccttggtctgagttggttatcagataaatgagtcctgcgtgggtgctagtgacagatgactcagtgcctgaacctattacacttaatgatgtttaattttgaaccagaacattgagacactgccatatcccaagtagatgcctctctaacaacacaatccagggcaccagggaagcacagaccaggaggaagggggcattcattgagctcttactctccggtatacagaggtactgttctaatacccctgctttatgttatatattattgagatattattattcccatttttcagatgaaaaacctgaggctaaaagggattaagtgatcttctcaaagaccacaagctggtaagtgcagagcaaatgttcaaatccacatctgcctgattctttcttttcagtaagacaaaaacaccttccaagggcacctcttaaaataccacgttggtgctgtgtgcttggtctgtatataagaccagctctgctcttcataattataactcactctcagattacatgaacgattgtgggagcattctttgcaaaatatatagcagtaggataccagacacacctgagtcagtgtggaattcaagtttgggcctggaacacacaattgtctgaaatactgacagcaggaatcctcagaaggctttctgactagtaagtgactgcttttttaattttaaaacaaacgtctatgaaaagtgaagaacaaagcctgaatgttacattggccagtaaattacacaggcagacatggaggggtcgtctagagcttgaacaggtgacctggcctctctgggcctcacctttctcacctgtggaataaaggggctggagaggtgtcctttcagtcctcgcaaggcgaatctctgtgcttctccatggaagcctgtgtctctgcacattgtagaagcaggcaaggcccgagtcctcatggaacccccgaccagcactggctgcataatttctggggcccaatgtaaaatgaaaatgcagggccccttggtcgaaattgttaagaatttcaggactgcaacagcagagcattaaaccaggcacaagctccgagcacaggaccctgtgcgactgtatggccacacgcccaggaagctagggacctgtgctgcgtgttccctacaatgtgtgaaggaagggaatctggagtaggtctggggcccccagccagcatgggaggcagggatgctcctggggtaatgagagccttccttaggaaactggccaacagagaagtgtggctcagcaaacagtcaccacatgtccctcaagctggcttctttgtcttgcttttgaaataagcattgaaatagccatgctgggctgagggaaatggtctgtttggaggcctagaccacagtgctgcaaaagggttgtgaaaacattaggttaaaaaataaggcttcaggtgtagcttctggtggactccctttcagaagggaggtgaaggcaggacaggtaggaaaaggtggtgaaataaggaggaggaggggcttgtggggagggctcttttctttttggaacaaagcacagggaggaaggaggtgaagtcagactttcttgctcattgctggatggagacaaatacgccagtaatgaggaggcttaacacacagtgaagaggagcaacctcctgagagagggtttccaccgcagcagccaaccccagtgtccagtgtcagcccaacacaaaagctgcttccctacagctgtgctggggaaccccgaggtcatgtgggacctagaggacggcagccagcatcacacttcagggttctctgctcccttgatctggagcagggacttgggtaggggctggaattccaccccatcagcaggtgaggcccatttctggagcaacaggtgaaacatactctaaattcctaataatgtgcatggttcctaggggcctaggaaacccagcataaacgtggaatgaaaaaactaaggctgcctttgagcgcttaaacctcaacatctgacagagcaaacacagagaagcaaggtcaccctcaagaagcagaatggccccaagtctgtgagatttaagggggacctgatggaatgtaatcaccaatccagagacacagggtgtccaatgggaggcagtagcggtacctctctgacctccaatctgcagagacggagtcttggttaggtggacttaaaaggcctccttagtgaggctctgtctacagtgggcaagagcaccacagccctgcaagcctgggggcaggattacccaagagccttgagcatctgacattacaagagacagcgctcttctgagcacaggaccctgggtccttcacatagacctcctctcatcattcctaatatgcagaacaatcacacaaagcgtttcctgagatccagattcaatcgaaaccaatttaaagagttattttggaggggggcggggagacatagaaatgcttaatagagctggaaaaaagtctttaatgaaaaagattgaacccttaaagcctacccatcggtttcaaaaaaatatatacacactggccacagggagaccagacaagacagggtgaatcctgctccagaaactctcccagctcatggaaggattattccaaatacatgcctcttggacactgccacagaattttcatatataaccaagaagattaaaggatggacaagcaaacgcatttcatctctcctccaccagctgctttgtcttttatccaatgtccttaggcaacatattctgctctaggataagcacagtgtgtgcacctctgtccagaatttggccttattattattattatttttgagacatggtctcattctttcaccaggctggagtgcagtggcatgatcttggctcgttgcagcctcaacctcctgggcgatcctcccatttcagcctcctaagtagctgggactgcagacgcatgccaccacaccagacttatttatttatttatttatttatttatttatttatttatttttgtagagatgggtgtctcattatgttgacccggctggtcttgaacttctggctccaaacaatcctcctgcctcagcctcccaaagtgctgggattgcaggaatgactctctacacccagccagaatttggccattggatcagactcacaagcccttgaacttcttaatggctgtgttatgacataatatgctttttacctcaacattaagaatttccactcaagatttgctcagtctacttgaagaagtagaaacagactatttattacaagatgaccttatgtctggaaatcttttcctgctctcacttttctacccaggagagagcaacttatagctcaatggtgcatatagttcatgggatctagttttgtttgacacaacttttaaaaaggaacatcaaattgaaatgcaggcctaaggatttattgcccctcctctaggcaatccctcatccaaaccatcccagaccggaaacccagtgtgatctgagcaaagaccacaacaatggcaaagatatgtattgcctattctgaactttaaatacacgttgtcactataagcaaatagaaatgaatatttgcttattgttctgaagagaacatgtcacttagtctgaatcagggtttctcaacagtggcaatagggacattttgggccagatgattctttgttgtggagactgccctgtacaatgtaggatgtttagcagcatccttggggactaactactagtgtctgtaacactccccagttgtgacaaccaaatgttcccttggggacaaaattgcccctgatggagaaccattgattgaaatgatccagctatgtcttgcgggaggctggggaaggatgtttctgtggaatctattaagaagccaaagaaagcgaagtgttttaatttccctagaacaagctatcctttaatttttctctccctttttttcttgctcatgtaagaccttctttgaaaatgaaccaagctgataaattctcccaagaacagatggggttaaatcacctgtagggagaaaacaagagatcgtctgtaaatacatgcctgaagagtttggcaccagcccagttcttttcaatccagtaatctaggaggcagggctggaaaataactgtgatttggtccttggaaacctaatcaattgtatcatagtccatttggaaacatgttgtgtgaagaggaaggtgttgttcagccatggtacacaatcactgggtccagaagagaggttcctcggacatgtggactctggtttagggttttcctagcacagccatgcccagagtgggtgaggaagttgccttgagttttcttggctgatgactctgaagtccactcgcactaagccagtttctgataacgtggctcccatgtgacttgcccacagggagaaagaacccttctcagctgctctgggtagtccatccattggtgtgccgcaagatggtccagttaagtggcttctcatccagtgggatgcaggtaggcagtgtgaggggatgggaaaccagacggtccaggaagtggatctaatctccaccactagatgctgtgcctcctgcctgcagctcccctgaagtttgccaccccagttaaaaggagttggaaccacaaatatgaagagcaagagagacagcaaatgccactcagcttgggtggtttgaggtactggtggttgtgtttgctttttattgacttggtatactgactaagtggcaaatactcttctgggaacttcagtccatgttgtctcacttggtcttcacacaagcctgtgaggaaggcatctctagcttcgtttggcagctgggaaaactgaggtgtagagaaactgaatggcttcagctagtaactggccattagaatcagccctgttgggccccaatggcatggtccttctaaatatatcaagaaatatttcctgagagtcctgagataaaatggtagcctttgagaatgtaacatatgtcaaatgtggtctctgtgcttaaaggatcacagcatcagagctgagagggactttgggaaatgttctcattttgtagtttgaaccaaacaaacataggggacatgggggagctaataacctatccgggatgttgtggaagaaaaggaaagaaaagccatatatggaagagaagagccataaagaaaacctgcagggtgtggtaggtgagtgggtgtcagctgaggtgaagagggaaaggtgagtcagtgtgagggctgacgaggataccatcgaccaaaacagggaggatctgagagacagctagttgtggaaaggtgaaaagaaggtgaatttgtttctgaagaactgaaccagaaaaatcaaggaagtaaaaactccagttgaaaactccaaaccctgagaagagaaggcatgtctcagaatccattagaaaaggtctcagtgagacccctaccaggaagacccagacacccacagcagggttctgtcatgcttaacattattagtcacttagatgaacgcagagaaggaatgtttgtcacatctgcagtccatgcaaagccaagtgtcacagatgtcagaatcaatagacaaaatagtcaaaatagtcagaaagaagaaaaggaaccaacatgaaacttatcagggatcaatggaaagtccctgtttattttcagaaaatcaattacacaactatagaattagaataacaacagtaatgatattaatagctactattttgaaagtcctataatcactatgtgccagttgcttcacagaaaaatttatttaaaccttacaatagccctacaacattggtactgttattattatctttatcttacaggtgaggaaaccaaggagattaggcaatcttgcctaaaatcacacaaatcttgatttttctaatggaaaaatgccatactctttaatcaataagataactggggagacccgatttgaccacacttgtgtcaaagaccttttctagttgtaaaaatgagcaggtatgtgtttgtttatgctacaaagaaaaatacacaagcacagatgatgaatcaattgggaggttattaaaaactaaacatttcattttcaagttagttttactaatttgaaaagggatatttgcaaagtgattcaggattgtaaattttgaaatgttcccctagaaaggtgaaatttttatgatcataggaatgtttactgtggaacgattgaaacccagctctagccaggtttctgatcataactttaccttatacaattaagggaaaatcatggctaggaatcaactaaaagaccctaagtgtctatggactcctactgacagagaagcctactttagcaggcctcggtgggagcaaagacatgagaatctgtgctcacacctctctgtggtcacaagcaacttagccatctcacctatctctattcttatacagcagaaactctcaaggtgatgacccatccccactgggttcatccagaacattccctttcttcttcattttgagaattccttgtctccttccaatcctgcatgccctcctttccttggatgactctgcttcccctctcctcctagtaattccttctgctccactctcttttcagtcctgggaatatactccctggatcaaggtcattcctttcagtcctttggatggacactcactgtccttctatttttgtggctaagaatttgagcaaattctcacctaagcctaagagtataaacataactgtccacttttatggtcatctggtgccaaataattacatggttaatcaaccttcagaattgatgtcaaccagtcaggacagaggacacaaatcacaggaggcaagtatttcatctattgactcctcaccatcctatctatctaattatggaaaagagttaagatggtgcttcgagcccattgagtttacaatttcatttctttgaaaagttccacgtcaacagtacattttaccacaacaggatgattctataaagacaactgagtaatcaagtggaaaaaaagttacttttatgtaagcagatgagtgtagtgtatgattatccatggtataattttggttttctatcccataatctatggttgtatattgcccatcaactactctgtgatcaagctggactttgtcccaaagggaggaatcataaaatgatttaagttctagcacctttacttaaattcccacctggattccctgaaagagaatgcatttctgtatagttctacattatggaatatgtctgaaaacaaaaaaaaaaaaacatttggaatcctcctgttcattcagaggaaggtgcctagttagtttctttgccatgtctttctgccctctctttccctcttccttctcactgccatgtcccaagtccaggcctacaaccctggatgcttgggttacttaagcgctcctccctcccaccagatccctgcctccagtgtccctcccactccaacgcatcctaccaggctcctttaagcctactgtcatgacattgctaacagctaacagcataacctgttctccaactccctatggtcagggcactcaccatcctttgcaacctggacccaccttatttgtccaatcataccaggaccttcaggtcccacattccctactctttagtttctgctggacagaaaactctcctcactatcccacaaatggaccgtacttgtgttaagctttgagtgacagcctctgtatttcctccctcccagcacataacatgtttcctccaattctccagtattttataattttacccacctctcaaagcctacctcttaaaagtatcttctctatgaaacctcctcctgctactctaagtctcttcttacattccttctgtcgcttacagcttccattgtatcacccccgcccctcatgagggtgtagctatttgagaccaagggcaagaatgaggtgccttcttgtcccgtcagtgctgatcacacagcagcactcaacagcatgttcttgaaatggttgaacacagctgatgttgcctactgatcccagatcattgatgcatttcacattaccttttaccaagcacctcctaggcataagacctgtattctactgtgaagggttgtccctctgccaatccagactttctcttaaatattgtctcaaaagcttcaattctctggctcattgttatctgtgattacttgtctgctacatgtgtcacatcaccccctgaacatttggctaagttctaatatgtagtcagaatagaaaacactccctgaacagaggggaacatcacacaccggggcctgtcaaggtgggggactaggggagggagagaattaggagaaatacctaatgtagatgacaggtcgatgggtgcagcaaaccaccatgggatgtgtatacctatgtaacaaacctgcaccttctgcacatgtaccccagaacttaaaagtataataaaaaaaaaaaactgttaaaaaatgtgaaaaaaaaactgcactcccagaactttaaaagttccagtctctgaaagccatgatgccattacaatgagacaaaaagaagaccttcaaaagcaaaatttggggaagttgtcttttccatagctccttgactcacgcccatggggccgcttctggtttattctttttgagaggcttgttatggatattgttacattgacatgagggcattggaaagacagatctaatccccccaaacacacttgtcatatacacccacaaaataaatgagacaataaaacaatgaataacaaatgattacagctatccttaaaattaaatagtaacctgcaataaaatgggtgaggactcagtttagagaaacccttccttagaaaagttggttgcattcagattctaaaagttgaccttcagtagaatctaagcccttggcatttgttttattatctttccagagctttacactttattgtaagaggcagctaaagcaagtctctcttgttcctacacatttctttaagaactcagttcacttccctatagcaagtgccacccaatgctttccctaaaagctcagtccacttccctatagtaagtgccacccactggaaactagcaaagcattccaggatttcagtatttctgagatgccataagagcactggggggaaaaaaaggagatgaagaagggtattgggtggggaaaatcttacctcaacttctgactggcggggacggttattttattaagcttgtccattctgtttggtaattgtaagagacacgaataactgtccagtggtcacgtcagcagttcctggccctcctagggagcagcatggtaagcctctggtctcaagggttccggccactcaagtctgatttctgagagtgcaggctgctggcaaacacccctgctctagggagaagtaaaactt

SEQ ID NO: 1546 - DNA, 79819 bp, Homo sapiens
ttatttttaaaaataaaaatatttatttggaaaatattagtagcatgataactcaacctcaccagatattaacagttcatcaggtcaggcaatagaacaagtccacatgagcttcttaaaaagaaatggatgaccacttcaatagctgactccatcttccattttattactggatgattcataatccaaaatatgaagttttgggactttttctcaaaaggagaaactttgggaaagtgtctgaagcaatggtattgatcttttttttccccctttatgaaactttaactgcatacttcagtctggtggaatcttttgtgttattctgactgtcaataagaaccaaaggactatgttgatgattcctgatgatttcagcaacacttccaaagtactagaggaagaaaacatagatgaattatactttggcatttgtgttaaatttgagctccactcctcccatcttctctcattctcaagttagtaaaagttattacaccccagctgacattctgcacaaaaaaatctagtttaacaaaggctgtaaccttcaaggtggcagaccttggactttgctgtattaagtacgaagaaaaacacactgacagcctcaattagcatagctacttagagagattacttcactgagttatgataaaatattatagtatattgctttttatttaccgttaaatgtaaaactatcatacaacgcatttttctacattctttacaaaacatagatcatctcttactttgcacaagtctcagatacaagaattgatgtaataaattaaccttagaaatttagtacaaggaaatagtcatctcctaaacaaaattatgttttgttttcttttttaaacaaataaagaaagctttataaaccttcatatttccatttttacttggttcctggtaagcttagagttaacttagtgcctaattaataatgaaatttcatgctaggctctctccatacatacttatttttccaaattttgatccttgttgtctatgggttttaatttaaaattatcacaaattttgttctgaaaaataattaaagttttgaaggaaagataaaaacaaatgtaacacagatcatgaaattaaattcattgagtatacaaaagtgctacaagttcacactcattaaatgtatttagaatcactttttaaaagtggtgattgttttacaacagtgccatgagtttagcagttactatcaattgattttattttctcgattttttagataaagacaaacatccacagtaaaatttttaagtgtttattaattgtttggatgacttccaagtagctacatattgaataaagtaaaatattcagaatattggccaacatttccaaatgaaataccagttgtcttttagataattggctagctgaatattcagtcagggagagaggtaagagacagggactttcaaatacctttagtctttattctttacttcctattcaatcattcagccatcttgcaattgccaaagaaattctttcattataaatcccattaaacattcattctgcttgtttggcataatatgttgctaaaccaaatgcagttgaaagttaaagttatggactcaagggccagaaaacgaaatagcacaatctctttgaagtggattacaagggaaaaagtgtgtcctgaacctaggaagcataggagaggattgctgtacttatacaaacaaatatctcattccgtccctctagtccctgaatatttgtgagtattgccttgttgtggtgttcggggattgaagtgtgtgcagtagggagttgagctgagttgaaacatttgaagtagggaatgaagttgaagaatatttgtgatttaatttaaaaaagaattgggcataacatagttacagcttcccctcactctcctttttttctgtttttattaattcagtgtatttgagacagatacattcagtgtatttgtggacagaaaaacaacgtattggccactaagataaagcagacagttgtcaaaactgtaaaattactcaatgttgtatcacacagtgccaaaatagctgcataaacagttaaatagttaatgaattggttactttttctagccatgtacacacaaatacacacagactttcagaaaaactccacatgattgacatcatgtaaccaacactttaattttccattcagatgttcagtgtataggggacataatctttttattatagatactttaagtaagagttttaattgactgtcagtacctccagatgctattatagtaatatattacttattttggaatccataggctgaatatgttggaagtgaggtgaagctctagtctattcattctaaagtggagatgaagattcatcaggccaagaggaattcctgtttaccagagtttcctagcaggacaacgaaatccagagcccctcagggagttcaaaatttgtgagagaatttcaggacctcgaaataggacagcttcttcacccacccttaagcctcttatagaaaagctagactgctggagaagctttaggatgttaaatgataatgcggtctacattttaaaaccaaagattggtcttgattagtgcccttagattcaagagttttgcattttaaaattatctgagactttgttaaaagcaaaataaaattccccaatataaaaattctagaagaaaatgtaggggggaaacaccatgacactggatttggcaatgattttttggatatgacattaaaagcataggcaaaaaaagcaaaaatagagaagacaatatcaagcttaaaagcttttgctcagcaaataacacaatcaacagagtggaaaggtaacctatggagtgggaaaaatatttgcaaatcatttatctgataaggggttaatatccagaaacataaagaactcctaaaactcagcaacaacaaaaatcaaataacctgattataaaatggaatagacatttctctgaaaatgacttacaagtagccaaaaaagcatatgaaaaatgttcaacatcactaatcatcagagaaatgcaaattttttttttttttttttttgagacggagtctcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagagaaatgcaaattaaaaccacaatgagctgtctatcaccttacacccatttggacggctactataaaacaacaacacaattcagaatataacaagtgctggtggggatgtgaagaagttaaaccctcgtgtgctgttggtggaactgtaaaatggtgcaactgctatggaaaaaagtatgggaggttctcaaaaaattaaaaatagaatacccatatcatccagcaatcccacttctgggtatatacccccaaataattgaaagcagtgtcctggagagatttgcacacccgtgtttatagcagcactattcacaatagccaagaggtagaagcaacacaaatgtccactgatggatgttagacacacaaaatgtggtatatagatacaatgagatactatgcagccttaaaaaggaaggaaatcctaacacatgctacaacatggatgagtctcaaggacatcatgctaagttaaataagctggtcctaaaggacaaatactgtgtgattccacttgtatgaggtatctaaaatattcaaattcataaaaatagaacgtggttgctaggggctgaagggagggggaaaagggaaactgttgttcagtgggtatagggttttagttctataagatgaacaagttctggagatctgtttcacaacaatgtaaatatacttattactgagctgtacacttaaaatgattaagatggtaaattttatatgtggttttttaaccacagttgtctaaaaggcaaaataaagaatacacatgactttttcagtttgttttgcaaatgctattctcctgcctgtaatcactcaaccaaatcaattcagttgcttaataattatttatcaagtgtacactgaagccagttactgtgctctgattctggaaatacagagatgaaaagacattgtccttggcttcatgtagtggggaagacagacacttcagcaatcatgacattttccaacaattcaaatattttctagcaggtgctgggtttggaatggtgtacctttttctgaaggaatcttgaaagtaaatatttcttaccttgaattttgtttatgctattttctctgcatagattgttcttcccatttttctccttctccatccctccaacttacattctacccatttaaattcaacccgtaattcaaaaccagaataagtatcactgcatttctagaccattcatgggttactccagctcatatttcagggttcatttataggagcaggctggctaaactgagatatggtaagcactgagtttggtccagattaaagaggcattaaagttaatgtttgattaatatttaagacccatgtgatttttttttcttgctccaggcccataagctcattctggtacaagggctatagtctaatgttttaactcaagtttctgcatctcttctggatccttccctggtaacctaccttggtacttgagttgagattttaggtcttgactttggaggtctggaacttgaccctaattcttacaaccttaattcaacttgacatttcaaccttgatttatatttgcccctggactaaaatcttgggtcagactgacctcattaaataactgaatgaaaggactagcatgtacatcacatgactttttccttttctgtgttcttataggatatactgcctaaatatagtattttatcttgttctctatgacatttatgcaagcattagaacaagtacttttgtatcctttctcctcatctctagcatctaatacagtatttgatgtcattatactcaatgcatagttatagaattgaatttaaaaagaaatcactgacctcttcaccatttttctttctgcccaaggcatattgttttgttgcttcaataaatcgcacaggaatattatatactcgcttattaaagaatacaactagtgtatatggttgtttggaatcatggccagagcttttccgaataagaaatgatccatcctgtttaattttttttaaaaaacataattatggttagtattacttatatttctacaggttcaaaaaatcattttgtgaagaacacctatattacattccaaaggtaaattatttagctacattatttttattattgattagcgcttgtcttcttattttctaagaaaatagtccaggaaaatatatactcatagaaaatcctgagtgagatcaatgcttgccttttttgaaaaaaaggtaataattaattaattatttttagaaacagtctcactttgttgcccaggctggtgtgcagtggtgcaatcacagtccactacagcctggaactcctgagttcaagcgatcctcccacctcagcctcctgagtacctgggactactggcatgcaccaccatgcccagctaaatgctagctttttaatgtgctaaataaggttttatgtttataaaatttagaaatatgtgaagggacacattaagatcaaatctagaggactctcttgaactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatagtggcgggcacctgtagtcccagctactcgggaggctgaggcagaagaatggcgtgaacccaggagacggagtttgcagtgagccaagatcgtgccactgcactccagcctgggtgacagagcgagacaacatcaaaaaaaaaaagaaagaaaaagaaaaagaaaaaaaaatccccaaactgtaagacagtaattcaaattttattaaattttttaataaaaatatttagaatcataaaataaaaaattacgaacaaaagatggacaaaaagcagaatgaaatgcaacaagagttgatcaaactcaggaaacaaactgaagaaaaagacaagcctatctcaacaaagaacaaattataagatgtccaagggacgagagcttcaaatgaagatttaagaaatgacacttgaaggaaggtgtggaaacaaccaggagagaaaatgggatttaataaaataagtaccatagaatcaaagacagtgatgggagaaaaaatgacaaaaaagatccaaaacgcatgtaaattgagtgcttgcagaagaaaaacaaataagggaacagaacaaccctttaagactatgatctaagaaaacttattggatataagagaaaacttaaatctacgtattgaaagggcttctgtctacttgagaaaattgatttggaattatcaactcagagatatattctggtaaaatgattagactttaaaaacaaaaagtctgcagagccaccagactaaagtatcaaattacatagaagggcaagaaagtcacattggtatcagacttctcaagagcttcatacagaacaacacaatctagtggagcaacacttttcaaactcaaattaaggattttatagccagccaagatttcttccaactactaggatatgaaaaaacagttttttaactctctttctctttttattcccccacagcagtctcactcttgttgcccaggctggagagcagtggcatgatctcggctcactgcaacttccgcctcctaggcccaaccgattctcctgcttcagcctccggaggagctgggattataggcgcccgccatcacgcctggctaatttttttattttcagtagagatgaggttttgccatcttggccaggctggtctcaaactcctgacctcaagtgatccactcacctcggccccccaaagtgctaggattacaggcataagccactgcgcctggctgagaaaatagttttgaatataaaggaactcagggaataatgtaaacacgatttttcctcagaatctactacaggtacacttcatcaaaggaaagagacaatggtggaagtccaccaaaggactgacggaacacactaatatatttacttgtagagctaggactaaaacaagggtgaggaagaacagtatgtaaatgctatatattctgacaaagtggagtgcaagaaaacaaagaaaaagaaaatgggaggagaagagagaaagaaaaagtgtcactttaatcttgaattgtccaagctgtccctggtgttcctacatgattgaagttgggctctccaaacatttacttccaggtattttttgtttgtttgtttgtttgccatcttgactcaaatttttaatcctgcacattgatccaaaatagcctgtcactgttcactcctcagtggagctcatgcagcaccaagccttccatagacctcccctggagctttctcgtctcccactgtttggagggcagtggaggctgtgggtccttgaggagatgaaaggacaagtagaaatgagatggaggaacttgaaagagaggaggggatagcagtttctcttgagtaagtaaaggaaaaagatccttgtatctacacttgttgcaattatttaattagcatatcataaggacgacaactgtgtctattacaggctgagggcaaaacgtgtgatttaaaaatgatcagaccttggccgggcgcggtggctcacgtctgtaatcccagcactttgggaggccaaggccgccaggcagatcaactgaggtcaggagttcgagagcagcctggccaacatggtaaaaccccgtctctactaaaaatacaaaaattagccgggcttgggggcacacacatgtaatcccagctgcttgggaggctgaggcatgagaatcacttgaacttgggaggcaggcagaggttgcagtgagctgagatcgagccactgcactccagtgaaactgcatcatctcaaaacaaataaataaaataaaataaaataaaaataataaataataaaaatgatcagaccttgtttgatctgtgcaatgcctcttcagcagactttcgatcacaggctccagcataccatggcttgcagagaacgccagcttcctgtgaaatggagggcactggtcagcatgggatggtccctacttaactctaatttctgtgtactagaaacaaagacccatttgcattatcaagacaggcctctacatttacaccaataattttaagatgagttttatttttcctttgatcaaacacaaggattataccgttaacttgttttttgtatttttttttcatttggccttagctaggttcctgaattatttctttctttctcctaaataagtaataatccccctttccattgtgctcttattgctcttactttgtggagtgctttacaatttccaaagcatttttacaaatattattttatttgattcttgcaagaaaggatatatgccttctttgaaggcaagaaggacacatgctattatccgtattttacatttttacatatatttgtatggaaacttagaaagacttgcccaagggcacacagagtcctttctctgtccctttataaactgtgctgtcttatatgtgatttaatatcatcagcctctacagatctatttggaggaaattacaaagtttaaataaaatctatgtgagaggaagaataatgaaaacacatttccttgctagttttgaggaaacattaactggagcaatgtcttagtcattgaaaaaaaacaacaactgggtattctgtccctattaccaaatgacagttcacataatgatgtaaaatacagtctctgttctcaaggttcactccaaatgtcttcttctcagaagacatgctctttcctgcagtttcctggtaacaatttagtgacatcaagagttcatttcatacctgttctgaaatagtggaattagatgaaaagctgggtaggggcccatccacagttgggtttcccccttctgtaaatcctgaaagggatcagaaaagtccttcaattaatcttcatatttcttgaactctttctatgcctatcccctaacactgtactaggtgctgccagggacacatccaccaaaaaaaatccttaaggcaatggttccaaaagtgtggtccaaggacccctggaaatctcgaaaatcctttcaggtggttcaagaggtcttttctttttgaattacctatcactatgaaacccaattttcctcatgtagttccaccagaaaaacattgcaacagatgaaatgtagaaacagagatgagaatccagcagtctctgttatgttgcagtaacatacattaaagagatttacaaaatgtaaactaatgccactcttttccctaaattgtttttgtttggaaaatatagttatttttcataaaaatattatttatgttaacatgtaatgagtttaatattatttttaaatggattaataaatgttttaaatgtctcagttttaattcttaaaatactaggtatcaatagaaacatgtaaaccaaagctctttgggtctacaattattttaagagtgttaaagtggttctgagaccaaaatgtctgagaattgctgacttcaggcatcaactccctcaaagagtttacagtctaaatgtggaaacatgtgaaatacgaaaaagacttatctgcattcattcattcattcattcattcattcattcttgtttctctgccatggatcaaaggcattggggatatacagcagttaacaaaacagcaaaatgccctgctctcctggaacttaaattttaatggattgagatgggcaataaagacataagtaaaaaatatatatataatgttagagggtcataaatgctatgaagaaaaataaatcaggaaaggaagaatatgtgggtgagatctgcaggtggagagggaggaggcactggacatcccaggaaagaatgtcccgggtagagggagctgtgaaggcaaggcctggcatatctaaggaatagcaagggtgccactgtgcctggagtacagtaagaaaaggggagaagagtaagagatacagtcagacaggaggcaatgaagggaccagatttataggacttggtggacccttaacatgactcaagagctgtaatgaacatgataagggaagcttttggagggttttgaacaggggggtaacatgatctgcctatgttttaacagggtcattccagctgctgggctggaaacagagggtggcaacagcagagtgggggaggccagttcggtgttcttgcaggagatgacagtgacttggacagatcacagcagtggaagcagtgagagtggttggattctggatctattttgaaggaatagctggaaggtgtgtgaagaaagcaagtgagaagtcaagggtgactctaaggtttttgacaacagcaaccagagttgtcctttattaagatggggaaatctgcaggagaaagaattctggataaactaagtgcttcagataatagtgccctggatgtttagagaaggcagccaccattgtaagaggagggggcagtgagggcttggcaggcccaacaaagatgggccaaaaggaaggatgtattctaataggaggggaacagcactcccaggtgagagcagcaaaggtgagtgagtgaacagactttccctaggtgcacagtgcagggcagtttgtggtttctgcagttctggcagttggaagagtacccatggctaatattttctgacacccgaatgtgctaggcctattctgttttcaacatgcgtgcatctcgtcctttcaccagctctttgtggaatgagctattatgcccattttatagaacaggccttctcagaccatcctgtctacagcagcagccctccctgcctccgttactctctgccacccacccctgctgctgcgctgtatttttctttatagcacttcagcatttacctgatatgatattatttgtgcgtttatttttactctctgtctccttcagtagaatataagtttcatgaggacagggtctttatttgtttcgttcatccttgtatctcctgtgcctagaacaatgcctggcacacggcatatggtcactaacaactgaatgaatgacttggtttgaaaaacggtaaaaggtataataaacctttttaaataatgaaaaataaatttctgtagccaaatcattttcactttgtgttgtcagaattttttttaaaaactagtaaaagtttcatttatttaagatgaatattattaaaaatttaaaaagccaatttatgtttagtaaaaaaaatgcataaaaattttgcatgtggacaattactgtttatttaaatggatttaagctttattattttggaatatatcccaaattatctatgtaaagcagagtttttttcttcctttttttcccacattgagttgcaggcaaattaaggtttgggcagttacgttctgtgagcctgacttatccgattcatatatttttagggtgatgtttgccttggaaaaattatccagatatttgccgtatcttctttttaaggtaccttttgtagacatattttgtgatctttaaaatatattttgacttaatttaaatcggtattatttgtttagaaccaaacactatagctggtgcttcccatatgttgttttacttgatcttattattttgaaaacagctgtattgtttttgtaaaaaaaaaaaaagttaaaaaaggatgcatgatcagtaaaatattaaatcgctactaaaaaaagtaaaaattgcctcaaatatatttacttttcaaaacaactctgtgaaataaacattcttggccccattttacaggtaaggaaacaagtgggagaagatgccaggataacgcagctggaagcgacagtgctgtgttagaacccaggcctatcagactctaggatccagcctcgaccactccctgatacactacatggcttcgttgtacttacttggcagaggtatgggtttttggtggatttgtctgcaagaaagaatttcagataattaaaggacaaagcacaatatgagtaagtttgactttttgtttacactgatgatgctgtgaacaggcacatcacaaataaatcaatacaaatggccaataaaatgtatctaaagataaaagagccaccaaaaccttaaagataagtaagactcttccttttagttttgaaaaaggaggaaatcttgactaaagtattgtattttagtcaagttcaataattaacccaattagtaggtctctgcaactctacacagttattttaaagttgctcaacaccttttaacacgtaactgcaaaacaatgaaatgttggatttttacctagcactgcaagtcagtgtcactgtgcagtgaaacaatgcacatgttaattcctgcagcaacaagaggaaactgatctttaaaggaaaggattcttacttctgggcaggaggaaacactggtgactgcacagcttcttgtctgtgacttgaccctcggtggcgttcagcaggtataggtttttctggatcaggaaaattatcatattaggattagagtgaaatgtctgtcctcatcccaaaacccagcaacatcagctgagaagaaccaaatttgatcagaagtcttcccgggaacatgtcttagttactgagatgtcatggatctgtgcacttgccagtctgttgatgtggttgtgctatgaggaccaggactccctcccagcagtgttacaggtacatcctaccacctctgcattcatccactggcaatgtacatagagactgaacccacgggccctgaaactttaagtgtgtgagtataggtggaagccagaagatgagaacattttagccaccctctaaacaactcaccctctacttgccatgtggcctccacacaggtggagacaacaccctggtgggtcttgattagtcataagacgtggtataagcagtgtgttactgataagaggcacactactgagttcataaatgatctctttttgcaaaattaattggatcaaattcaaggttatccctataataatgtaaatctcacttgcatttcagtgttttcctgagcagaagaggaaagggtgggaaatgagcataaacctgaagtgtaagaaatttatgttgaagcccatagtgaactctactgctgaaccattaataaatgtgatcacacattattttaatactttactctccctcaaatttgtcgttggggggtggggtgtgttaaaatcttggtatgttcatgtgtgagtctgcatggaagaaaggctgagaactacagaaaccccaaagaaataaaagtagtaagaactcaaagattcaaataaatggtaagatagacgtcagggtttcttaccattcagtggtgcactaaagcttggaaaccttgaacctctgaagattgtattttgaatttgtggcaagctacttcaaacctctatgttagatgttttgctcatgacattaaaacttggtaatttcagaaggagaaacaatgaacaccttaggtcttgccagcctataagctttgactacacctgctctgcctccgccatcctgattccttcctaggctagtagaggccactcactcactttgcatttggatggtaattgcctatgctcttgaaataaataacaaaggagggggcatgcctggcaggctcctgtactgggaaccctttgagaatgaggacacctaagcagcagtggacatgccttgggccctgcttctttcctggattttggaggctcttgtagccatgaagtctgcacaggttgtacttacttcctacagatgctcagagctcctgaagtcactatcactccacaacctggactcagcaggtctgagaggctgcaaggaatggaagtacagaaaagacaaaagcctcaaagggaaggcagaagaaagcaatacagcagaaaaggggtgatgcctcagaaatagcctagggaagcaagatatgggagacaggatgaaaaaacctaatggcgtcattaaagcagagaggtgagttgtagtgcatgctcagaaaagatccactgtccatcatcagagaaaggagagtgctttatgtagatatacgcacatcaactcagggaagagggagaatactcactacatttttaaccctgggtatcttcaagtatggaattaaatgggtacagggcatgaacttctatataatgttttaagtgctgatattatagatgattcttctatttttttccggtaatttccaaacacaattttttttaacatgagcagtttctaaaaatatatataagatttttgagtgatgataaaggaagaaattctaaattactcaggaggctgaggcagaaagacaacttgagcccaggaatttgaagctgcagtgagctataattatgcaccactgcactccagtctgggctacaaagtgagaccctaactcaaaaaaaaaaaaaaaaaggaagaaaagcaattgaagatgtactaagaagacagacaattgaactttgaaaacattatcttgaaaacttagcaaaagaacttgttcaaataaacagatttttaaagttttcattactttaagtaagctattagttctaaaacatgtgaatggctctacgttagttttcacatttatgtaaggtcctagcactattgcctggcaagtcatatctgtctgccaaaaggcaggtttttgcatgcattctgtagcctactctaaacatgctgaggttctgagctagttttgctgttcattgctcattgcaaaaactattttgtttagaaaattgagtttcatgtttacaattgccccaaaaataatgtaataaatgtgtacatacaaatccttaataaaataacttttagaggacatgctcatccttcaaaataatagattttaccttcacaaacacttgaagcattctgttgagaggcaactggagtctatgtaaaagaaaaaaaggcaaggttattcaatatagcagaatgtggaaataaatgtcagagcaatattattaaaataaatattttggcagcacttttctttgatgcattgctattctttcaatcacaacaacaattacaaacccacagtccctagcccaacctttgcattaagcaacaaacagccagaagtgtcctatgaaggagcaatgtcactgtggtggagaaacctccctgccttgtcaacagggttgatggaaatcatgacccccccagcagctgccacatagtaacccatgtacagcaggcatctggcatctgctttggtctcatgaccccccccttctgtgtgtttgctaaatgattgtaaatgtcaggcttcacagtagggactaggtccaggtgggctcccttatgtagtgttgtggcccaggttcaccatgttctggccagaatctgagtttagtgaggcctatgtgtgcctgatacacaatggtctaccattagctgtggtggggagtggacacagacgcttcctgtggagagggcagggaacctggctgcccctctgatctgctgcgcacactcagtgaagctgctgggatcaagtgaggatgagctccttctatgctccagggaggagcatcctccctggctacctgaggatttgaagcttctcttggactgcttgggcagcaacttcagttgctaagattgctgtgttcaccatagctggaagcattttcaactttaaataaatggataagaataaacactgcaggaaatatgaagcacttttaaatgcaaaattaacttactgtcttcagtggtgtcgttggttttttcctggggaataaaaagagatgagctttgttaaaacacaacgaagacaaaatggagctatttaccattattttagtctcaaatttaagctagaattatgaaagcgatacaagtgtgtagaagactatccttgcagggtggagagggatggaagtgggatttagttatgatcctcctaggctcagatggagtctgctgacagatggggaaggggtcaactggggataaagtagggcaccagtccggcagaactggactcttgcaccagttgcactaattacttggcgggtgaccttgggcctctttgtcttgagtgtgaggttagattcctcacctgtcaattgaggaccaggatcagtattttcagtgtttctgtggagccccctcttccccaacagctccctgtgggggttactgtccaggacagagggtagaggtaagagggtggtccagcaggtgaggttgcagctgcacttgcccactccagcttcctccctgtctctagggactattctccactgtcttctgtgcaggctttctttcagagagatccgaaaccaaaacaagtttgaaaaccactgatgtgtggtcctgaaggtacttgcctgcactaacattctagtttgcaaaatgattcaggtgctggagcttctgaaagtcggggtgtcttgtggaacactgtaagtcaatgaactcaagattccaatagagactggagtctaatattggtaaggttgtatgctccttttctgtgtgttaaatttcttaatttaaaaaccctcaccatatctctctctcgctttgttttcggctgagagctgaagtgtgggggaagaacactaagaattcctgagcacctgtaagatgcctggcactgggttaggctcctcaggtgctatttaaaccttacagtgacattttaaggtgaggaaactgaggctcagagagacgaagtagtttgcccaaagtgatacagctgaactaagagagacgtatgcagagttttggttaataaaccttcaacatggaggctttctttggtttacacagagacagaaataagattagagccattcaggccagctttagacatatttaaatttgctttccaaataacctgttgagccaacataattttacggggtgacgtttgtaatattaacacattacaatcgtcacctgactgtttacaaagcccttctaaattcaataagaaagaatgactgtcactttcgagaggaacttcagtcgtatggctttgagggagtgccctggtatgaccagcacatagtatatatctacacacttatttacagaccataaaactgagcagcagtaagtaaagacaaaacctgctagaggctctgaaaatgattcaggtgctggagcttctgaaagtcagggtgtcttgtggaacactgtaagttagtgaactcaagacttaactaaaacttcacaggaggaaatacttctagatttatttatttatttatttatttattcatttatttatttatttgagatggagtcttgctctgttgcccaggctggagtgcagtgctgtgatctcagctcactgcaacctgcagaggttcaagtgatcctcctgcctcagcctcccaagtagctgggattacaggtgtgtgccaccacgcctggctaatttttgtatttttagtagagacggggtttcgccatgttggccaggctggtcttgaactcctggcttcaagtgagctgcccgccttggcctcccaaagtgctgggatgacaggcctgagccaccatgcctggctcatttgatgttagcagggctccttactcttggtccaagttgcagcctgccatggggagaacttctaatgaagtcaacagggcagtggggtatcaccatcctcactccccagatctcaaaagctgcttcctgcaacaggtacttacccggcccgtggcaacggggatggtgcagctggtggaggtgacttggtttcccaggccccactgtttcgacctgcacaaacatatacactactcagtccccaagtcctgagccgggggctgatgctcacactgaggctggcctctctggcaggctcagaaatatttgcacatactgtgttgctttcagttaagcacatataggtagttatattgaagctattaaggaaaacttgtgggcaaaggtgatgacacattttaaaagtgtcagtgtataagctcagagctgggatgggggttagggactccaccttaacatttctaaaggaccttctccttacccgccccctgccccatggggcaagtcctgagcccactgattctgaggactcagtgaggacccccacagaggtccttcaggaagggagccaacagctcacacctacatctgtgcacactgcacaaatgtgcacggcagaggtgcccagagacagaggctccaacccaccactcctgacacagacctcagacagtgctcctttataagcacacttaaatacggtaaatgcctctaacttcacattcagaggatatttactcactcatctctgagttttcaagggctttcgccgacaggttttccttaatggacaaattgagacaagtgcaggctgctgcccaaatctcatcttctcaagtcatagaagggacccgaagggtcttgtcccctgcacccaacctcccttcctgtacctgaagatagatgccagacaatcgttatgagggaggaagtgaaagagaagcaggatggatcttcactgtgggacagagggcaggccaggaggggagaggccagagctgagccagccccctcagcatcccctagctgcctcagacatgatgctcacctgcttggacaccattgctcagtgagaccaaggggtctcttcatgaggctcttcattaacttaactgaactgaataaatgttttcttaagaacttactacacatacaagtccacaattccgtttttttttttttttttttttttgagacagggtcttgttctgtcacccaggctggagtgcagtggggagatcacagcttactggaggcttcaaactcctggactcaagtgatcctccccactaagtagctcctgagtagctgggactacaggcatgcaccaccacacctggctaattttttgtccagatgagattttgccatgttgcccaggctggccttgaactcctggactcaatccatccacctgccttggtctcccaaagtgctgggattacaggaatgagccacggtgcctggcctataattcctaatggatttatagggcatactctgtaagtacaggctggacctgctgccctcagtctgtactttcttagtttatgagatagagcacagataagcacacattgaaataataatccattaccaaggattattgaggacttggtacatgtaaagcacatgaaggcactgtgttaggggccgaggaagaggtgaagaagcagacataggcctctgccctctcagaatttataacagggaagatacatgcaccctccatatcatctcatccaaacacagacaagaaaaagaaaaggcctcaaaaagtattgaaatagagttcaggaagttccttcccatgtatgtcactggagagaggctcccaggcttctactcagagcccactgactcttttcctaaaccctcaaggatgggagcaacagcaaagagtgggtggtgtggattgtacctggaagccttccccagcaccctgggaagcaatgccccctccatgacagctgtcttccacggtacctgaactgggtctgattttttgaaacattttggaaaagagattgcgtttggaatgtttacatttcatgtgacaacatgaaaacaataaactgaaatgtcacctgaatgtgtagtaggagtctccctgtgtttaagtaactggtgtatcaaattgaatacttaagactgacactgttaaagtacccttgactgcaatagaatttgatggaagatctcagggaagtggaacaaaatcttgtatgaaaaataaggaagtagaaagaaggtctaagtctgaatttcatcccaggggttttccctcttctgaaatgttaagggctcctttggccactatattatctttgtcagaccttcctcctggcttttctactatgcttccttttcttgcatatctcagaatagtctgccaaaaccttccttttcctttccttccctataaataacttctgacaatcagaggacagcatgattgtcatggtggaacactgtcacggaggacactggtggaaagcctatggtcttgcctcaggaagacagagttctagggaaggatggagcatgactcttcatgggtcactggcccatgaaacaatattgttccctgataatatctgccagaatggtcatggatcaaggcaggttgaacaagggattctgaataataacaataataataacaaagcactagcattttatgagtgcaagtcatctatattgagtcacttaattctcatggtatctactcatgatacccctaggcataggtgccattttttcagaggaagaaactaagaaacagagatgacttcacttgttcaaagtccggcacctagcaaatgtcagagccaggacctaaacctctggctttggagtcggctaaatccattctactggcttctcaagcacagcggggacggcaggggctgtcactgcaccagatttactatatcaccctcggcaggcaccttattggctatcaaaggaccaagagcaatattgaccagaggaaactgatgtggtgtggtgctttgacagaaacaccaactaggcacctgatggacacttttgtgatgcccactgggggactatctgaagcctttaaaggggaatggatggttattcaaagacacaggctagtagtctgatcatttcttttgtaaaaataatctctgaaggttccactgtttgcacactcggaaacccactcggactgtttaggcttgtcccttcaaaattatttcacttcttcccccttcctgtaggtactcccacctgtatgtgataatcacataaccaggacattattttcttgtttagatttgctttcttcatctgatgaccctagtattaaaatacagctataccaggttaatagcaaacttatgagtaataaatccagctggctaaagccctgttggtgattctttaaatatttaatacaaccagtgtttgaggactcattcaccctctcaaccaactgacccctccacagtctcggcacctcccctgagccagatcctggggtaggccctggaaacagctgtgagcaaataaagacagaaatctcagggcatgtgcagggcactagagggatctgtcccagcttggggccaggtaaagcctcctgagcaatgacattgaaggcaaggtctccaaggagcttgcaatgtacttaggaagcgattagactgagacacaaagtaattagggaataagtacgggctaagtgtaagggggaagagacttcctgcaaaggagagctctctgagggctacagaaaccagaggagtcttcctggaggtggaggcctcaagctgggccttgaaggatgagtaggattaggtgtcctaaaagtgagaacacaaagaccaagaagcaagacccgtgacatacaggctgattggagtactgggtgtgttttaggaagaggaggtgcttgtaaggcagtgtgttttaggaagaggaggtccttgtaaggcaagtagagctttgtaagaggtaaacaccagatattagtaatctatttctctaaaggagggttgaggtcttcatttatttatttgttaaaggttttctattccagtaacaacagccctcatcctgagttatcgggagttaggagtctccatttctgctggggcctaagcaacctggtcacgatgttttagattggcatgtttgacctttgtctctccagagggtaagatgagctggctaagatggctctgagctccactccccacttataaagcgcttgtgggttctgaggagaggttaagtaaaaccagaacttgtgaagaaagtgaataatttcacaagaaatgagtccaggaaaagatttttaaaatactcgactgttctttcattttctgtgaaggagcctgtctctggaagcagagctcagcctctcaatgacttgtgttcagctctgtgagagaagagagtgtgtgtgtatgaatgtgtgtgtgtgtgtgcacacgcgcatatgtgtgcctaggggagagggacaaggggagagagggagaggaaatgcctgtgagaatgctggagagcaggctcctacacctctctgtgctgttaatgggggtcatgggcacccctcagtgtcttgggctcagccttgggggttgccaaaacctataggagcaaccaggaacattcatggtttgggggtaggggtgacatggcaaagactagctttgtggtgagatgaaactggtaacatctggaggagttcagcggctcagtccttgtcgctgaggagagagccaagaggcaggggtatggctgctggacaagaaggtgcaaggtggctgagtaaagaaagcccagactagggtggtcacagctaaaatggaacagcaaattcaggagaaaaaaaagcaggatttggagcatgtggcctggaggctctacgcattgagaaacaggggtgcccgcaggggagggaggagtgagtttagagtcctgtgtgggagcatcaaggtgttcagaagggaagtcaggttggggttggatgccagggagttaccagtgtagacttgagacatgaatccagattaatcgatgaacgctacagaagtgaaaaatcattctctctcctcagcacttagtgtgtaccaggcactcattaagagtttcgcattcacatttgcagaattctcctgtcacagagtaggggctatgagcaccatttacagaaaagaaaatctgatgcttggagaggtgaagtacaagcccaaggtggcatagctggtaacggggcacactggggttccaaccgaggtctgtctggctcaaaaccaagcttgtaaccatcatgatgttctgaaagaactgtgggttgagggctgagggctaaattccgggaccccctcagtcaaggaaggggacacagagaagccagcaaggtgcccaggaaggtagggtgaaaaccagaacttgtctagcagatgccaaaaggcctggggaaatggccacttccacacacgtgccaccagacagtgcatgaggatgaggactggccttctgttcccaatattaagacatttggaaatacaagtgattactcttcatagttgatctgtttttcttatttgaaatagacgtaaaaccaaaccaaatcacacatacactttacctgaagctgttcctggaggagaggcgggcgttgaggaatttggcttggttgatctattcaccatgggagcttaaacacagaaatgtgtgtgtatatatatatatatatatacataaaaccattacagatacatgccattgaggaaaattcacactcagggaaaaatgatgaccagaccagagaatttgcaaagaatgggagacacccttattagacacacaaaccaataaaagaagtcttcttagaagaaacatctttagaatgggaatatcaatgacagattcataatttgatatattattatttgattatttgatgatagagatcttgttaaagtgaataatggctttgaatttcatttgccaagtgggaggtctaagagataaaggagttttattgtttttgtttttcatcaagagtgtattgaaccccttactggaggggcccaattaatagctccacctcccctaccagatgcaatacacaccattgctctgggatttcatgggtttttttctgttcttttttgtttttttaaagaggggttggtaaggagggaatgtgtatttgttcttttgtggtaatgggtggcttgggaattcaggtgggtcttgaagctgttggtgataggtacggagtacgggagagggttgctacatgatggcggactgaaacctgaatatggctaccatggagttgagagtagtagatgagtaatgttacctgaagaggtatcacttgtactggatcatattctccatagtgactatattcagagtaaacataccctgtttccatgcctaatcttatgtagcactggctttttaaggtaattcattggtcatagcatttgttgttctgtgaagggtttacggatgaaatgtttcataggcttatcatactactaaatttaaagaaccaggactcagggcatatttcactctttcattttttcactcctctgcagaaactgttcttggtgcaatgtttacaaggccaacatggtggcttgtgacattgtattaggttttatgagaaatccatttgaagcgagggcagctgaagagaactacccaggtgctttcataatgtgagatgggaagattaaagcatggaagaggaaggggaaggcagggaagggctatgatacacagagatgggttgtcactgatgctgtctgcccaaccagccaaagaagcacacactgtggcccaggggagaaagtcctgggcactgtcatttctgagcctcttagtgcttactaccaaatactcttatacatcctgatcaactgctaaaaattttcaggtgcttaaggcgacaaactcttacctttttcaggtggaggtgaactgctttctgtgggatgaatatagttttcatcattatcttccacggggaccacataatcagcctaacagaaatacaaaactgaatgagaagaatgctgtacattcatagttgactgtatgggagggagtgatttttttaaaaagcattattgagacgcaattcacatatcataaaattctactatgtaaattgtacaatttggtgacttttagtatattcacagacatatacaaccatcaccacaatctaattttaggacatttttatgcaaaaagaaaccttgcacccattagtcactccccatccaccgcttccttgacctagtcgaccacaaatctactttctttctctatagattttgcccattctggacattgaatatgcacggaatcacacaatctgtagtcttttgagacttctttcacttagtataatgttttcaaggttttcctgtggtatagtatgtatcacaactcccgtctttttatggccaaataatagtctattttatgagtatgccacatttgtttatccattcatcagctgatggacatttgagtttttttccactttttggctgtaatgaataatggtgtcatgactattcatgtacaagtttttgtgtagacatgcatttctcttgggaatatcctagaagtgaaattgttgagtcatatggtagctctaagtttaacagtcggagaaactgccaaactgttttccaaagaggctgcaccatttttcattcctgccagcaatgtatgagggctccagttttttcatatcctcaccaacacttgttatcatcctttttattacagccatccttgtgtgtgcaaaatgatatctcattatagttttgatttgcatttccctgaagactaatgatgttgagtatctttttatatacttattgtcaatttttgtatattctttggagacatgtctattcaaatctttgcccatttttaattgggttgtttatctttttattgagttataagagttatctatatattctagttataagttcttcatcagatatacaatttacaaaacttttcttccattctgtaggttacttttttactttcttattggtatcattggtggcacaaaacgtttaaattttgaagtctgttttatttattcttttattgcttgtacttttgatgtcatatccaagaaaccattgcctaacccaaagccataaagactcatatctgtgttttcctctaagagttttacagttttagctcttacagttaggtctatgctacattttcagttaatttttgtgtatggtgcgagattagaagtccagtttcattcttttgcctgtggatacatctagcaccatttacctagcactatttgttttaaaaaagtatttctctattgaatcgtcttagcacttttgtcaataattaaatgacgataaatgcagggagggagagattttatattgacaagacacaaatgaggtaaccagatctcaaaactggtttttaccacctgccctggtgggcagccaagaagggtactaggagaaacaaaaacaaaaatttattgccaggtgttcttctaagtactttacatgttttttttctcatttaatcctctaacaacacaataagagagatatcaccattggctccatttccagatgaagaaactgaggcacagaaaaattaagtagtttgctcaagttgtcaagtttaaaagtggtagacccagaagggcacagtggctcgtgcctgtaatcccagaactttgggaggctgaggcaggtggatagataagagtccaggagttcaaaaccagcctgggcaacatggtgaaaccctgtctctacaaaaaatatagaaaaattagccaaacatattggtatgcacctgtagtcccagctactccagaggctgaggtgggaaggttgcttgagcccaggaagctgaggctgcagtgagttgtgattgcgcttggcaacagaatgagaccttgtctccaaaaaaaaaaaaaaaaagtggtagatccaggatttgaactcaagcagttcaataatttagcacccatacttttatccaccacattctagtaccttccatcctccccctcctctttctgtcttatctatcctctctttatttaattgctatttcttatctctttcttcacctctgaagctggccgagaggcaccagagagttctactcacacatctcaatctgcagttatatttagagatgatctggctgagggagatgaggctttggaatcatacagacctgggaggaaatctgtgcttgggtcttttctagatgtatgacctgtgggggagttaattgctgaatcatcggaagttctcctggattctgccattcagaggtgggcacttgctcctctgtggcacagggaacctggtcctcatctctgcttcgtctctggccccacagtgtcaaactatgaactcccgaagggcagggccttctccttctctgtgtttgtgtttccagtacctggccagtcgaatgcctcactgaattgaattgaaattgcctaacccaatagccaaggctgggatgggctgacttagcagctttgaataatgggatgttgagtggctgcggatccctgcaggacctttttggttctatgggttcaccttttcggattcattagtagccagagtgacatgctttataagaacccaacttctcttctaggcgttagttcctataaaaggagaggctgagcccccaggaggcatgccaccctcttaaaccctgtagtcaacaaaatccttcaatatcttatgtctgaacacagaatattggtattgacacttggcaatgatgcctgaatggatatagggaagttggaagctccaggccctaacccagtcctacttgaccacttcaaaatgtattctttcctctgtattcttaattttgtacttgttttgttctgcagtgcttgattacagaaaatgtttttatctgcagtgtttagaatctgagctgtttagagtcatgatgatataggagttaagaaaaaattacttaggcagatagtgagggtaagatgtccttggtaaggttttccttttaataaaaagcagccccaaaatcattttcttttctaacaaagagtagcctgtaaaatcaagctgctgatatagacaagcaagctggaagcttgcatgggtgaatgctggcagttgtgccaataggaaaacgctacctgtgactaggcatgatcaaaatggtggctctgtcttcccctctctttgccagccacctgtacagtaaggagcagacaagatggcactggccaagtagaaaacccatttgtataataagattagggtggggcgaccagcctcttctgcaccatgtaaatgtcactcctgatcaaaccaatctgtggaccctgtataaatcagatatcacctcctgaagcctgcctctaaaatctgctgtggtccacctcaggcttggttttcccttcagattccactgtcttgcaagagagagagagatgctctcctctctcctttcttctgtctattaaactttctgctccttaacccacccacacgtgtccatgtcattaatcttgtcagtgcgagacgacgaaccccaggtatttaccccagacaacgatgccacttcaatgatatttctggaatggagacatttgtattcccaaagaagactgataggaaaaaagactcgatccagtctcaacaaattctgtttgtagtgtctgcccaactttctcatctttatagggttttaggagaaggaatgtaaaatgtatattcccagcattgcaattcaatgctttaacgttgttattgctgaaataagtaaatgaccaagaaccatcacattttatgtcctttattaggacataatgtggtcttattgaccactttgacattgctgcagtgttttaataccaacccccttctttcatgaacaaaacacaaaaacttgacttcagtgaatcagtgattggtcttttgaagccaggtagattattatactaccatgacctacaggtattagaaatccttcttcaattattacaatgacatgattcaaaattaaaaatagattaaaaatcatcttagatcaactccaatgtttagatgtttcagtattaataagacacttgtcataattgtttacatgtttgcctccccctaggactacagatttgaaaaataggagtagcgtgaatttatcttattttcactttcccatcggctcataccctattacttagccggagtcattttgattagctattaaatgcccacatgggctgcatcctcattaccactcatataagcatttaaaagctttccatacattattttattgaattcttataaaaataccctctaaatatattccctctgtgaccttgggtaagtttcttagcccctttacacctttgtttcctcatctgtaaagtggggctgatgatagacttcatagggttagtgtgaggatttaatgagataatgcatacaaagtgctcagaacaccagtggatacacaacattctccaagtgttagcctctctcattatagcacagatgctccttcctcctaaatgtctttgccccacctccagctctctgtttagcctgtatctctgtattttgcctataacctgcagagcagggttaaacacttttatttatgcttgtacttgacttcttcttttcccaactaatggttcagccatatcttaatgttggcttctgtttgtttgtttatttgtttttacacctctttcttatattggctctctatctgcccattccagaacgcccccgccttcatacttctctttttcccactggtgcagacttgcctgagccacctccacaaggctgctattagcaaacctctgccctgactccctggggtccattctcagttatttacagaaatgaagagccttacataacccacagtattcatctgcattctatatctgaatttgtgtcttcatgtggaattgccaaatgctgaaataatttacagtgagatcctaacagctggtctccccatcctgtcccctcccctgctcagcttctctttgccaccctattcccacccttgaaaggacaacatcgcctctcagatgggtaggtaatagtaagaaggagtgtgtgcagggtgagggtgtgtacatgcactgtatgcattgtgggagctatgacaaatcaaaaaagagaccaggattcacagctgagagagagggggatgccctggggcccagttgctttgaggccatggctggcctggtgttgctagatcttcagttttcagaagaaactagaaaactggattttgtcaaggctctagaatatggtagaaaggaatccgacatatattaaacccctctgtgtgtgaggcactgtatttagtgctgtacatatgttcttttattaaattctcaaaataacagagatgaaaaacagactcatagaagttgtctagcttgccccaaatcatacacctagaagggccaaagcaggaatttgggcctagatgctgcatctatttttatttaaaagtccatcttttccatctcctgctgggctgcaaattttataaaggcggaatgaaggtcatttcacaacatgtgtgtaagccataagttttatcctctacaggcaagttatttcttagagaagctgcaggctggtctctgtccttatttaaaatgcagggacctctgggagccataacacattaggctttatcagttactacgacagcttggatgagtttacctattcattttcaaataggagctatttcatagggaaaacaacacaaagggctaggtgctgagacagggaagattgaggaggtaaacccagagttggatgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgcatctgagaagagggaagtggaggagcagagagaaaagaaggtggaggaaagaaagcaaggtggcgacagtgttacagtgggtataatagctagtcaggcatgagcagggcaggagagggctcccctgccccaggaatgtcaggagaccatcaggtgattgtcaggtggctgttaattgtctctctaaaataataattggttacagccagcgccagggaaaagcagtctcccaatagatagaaaaaacctgaaactggtgatgagcagtttccgataagatctcaggagttgggcaagtgggctcaagcatgcgcattaagaggcaaaatggcagcgtttaactggtacttgaccttctagaaacattcagctggtaaggcaagaatgcttcaagggatcgtgcgtacaactccggtaagcacactgcgcatgctcacctcccaaatgctagcagggcactgcacaagcggacagcccacacaaaggaagaatcaggggagaagggacaaaagaccccggaagtgtgctagtgtataaaaccccaactcaaaggtcaaacagcgcactggatctctcaagtcgtccgcttggccctcttctaagtgtacttgacttcttttcattcctgctctgaaacttgccttggtctctccttctgccttacgcccaggaggcaagaattgaggttgctgcagacccatatggatttgctgtcagtaacaacaggacagagaagcaaaggagaataaagagagaggaagaacatcttaggaaggaaagaagagattcacaggaaaccccagggaagaaggaggggataatatgaggggcacagactcagtattgatattttaccatacacctctagtaaactgacatatttacaataagccattttggagaaaaccaagtccctttggtataatagtggagagttagagggggcagtcaatagcaggttgtaaagaaggaggacagccagcgggcaggctgtcctggtcgcttgccccacccccctctgtgtcctgggaagcctttggcacagatttactttacctcatcctcaaggaggcctttgggtttgggtgggacttgaggtttctgcaaagcagtcagggccggcagggtggaggtgagccttgctttctctgaaggccagctgggcttactgggaagtgtcttgctgaagggtggggaatgcctctggcttgatcgattgtcttgaaaggaacaaacaaaaaacataacataaaagaggctctggatcatttcctgggtggaagccattgagatccagaaagtataaaaccacgggtgtctatgtagccacaaatgatccacggggcattccttgaaagagtaaagtgaaatgttaggcccaaaatttcaactgcttattgacttaaacgacaaaaactggaagaacgtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcacgtggatcaacttccatgctccttccctcagtgatttcgctccattcacagggaatctgtgggatccctttggtccaggactgtccttctcatcaggtatcagaaaaggagtcaggctctaaggccaactggatctgagttctgtcccttgctctgccactcactagctgtgctctttggggctggttattcaacctctctgggactcacattcttcattgttatttttaattttttaattttttatttttttgagacaaagtcttgctctgttgcccaggctggagtgcagtggcatgatctctggttactgcaacctccgcctcccaggttcaagtgattctcctgcctcagcctctgaagtagctgggattacaggcacccaccaccatgcctggctaatttttgtatttttagtagagatggggttttaccatgttggccaggctggttttgaactcctgaccccaagtgattcacccacctcagcctcctgaagtgttaggattacaggcatgagccaccacgcctggccaacattcttcatttttaaaatgaggatcgtaatatcgaccttagagatcttgaggggattaggaagattgcagtgaaggcagtaggtacagtgtgtctgcctaataagtagaacttatatcacctgtgccatgtgagagaggcgttaggcggcctcaagtctacccagtgattcagtgagctgagcatagattcagactgatgtgttttaggaaaatcttggcataggaataacctggcatgttcttcatactgggaacagcacaggtgctagcactggcctctggattgcatcactggcctcttgctgctgcttcctgtgacagccccacctcgcccggtgcagctgtccttgcctgttaggccctcgcctctatgctcctggtgcctgcccctgccctcagccctcactccttgttgaaggtatgtggttaacttcacctccgctgcctcctcagaagcctctttctggtggtgtggctgtactcaggcatgagggcatccttccttctgtgcctataactcttgtcagttttatttgcagctcctggagtttactcagatttctgagtaaacaaatatttaatgtaatatttaagcccatcagaagtagcaaaacacaggagacaggctttgaagagtgtgatttttttttttttttttgagacagagtttcactcttgttgcccaggctggagtgcagtggtgcgatcttggctcactgcaacctccgcctcccgggttcaagtgattctactgcctcagcctccctagtagctgggattactggcatgcaccaccatgcccggctaatttttttgtatttttaatagagacggggttctgccatgttggccaggctggtcttgaactcctgacgtcaggtgatccatccactgtggcctcccaaagtgctgggattacaggtgtgagccaccgcgcttggccaagagtgtgttcttgagtgagccacttaaccaccctgaattgcagtagccctttcctccccagggttgctgtgatgattgaaaaagatcattcaccaagtatggtgggtggtgcacagagccgagttgtgatgagctgggcttcggaagctgagagccctggcttgtatcccagctccatcacttagaggatcttggcccagtcagttcactcctctgacctctttcaggattatcgaggaggttaagtagacccccaggggaaagcactaaactgtaaattagaagatctctgggagtatgtgcatcttgagtgcagctgaatgctcagtgcttagcatagttctggtgcatggcaggtgctcaaaagatcaactgtggcaacccagtaagcccagctggccttcactttactttcattcagtgaagcaaggagcagtgcctggtacactgtaaggagggggttaatggcagtgagatattacatgtagagccggtccatacaaatgctggcatcgccatgaccatcacagacatacttgctctctgaacctttggggaacttagtcacctgccaagactggaacaaagatgggcattaaaatgcatacttggggccaggcgcagtggcttatgcctgtaatcccagcactttgggaggccgaggcggttgtatcacttgaggtcaggagtttgagaccagcctggccaacatgaggaaatcctgtctctactaaaaatacaaaagttagccaggcgtggtggtgggtgcctgtggacccagctactcgggaggctgaggcaggaggctggacccaggaggcagaggttgcagtgaagcgagttcatgccactgcactccagcctgggtgacagagtgagactctgtcgcaaaaaaacaaaacaaaacaaaaaaaaaaacagacccaagctgtgtccatttaacccatgaggcttattccaggcttggggctcctgagcacctgtatcccctggtaaaaccgcatagtctggactaggcatgggaggaaggtgaggcagacactgggatcctcgaaggtcattgttttgtacagacttcttaagagaaatcccagaaccttgagcacacgaagccctaaaagtgggactaatctcagggttgctttcccttggagtgttgggagggagcacaaccatcagggtatgctgggtttgttgtttgtttgtttgtttgtttgtttgtttatgcctgctttcaatgttcccaatctaggaaagacgcctcttcccctggaatgggaaagccctacagcttgggatcctttacctcggagcccagatcccctgcttggaggtggcgggagcgggcggctggcagaggccctcaagcagcagccaggtttgtccccaccccgcaatcttggacacccccacctccccatgggcctggaaggccgagtgcccaggtctgcgggggacctcacctatatactcgcctctggcgaagggcagggctgggtgaaccggcctggtttcctgctctactggaggcggctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccgtcaggaccattcctgccttgggaggccagagcagtgacaggagacaaggcttggagaggttgacttcaaaaggctaggcagccgataagaggcaaagctggggtttgaagcaggcctttctgcctccaaagtttatcgtctccaccactgcactgtccttgggggacacaggaactacttaacgctaatgggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtttgctctcttttttttctttttttttttttcctgtttttgagatggagtctcactctgttgcccagactggagtgcagtggcgcaatctcagctcactgcagcctctgcctcctgggttccagcgattctcctgccctagtctcccaagtagctgggattacaggcatgcaccaccgtgcctggctaatttttttttgaaaccgagtcttgctttgtcgcccaggctagagtgcagtggcaggatctcagctcactgcaacctctacttcctgggttcaagttattctcctgtctcagtctctggagtagctgggattacaaattgcaccaccacgcccagctaatttttgtatttttagtaaagctggggtttcaccatgttggccaggctggtctcaaactcctgacctcaggtgatctgccagcctcggcctcccaaagcgctgagattacaggcatgagccactgcgcctggcctgtttttttaaaatccacatttcatttaagtccacactgaaaatacattgtcacggtctgaagtccaaatggcttagaaggatataaagtgcagtctccttctcagcctctctgcttctcaccgcagaggcagaaagagtcactaggtttcttgtgcatgtttttcagaggtagtttatgtatataccgtttgtacatatattcatgtggaggaaatatttgactcaggacataagaggtcctctggcctctgtgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacaggcatacaacgtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtccgtctttatgagttcaagtgttttaatttttagctcctacaaatgaatgagaacatatagcaggatttttgtttaaaatcaagaaattctggaggctttattaacaagcctggatttcattctgcgtgcagtggggatccatctactgaagtcaaaagagctgtgagtgaatgcttactcagtctttagtacagctggtatcttcattttggttgtctgattttggggcaagtaattccttcctctccaggctgattttattttgtgctttctaagttcccttgtgtgctctttttcatccagccagcttgctcagttttcttctcttacctctgcatgtggaccaagcaatttctttgctttacatgtggctgtgtgtgtgtgtgtgtgtgtgtgtgtgtgtgttcgtgtgtgcacgcgcgtgcgcagccagcagggggcgcagctgcagtgcatctcagggagctgcggctgctgggccccaggaggagctccatgaccaagagatgggcagaaaagtcaccccttcccctcatttttcttttctttttctgcagttgaagaaggaggaactcctgtcttctgagactctgtataaactccaggtagtgtgcacagcccagggctgggcacaggactggaggtctgagtcctgggttctcattccactgaactgggtgattttcattctcttggcctcagttttcttatctgtgaaatgggtatgtggttgtatggaaggcttcttggatcccttccagatctaaaactcacaggttggagcaggctaacattctggatgaatttgatataagtgaggaataattattgtgaagaaaagtttttaggatgtcaggccttgcacatttcagagctacctcaaagagataattctgatacaacatccccagtgtcatcatggccaggtccctctctctgtggctccggagctctgctaatgttctcttgatcacagcaagcaccttggtggcaaagagcctggtcctgagatctgagggcctgggtctgaattgtggaactgcaagtgactgaaactttctagaccttggtcctggaggccccctgatgtgccagacacttattctttagttgttggttcgtttagggctcctgggcaggggtcaggcagtgatgggcactggggagtttagggcagaggcatttgctaactgatatggaaacatttaaacatttttacacctgttttggatgtgctggtgagtactctgaacaccagcactgaagttgggcataagaacacctacctcaaaggtttaaatgaggttatgtgtggaaagctcttagccaggcgcacactgagtgccagtcaagtcagctggtatgcagtatgccttgcctgtaggtgacctttccaagtcttccctcttgggacgtgcggctgaccaccagcatgtaattcagaaataagatcttcaaaaggcctcccatgggaccctgatgccctcctggtcccaggagcaaatacttacaaagtcatcggaccactgctcctcttcgtcagcagggctctctgcaacagcaggggagaagcagaaggcacaagtgtgagcctcagctggccagccccagcccatccacacacatttcgcacctgccttcccttccctttgggctttctggtgccatatacttgaccttgggttagttactacaatcatatgttcacttgcttttgactttttaaaaaatattaattctcaaagcatagagagaagtcccactgggcagagcaatgtgcgtctgatccatgtgtgggctttgttaagggacatttctgggtcccccagtagagacctacaattcatactatgtggcttctaaggacttcagaggatggcgtagtaggaacagcacaggacagggaatcagacagacctaagttcttatccaggctctgttccgaatgcgttggagtgtgggcaagacctctaacatctctgagcctcggtttccagatctatacaatgaggggatcatttctgtgatcatctctggctctaactttgacttttcttgttaaaaaaaaattatccaatgtcttagtatgtgccaggcaatattatcagagctttgccgtcttttagccctctcaaagacgctgtgaggggctgggcgttggggcttatgcctgtaatcccagcactgtagtcccagcactttgagaggccaaggcaggagggttgcttgagcccaggagttcaagaccagtctggacaacatggcaaggccccatctctacaaaaaataaaataattagctgggtgtggtggtccatatctgtagttccagctacttagcaggctgagatgggaggattgcttgagcccagggggtcgaggctgcagtgagctgtgattgtgccattgcactctagctgggatgacagagtaagaccctgtctcaaaaaaaaaaaaaaaaaaaaaaatcacctaaaccttgtgaggaaactgaggcctagagcagataagtcacatgcccaaggtcagatagtgtaataaatggcagagccaggagttgaaccctacaggttgccttccacgggcatgcgctgagcccccacatggtgctgcctcgctccaggggcaggaggtgccgtcctgggctctgcatgggcatagaaaaatggatatgacaggttgtggcccttaagtagtttatgagcttgtagaataaaataagtctgaattatgacagcccaggcgaatatttgacccctttccctccaaaacacatttagagtatgagaaacttagcatctagcctatcacataaactgaccttagaggttaaatgggattcactctgctgtgtaggaatcaagcagacacaggcccatgtggcagagtggctccatgacagcaccacagagggtcccagctccctcctgccccgctgagcagccactgccacagaggatccagtggatgttcctaaatttcccagaacctcaacagaaccttttctagttttatttttatgtttttgctattccccgctgagtagccactgccacagaggacccagtggatgttcctaaatttcccagaacctcaacagaacattttctagttttatttttatgtttttgctatttctacccctgccacagcagaccaccggactccagagagtcaaacatttggggtctccagaggcaccagcaaggaattgcagaggtgaaatggggtcaggaaggatactgtgggatcggagtggccacattttaagcaatggcggcagcagcaccctcttttgggaaaaacatgataggtgctaagaaagagcctcactctacaagccaaacatgggtcacactttgacgtgaacagaaaagaattcttacattattctttgggttgactaatgctgaattagagtgtactgcaatcactggggttggccaagaaactctagaagattgggtgaataaatcctcttcccaatatgattacctggcacaatgggggagtatgtttctttttcttttctagtctttttttttttttttgagacagagtctcactgtgttgcccaggtgggagtgcagtggcacaatcatggcttactgcagcctcaacctccttggtgcaagcgatcctgctacctcagcctcctgagtaactggcacgtgccaccatgcccagctaacttttgtattttttgtagagatggggttttgccatgttgcccaggctggtcttgaactcctgggttcaaatgactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcctttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctctgccttctgtcccaccaccgacttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtacttcgttctgtcctgtgctgtgattaagttgttcatgtctctctgtactgaaaataaggcctatctaatttatctttgcatctggacagaattttgcatttgtaattaatgtattaataaatgtgtgaactaataaatgactcaaacaaaggaacattaggatagcaacaatagattccatttactgaacacttcctatgtgctgggtgccaggctaagtgttataaaagtgtattcttataacagcactatgtggtaggtgttatttttatctctattttacagtggagaaacttggttttgaaagaggttgtaaaacctgcctgaggctacttggctagtgagtttgggagctgggttggaagccaggctgtgttggctcctgcagctgaaatctcatctgagccacttagccctctgctgagcacttagataaaaccttggtgaaacgagaatgacccaatccagacatcttggcacatggagacagaaaagagagaaaagcatcatacagtatgggatagaggttgtttgttggtgccccatcgattcctagctagactatctacttcaggtcccaagtgcaactcacagcatcatattcataaagttacagtcttgcaggcaattgccaagactaaaaagcatgggagtccgaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcaaataataaaatacatctgaagctcttagcaaagcctggcacacagtaatgctttagtaatgttaccgtcatcttgagcattgcaaagaatgcctcaattaacactcaaaacaccactgattctaatttactcccacgtcaatcacacactatggctaccacaaaggcatggatccaagaaagcctctattgtagtgagtaaaatttgggggagaagttcaagcttcatgtgggccaggtggattgattttgtttgtgtgattccatggtctctgccaggaagctgagatcctgggcgggccctcttgtcagttaaagcctttcctatggtgtggtttacctggtttggggcttatgctccatttaccatgtcataatcccatgccacacaatagagggactcctccctttgcctgacccaggttttaagattcatgtagccctccccagcctgtgggcacagcaccagacacaaggagatgtgagaatggccacagcggcccacatttgggcttaagctctggggtcagactgcctaacttagaatccttattctgccattttctaggagtgagatcttagctgaattgcttcacctctgggcctcagcttcccctttgctaaaatggacattattaatcgtgcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccaacccaggcctaaaggacctcagagtccaaggtcttctcaccaagccacacttcataatacaaataaagactaagggccagaagaatgaccacatgagactgggaaaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtcttcctccatcatctgagagaggggcttatgtgtcagccccagaagcagggcttagaggcagatgtgtgcagaatgaatgcgctgggctggagagggacaggagattctgctgagcgctcacacaaatctgatgtgctgccggccagtgggggctccagccatagtggacaccgcaggctccagtgacaagctgagatggggagctgatgaggttggtgtttaggaactcaggcatggaaagacgaaagctgatccagaccagggggtctgggaatgggaagggatggctggaaggacagtacaggactctgtggtggtggctggggcaaagggagtatgaatccagcctctcagttctgagtcaataggagcaccagagcccctggggcagatgctggtggcatcacagcatgtctgacattctgcctcagctgcagccctgatcctgctctggaggctacccggccgccagaccctgcccatctctcccccaacagagcaggtggtggcatgcagggagccagtgggaagaccgcagcaggacacagaaggaaggaaagagggagggtgggccagttgtggtggtggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttaggccaggcatggtgggctcacacctgtaatcccagcactttgggaggccagggcaggaggatcactggaggccgggaatttgagaacaccctggacaacatagtgagacattgtctctacaaaaaagattttagaaaattagccaggcatggtggcacatgcctgtggtcccagctactcaggaggctgaagcaggaggatcacttgagcccaggaggttgaggctgcagtgagccatgattgtacccctggaccccagcctgggtgacagggcgagaccccgtctcaaaaaaagaaaaaagaaatacttatcatcgtagaaactccctttgtctgtatgtctactcatcccttcacaggatcattaacagaggggtgggggtacagcaatgggggacatagtcctggctcagccatcacctcactgcatgacctcaggagtcactttgcctctctggtctccagttattcctaaaatgagaagcttgggttgggcaatccttcaggaatttctaagctttaaaatacctttgagcccaagtgtcattcctctattcttagttccctatggcaggactgatgttggatatagctctcccatgtcagcgtaagaccagtacctccaggggaatatggacagggagacagaaaaccaggtaaatgctggctccactaggagcaccaggcccatgacaaaagcaatgttaaatctcacttctttagtggacaaaggattgttatgcataccccatacttctgtgtgggcatttacccaagaatccctgtccaagtgccttctttgctctggatttttatttttttccatgtaagtgagtttgccacccctccaccctatatttgctctgatctcctccctgcatgatagcagagccagaggagtcacacgtggacctcccagggatgccaccccatcagagccctggacatcagagcccaagagtgcaagagaggggctctgttcagttctgactcctcaaggacttgtggggtaaccaatggggcatctgcagtgatcccagcagactctcgggcaccatgactggtctctccctgacctccatccccagccagacctcagacttcaaagataccgaaggctgttcaactgtgaaagctcaggaactgggaagcgagttcttgcattaatgtcaggagctctagtgccttcagaataagaaaaaagttcccccaaaagcatgaacacttgagcttgggtcaaagcaaggagctgcaaaatgggagtctgggatgggttttcctcttagtggctgcagtcaccttggacaggatacttaatgtccttgagacacattttcctcatctgcaaaaccgagatcgtaatttctatataacggtgctaatgagaagattaaatgagatatgtctgtgaagagcttagcttaatgcccagaacagagtcaatactcaacagattttggatatcttcccttcccacagcaatgccagctgcttggggcaatgcattctgcccagtgggccagcagttccttaggggcgatgtttcctcctcagggaaagactgaactgggattgctgggtctgaactgaaggcagcaggctccacactggcctgacctgcatccctggaggagacccagctctccattctttgtgtaattcaagctttgtccttctgtactctaactagggaagagggtatggtgactcttttactgacctcctgtggggcagttgctggtcctttctatcctctgctctctgaaggtcagcatcaccaaggtcaacacactcttggcttagagggttttgggaagccatttgtttccagaactggaaagaggacataaatccaatgtgtggggggaaaatggctggagcatttcaggagcctttggtggatcaagtgctccacagggcacgtgattggcctcccaggctcaggaggtctggtgggctctggcctccacacactacagtttccaagatcctaaagactccccaggttcaggaggagctctcagggctgatttctgaggccctggacgtgcagctgtgcagaaacctcaaggctcaggggaagcagctggaaatgctcctgggatgtgaactggggtgggggagagaacggcaagggaggatgctaactgcaggtggtgatggtggttttggaccatttccggggattgagtgtaagagcaggggaaactgggcaaggccccagtcatctggcaaagcaataagatgcatttccgagaccctggaacatcaatggatttgcaggggtcagggattgagggaataaaatctacgtgtctttcagttcaggaaaggcaatagggacagagatggtggtttatagcagggtttcttaaatatgatttacattcagatcccctggagatcttgctaaaatgtaaattctgatccagtagttctagggtggggccaagattctgcatttctaacaagctccagatgaggttgatgctatcttgctgggaatcaaactttgtgttgcaaaggcttagaagatcctgttgggccacacttctgcattccaggagagattaaatgttctgacatcaagactatttggaagggttccaggaaagggagcaggtgtctgaggacaaaaaagagaacacttcagagcatcagggatattggaagatgtgaatgcctaaagccagggaatgttaggagaggctcactttatcactgggccctgagccccagagatctgtgtttctgcaggagtgcagaataattagtattagaggggacctgacagatcttctagttcaggcctgcataatatagatgaggaaaggagcatgagatgcccaagattacacagccagttagtggctaagctgaaagaccttgtatgtgggctcagtggtttgcagttcctcttgttagcaatgtagagccatgaaaagatttaaagagaattttatttcagaacaattttctggtggaagttgagaggaccacatgcaatcaggaattaagcagattacttagagccttctaccctaggacaagcaagagatgatgaaggccttagctgtagcaatgggaatagagagggaaaaaatatttaagaggcatttaagagcaaatcaatgagatttggagattaatttttgtagaaggtgagggaaaaggaggcatcaaggttgatcccaagtgtgtgggttaggcaaaaggatgaataatagatggatgctacctcccttttccccacgcagaaatagagggaaaggagagggcctgggtgggtggatcagcaggcagacaggtgagtgtgaggggacaatcaggagggaggtccaccctgaaatcagatatgtcagtccacttaggtttccaacaattgactctgaactcctggaatctgtgtccagcatctctgatgctgttggttcatctaaaagtggcaaatattcctgcacatttgtccccgaatcctcaaattaaatgtcaccttctcagacagatcttcccacaccacctaagctcttctcctaccccacactgattccccaccattgcactcttccatcttccctcacagcaggtaccatgtttgctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctgtcccttgctagaccatgggaaaccatcacagaaagtgtccaagcagaagctgggccttgtgtgtggaggtgaatggtggtgggataggggttaagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtagatattaaagcccagaacagggtccctcttttagtgccagactgtactggcatcccctgaccaactgtctaaacttgctgactgattggcagggtgatgccaataactactctgtgaattagtgagtggtccaacaggcctgtaaccagacttgggcaggttggtcagcatttctcagtgtgataagattcccttaggaggaactgcactatctgacttattgctatcttgatcagtggccgaaaaaataaaataaaatagtaagcatcatttaaggttatggtttggttttaggctgttgccctgttgagaatcatcaatgatgtctgtagctctgtggttttcactgagggatattcaggaaatctttataattaatgctatagaaagagattttaaaactatcttccaacgtatttgttctaataaagaaatgtgtattgaatatttcacttggctcaccactgccagaaacactacaaatctcaaaactaacccttctttcctgccaaagttgatcctagttggaatgaggttgcaggctaaacttggagaggactgagagtcagcaatgtgccagcaataatttattacccccaccccttcaacaatcctcaaatatcaatttaaacagcttttgatggaggaagtagtctcttccccacttaccccacactcccagccacagattagattcattagtgctgctgtggaattccacccaactttgtgcttcccctatcactgaattgtaattacttttcttttctttcttttttttttttttgagacagggtctcactctgttgccctggctggattgcagtagcatgatcacatctcactgcagccttgacctcagtgatcctcccacctcagcctcctgagtagctgggactacaggtgcatgccaccacacctggataatttgcattttttgtagagacagggttttgccatgttgcccaggctgatctcaaactcctgggctcaagcaatctgccttcctcagcctcccaaaatgctaggattgcaggtgtgagccactgcacctgggcctataattacttttaacataattgatatggtttttctgtgtacccccccaaatctcatcttgcattgtagctcccataattcccacatgctgtgggagggaccttgtaggagataattgaatcatgagtgcagtttcccccgtaccgttctggtggcagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtatatctttatcagcagtgtgaaaacagactaatacaataatctatcttcccttctggactataaattcctcaaatgtatagtctatctttaacttttagcactgtattcctgcctcagatctgtgtgtgcctggcacatggaagatgtttaataagtgaccaataaataggtgggtggatggatggataaaaaaactacatctccactgtagtcaaaatgcctaatagatttagtcattcttgaaattagaaaagataccttttgttttcaaatgaggatagcgtatttccctttccataagcctaaatgtaaatatgaacattaaattagtcaagagtcagttaaagtatctgagaaataccttacctgaagcgtagtcccttcgaggaacacttggaggtgctttgacttttagcctggaaataacaaccatgagacaaaaggtcagtgagcagaacaatgatggtcaaagccgatgctagaagctgatatagacagaatagatagacaactaatagcataatggcttctcttggaccaatcaatggacagatttgatgtattgtaaatgtagtgaagccattagtcaggggttttccacctctccccatctccccagtgcatgcacaatgtggctatgacttggcaaaggtgaagtcaggtggagaagggctcagagaggtcagaatatgatagtaataagcactgagttcagaggttcaaggaagataaatgttgattggttggtaaggtaagtgttgataagaaggtaagataagatggactatattttaatgacttacaaatgtttaacaggaaaaaatcagctacaataagcgttttggttgtaggttgggctaaaattatgtttgcaccattttaaaaacgcaaataagccagacacactggctcatttctgtaatcccagcactttgggaggccaaggcaggaggatcacttgtgcctaggagttcaaaaccagcctgggtaacatagtgagactccatctctacaaaaaaataaacaaaatgagccagccatggtggcatgcacctgtggtcccagctacttgaggggctaaggtgggaggatcacttgggccccagaggtcaaagctgcagtgagccatgatcacgcccctgtactccagcttgggcgacagagcgagacactgtctttaaaaaggaaaaaaagccgaacaagtgaacagtgagtgtctcaggattggagattatgagacttagcatatttagtattcaacttgttttaagcactctcaaaactttactaaagtaaaggtgctttagtacctttatgcacatatgaaatgtgctagtcacaatccttcttcattcaataaaagaagaaaattgaaattacattttagaaaactattccaagttttgtaagttctgatacctccctttccactacttgaaatgagtaaggtttatagtcaattatttttaataattattacccattttaactaagaattatttgcttaatgaaatttaaaatatacataaataaaacttatatccagtagcctttatttactaaaatatcatatccttctatagaagcagtataactgctattatatacaaactttcatgttttgaaaaaaaaagcatagaaatttgtgtttgattaaaaaatgcacacaaaaacagtttacaaaccaaaattgtaatttgcaaaaataacaatatgtatatttacatagaaattctggttttctttttctcataggctctcaatatctattatttcattcaattctcctcacaagccagcagggtgggctgggaagatactatcattagtcccatgatgaggtatagagacagagatcatccaaggtgttgcaaggaagaaaaacaaaaacaaaactgggtctggtgcccaggttggttcaaggaatagtaaaatttccaaaagcacaaaccacctgttatccattattactatcatttcataaaagaaaaggaagggtattttactacccccaaataatctcagaataaaggaaaaactcactaaaggactgttggccactcaacactaggaataaaaggcgtagttgaactttgctctgtagctggctgctgtgcacaacccccaacacttcatgctccttattttctcatgcggccatagaccagtgaaaactctgtcacagtcttgtgttagggaaccagcgtgttcaagcgtgcttcctccgttcagggtagcacctgtggcctggcttcaagtaaaagtgtaactgcaagtcactttgagctaaagggcccctgacgtcacccggggtaatgactatggtggccataatttccaggctgagaagaaacatggtttgtcatgtaaaagtgctttggtcatccaatgggcagaatgtatgaaacagaggctgttataaaaaacttgagctccacagctgctgtaaatatgactggctatggaatagagagacattttatgcagaggcttcatgttattgagaactggtgtattgtaaaactggcaactgggggccatggaatagagaaacattttatgcagaggcttcatgttattgagaactggtgaactgtaaaactggcaattagaattgctagtgattgtaacaaggactgtctcataaagaatgagattctatctgtagcagaaataataagcaaaaatcatcacacacctctcccactcatcagacagaacatgaagccaaattctcctcctctgtaagatgaccaccacctcacaagcagaaggccatttatgtttgatgatgatcacttatgcatagagactcatttacatttcatagtctggaaataccaccaaaagtgatttcttatttttaattttagcatagattaaaacgaataaggatgctcttttgaatgcatagagaaatgaacttctataaactattttttggtccaaaatttggggagaaaaatttggtaatagcaattaaaactttaagggcacaacttcttccatttggaaatttcattttaggaatttagcctactggtatattcaaggtctgcaatgaacatttattaaagtattattcatgacatttaaattggaagaaacaaccagagaattttgattgctattatcaaattgctatccaaaaatgttgtaccggtttaaattcaaatccccccttaaagatggccaccaatatatagctagttaattgaattataatatatttaaggtagactattaaatcatctgttcagaaaagaatatggttaatttttacttactaacaaataaagatgtccatgaaatagcttaagtaaaaccaacaaagcaagttggtagaatggcgcatgcactatgataccatttatgacgaaaatgtatgtgtatagtatgtacaatgtcagtgtatgtatgtatgtgtttaagcacacacatacatacatatatacatacttatacacacatacatacatatatatacacacattgaacttaccatgacaatgtccctttctggggagtgggttaagatggagatataaggaaatgggagattttgacatcatacaattctggcctctttgattttttttccctggtgaatctgtattagttttatttaaaaaatttaaagacttaacagaataccatttcccattttctcttgaaagagacttacctactaaggtatataagacctactaaggtacgtctaccttagattttgagtggcaaatgcagatatgtacaatttttattctctttaaaaaaaaaagcttaagagtttttgatgtacaaggagttttgagatgctaggctttccctctccaagtgccaattgaaaagttcattttcaggtaataattcgaaaagcagaaatcaaaatatggaaaactggctgagcgcagtggctcttgtctgtaatcccagcactttgggaggctgaggcgggcggatcacctgaggtcaggagttcaagaccagcctgaccaacatgaagaaaccctgtctctactaaaaatacaaaattagccaggtatgctggcacgtgcctgtaatcccagctattcgctgggccgaggcaggagaatcgcttgaacccaggaggcagaggttgcggtgagctgatattgtgccattgcactccagcctgggcaacaagagcgaaactccatctcaaaaaaacaaaaaaacaaaatcaaaaacaaaaccccaaaaaaaggaaaactcacatggcatcttgaagaagctagggctgtgttttgtaacttttcatttggatttctccatacatgttttcatagcccttagctaaatggttatagaaatgattttcctgctttgacatttgttaggcaccttgaatgggcatagctcaccttccctgcagtgagaaggaaaatcaaagtccactgagtacaactgcactcacttgtcctgttccagaatgtagacctggccaccatggattccagccaatagtaaagaagggttacgtgctaaagaggtagaaacttctcatccaggtaacagagaaatttgttttcttccatgtagcacatgttgacttattttatataattaagtatttaaatagaggcgaacttactttttgattttattcattattccaccttcattgtttttaatatcatggaccatcttttgaagctgcctgtaaaaaacaaaattaaacataagatattaataaccagtctgactttttaaaaaaagtctcctactcttctcgaatacaaaaaaggggaaaaaactctaccaaaacaacctccaaataggatgaattatattgtatttaattaaattgaccatctgctactttagcgaaggagaagcatgactgattctataaggaatatggtcactgggctgtgtccccttccgttgggatgtctggaccagtctcaggctgtgaagaaagatattctgattccttgctcattgtcttagagcatctacgttacgaagatagatgctactctgtggacatagcagaggcttcaatcaggcccaaggttcttttttattaaatggtagtaggtagcatctattaaaacttccatttaaaagttactcctacctaggagtcataaagaaaatgactattaaatctggctgatatttgaaacttctgtagaacaaaaagtaatattgaggcaggagaatagggtctggagtcagggaacctaaggccaatttgcactgacttcctagaactgaatcaaatggaaaaccccacctctccatgcacaagtaacaaaaggatcagaggctactacctttgcactgcgttatagatgagaaatggaaagtgcctctgattgatcccctcctgtaaccaatcagactggtcccaggccaagtcttcctgtgtaactttgtaccttaacttcagcgtctgattgatcaccttctgcaaccaatcagactggtcgtgggccactccttcatttacataggatgtaaccaagtaaccaatgggaaacccctagaaggaaaattctgtaaccagtgctcttgagccacttggtcaagcccattcctactctgtggagtgtactttcatttcagtaaatctatgctttcattgtttcattcttctgttactttgtgcattttgtccaattctgtgttcaaaaggccaagaacctggaagactcatagtcaagaccctccactggtaacaatatgtatcaagaccctccactggtaagaatatgtacaaaatcaaaagataaatgacatgctgaaagaaatatttgcaacatatagtaataataataagaactacatattagtttgctgcaaaagtaatcacggtttttgccactggaagtaatggcaaaaactacgattatttttgcaccagcctttctcgatttacaaagaaatcttacaactcagtaagaaaaagagaaatagttcaatagaaaaatgagcaaaagatatgaacacacagctaacagaaaacaaatacaagtggtcaatagaccaatgaaaagatattgaacatcacttatatttaaacaaatctaaatctaaacaacagtgagatgtcttttcgcctatcagactggcaaaacataacaagtgtgataatatccagtgttgagaaagtaaattgttacaatcaaatctgtcaagatttaaaacgtccatgacttttgacccagcaattggactgctaagaatttgtcttatgaaaatggtcacaaaatgatatcagtatatacatataagcatgtttattgcagcgtgatgtgtaagaactctctaatcttctccctgcttcttctgccctccccacaaccataactctgaaaacaacccaatgctcattaatcattaaaagggaactagttaaataaattatgatagatccatgcaatggaatgccacagacccctaaaaaaaagaggaatatacatctatattgttgcctgaaacttctactttctaaaaaggggattattactttatgatgttttaaaatatttgaatttttatagcatgtgtagatatcatttgtattatctgtgttatacacaaatatggagaaaaatattataatgggaggatagggccatgttatgttttcctcataataattttctgacttaaaaaatgtataataaaatttcacgtggttcttccctgaaagagtaggacgttttaattcacctttcaggtaaatgcttcctttgttctgagaaaactatttgactggaccctttagataatgaactgtacacagctattgttcttgtaggaaatggtgatttccccacaatcctgaaagcagatttctctgactctgggagctaggccttgggttaggtaatagaaatagtttagcataggtctaggaaactgttggttgaggacatctgggagaaatactccttggccctttgtgaatttagaatgcccgtgcggtggaagggttactttttggtgcagcagtggagcagtttagagggtaagaggacagcttctcagaagaactctgcctgggcaggcctgtgggtgtcctctaccaagtgttaatttaaagctaaacaatgcagccatgctggtgctctgctgggtctgctctattgagggcaggccctctagcccttagggagtggagtgaaatttacaggatagggaattgggaaaagggagattgctcaaacgtaaaatgggaacttaggctgcagattttggggagatctctctccttctagggctaatggctgttaggcgctagagtgctgaagagcgcagacaaacctgagggattttcagtggtgggggtttgggcgatggcagggggtggtagccctgaatctgaggctgggtctgggcctctgctctgagaaaagccatagccagagccatcgctagctattttcaaccacataatccctctctgctgtccctgaatcttcagtaagatcttgtagtagctgcagcccggcctcagctgggccttggggaagagagtgttccactggcatggaagggtggagggaggacaggctggagtgtgaagtagaaggataggagaaacttcttttgggacagccgtatggctgcattttggagaattatctacgtaagtgaggtacccactgagggacccacgttcaaatgtatgtgtcaggggtctggtgccaagtcattgtaatttgggtaacaaaggaaatgagaccatattttatactccctagctagggaggccgggcacactgatgatacaagtgtaagagctcaggaaagagccaggcacatattatgggctcagtagcaaagagaaaaggatggttgagagacacacagagggtccctcagatgggcccttgagttgcctcagaactctacagttttctagaatttgttcacatatactctatgccaaacccttttctccttttcctgaggaactatagagaatcttcgagatagaggaaagaagaaaatgaaaataaggggtctggcagtggggagagagattgagagacagacagagagagagggggagagagagagagagagagaggaagagagaaagagagagagagagagaggttgaagtggattgattgcaaggaaattcaataatttcatatggagggcagagggcagctcgttgtaagctgactgtaactgaatggagtatctttaggctaagttaatgcttaaccaggttgaggagcaaaatgaggcagcagtgaagaatcctatcagaaatgtgtcaaaaatgggacacaggcagagtaatagggaaccaggggccaatttgcataagtgattttgctgtggatgtaaataaacagatgcaaaatgttgcaaaagaattggatgcaattttgtcatttgctcaatttggcatttggtgcttgcttggcatttcctaattactttttattgtgtattattataacaataacaattatactatgtaactatataattacagtaagttactgaagtgttgcataaactatactttttaaagttgatgcataatagcagtagatatttatggatgcatgtgatattttgatacatgcaaacaatgtgtaatgatcaaataagggtaattgggaaacccatcacctcacctcaaacatttatcatttctttgtgctgaacacattccaaatcttttcgtctagctattttgaaatatacaataaattatagttaactatagtcaccctagataaattacactttttatattttaaagttttcttctctctctgtatctcgttcacacaaattctgatgtctatagactgctttgttacaactgccaaacttctgtgatctgggaagacatagtgacccaaaaccaagatttgctgtgatgctgttagctcattatgtcaactgtccacgcatctggtgatgcacagctctgctgctctctagtattggccatttcattttgaagtgctttttgctccttattacaacttatagcacatgccatagcaaaagaatgcacaactggtctgttccaggaggggttgttctggattcaaacagcaatccttttactgagatgagttgtgtgtaggtaaagataggtaaggcataaaacagcttcactttgattatctcattcagagatatccttccatggtggggagatggataataaggtcacaatgtcctaatcttctaaagtcatagagagagagccatgctcatgtaacaaaataaaatgaagaacaaagcttatctaatacatgttttaaaatatataagtattgtaattttaagcagtatggcattttggtatttaaaaatggtgagcaggtcatataaataattataatacttgtgtaaaccaaatcaaattttatattctctcttttgtttttaattttcaagcttttgaattaagacacgtaacttagtcacactgtagtagtgtgaccctgggtaagtctgaatctcgagagatttaaattccaggaagcactgagagtagaaaagtcaccatttgaaagttacagcagtttcttccctttaaagtgccttactttagaatccgatagatctcaagagggctattggaccacaactggctgggcctcacccctggagattctcattgggttgtctgtggtgcgtcagaaaatctgcatttatgtttttatttttattattattattattttgagacggagtctcactcttgttgcccaggctggggtgcaatggcgtgatctcggctcactgcaacctctgcctcccagattcaagcgattctcctgcctcagcctcccgagtagctgagaatacaggcacctgccaccatgccgggctaattttttgtatttttagtagagacagggtttcattatgttggccaggctggtcttgaactcctgacctcgtgatctgcctgccccgggctcccaaagtgctgggattacaggcatgagccaccatgcccagctcctgcatttctaacaaattcccaggtggtgctgatgctaccagttgggagaccatcctttgtgcatgtctatgatagatcatgcctttttctattgtgggccttttagttgtgcccaagtaaagcaaatacctgtttgggggaaaaactaagttctcattaactcaagtgcaaagtttcagacaaataaattgggtggtcaattggaagcataatttgggtgtgcgcttttcagtctgtagcttctttgcaggactgttgacttttctctgtatgaattcagactaacctctgcttatatattttaatttattttatagtcatgtactttcttcttgagccacagtttgcaaaactgtagaatggagatgaagtgactgcaggcagaacatgcccctctccttgcgtgacaatggaaaagggactggcccttcttggagcagagtgccatggtcgggaccattttgccattgctattataatatggtgctctaagtgactaacagaatgcagtggcggtggcactaagactcgacctcatccctgttggtgggggataggctgtctttgctgtcactcatcctgcaaagactccaacctagaaaaaggatgtaagaaaatgaggatgtggcaggcaggcctcaggcttggtactgtgatgtttcctgtcttcccggggcctcctggttgttggtccctgtgctgcaggttgaatagaggaatcttctagaaggattcccattgaatagccttccaatttttactacccatgcataagatgtacagattttacacaactaagatcactcttgacattttgaaatctgtgtgttccacttactatattgtgaatattttcataagtgagcaccatccttaggctttatctgcatctttctttcctctgctatctgaggggcttttaaatagctgaaactctgatccaagtaggcgtgacaagaagcagtgaatcaggacccctcagcttgagggagcagagagatgaccagaccacatggcaatctgagaccaggagaagcaaaggctgtgtgagaataagtgccgaatgccttgcttctgggagcctgggatcaagaggcttggacctcaggggcagagagggaggggacaatctcaggttccctcttgtttcttcaaacccagcctctcttccagatcaccctctgaaacagtgttttctagagtaaggtctaaagattgcctgtatttatttattagaaattcagatcactggaccctaaaccatatcaatagaataaaaattccagatagagcccagcaatctgctttttaacaaattttctaggcctggtgactcttatgcacacagaaggttgacagccatttttaaaggattaggccaggctgggtgcgatggctcacgcctgtaatcccagcactttgggaggccaaggcgggccgatcatgaggtcaggagatcgagaccatcttggctaacacggtgaaaccccatctctactaaaaatacaaaaaaaaaaaattagccgggcatggtggcgggcgcctgtagtcccagctactcgggaggctgagacaggagaatggcatggacccaggaggtggagcttgcagtgagccgagatcgtgccactgcactccagcctgggcgacagagcaagactctgtctcaaaaaaaataaaaaaaattaaaaaaataaaaaaaaggaaaaaaaaaaggattaggccaggtttatccccttctaggctaagtttaaatggaaagagcaaaagagacgacttcccaacctccagagtatcttcccccatccaccatagcctggaatagctttaacagcaaatcttactattttctccataatgagtggccaaaggcttacccaggcattctccccaggaaaggaaagacactggcaatggaattttagtcaatggtatgatgtctgctttcaacaaggggaagacagcagaaggaatcggctgtggttgccaatggccaggcattcacctttacctggactcagattaatacaagtcgggcacagtgatgcttccagcctgcctgccttctcttcccaggcagcctggtgtcagagcagggactctaacccgaggagctgactgtgtacagctcagccttcttcaatgagttttttttttgttttgttttgtttttttgagatgaagtctcgctcttgtcccccaggctggagtgcaatagcacgatctcagctcactgcaacctccgcctcccaggttcaagtgattctcctacctcagcctcccgagtagctgggattacaggcgcctgccaccacgcctggctaacttttgtatttttagtagagacggggtttcaccatgttggccaggctggtctcgaacttctgacctcaggtaatccgcccacctcggcctcccaaattgctgggattacaggcatgagccaccacacctggcccttcaatgagtcttttatgaattgaagtttagaccttacatcaattggcagtctttctacatctccttcttggatgaaaaggtaggttaaagaaatcgtcttgactttggctgcacattagaatcacttaggggacttttaataatcttgacacccaggccttgcccccgaccatttaaaccagagtcattgactctcaggggatccaatgtgcagccaaggttaagaaccactgacagtgttctcaggataggagaactttgtacataccccagggaagttcgtctggccaagagagcacaaggagaggaatccatagtgagaatccacagaagggtatctgcagactgagaacagccccaggcacatagaaggataaacaagttcaggaaggatggagtttaaggacagcgagctcttccagggccaagagggcacggggagggcagctgcatgcagatatttcggccagatcaccagaggtgtccaagaaattacatatttgacaaaaacacttttccaataatttttattaaatacaggagatgatttaacagatgatattatctgtaagaagtacttttttaaaaagtttagtagaaataagatcataaaacatcttgttttccttgtagctctttagtgctgtcacagaggacaatgataggcaggtttcaggattttttttttttcatttgtctttcagaaagggtggaatgcaaagtattgctaatcagagaaaatccctgtttaatctgcatgtaggaatggattaaagagtgtctcaggtgaaagtgactctttgtaaacaaacagaataaataaatccttccttcttcatcccccgcatcttaacctcaggtccagttcttgagtttcatcctttcagtgttcataggctggtcctcctctctgagccaagatctaagcctacactttcccctttacaacaggaaaatgcagcagctggcagcagggccctcccatccatgctgtgagggcttgttagggcctctttcagcaaatgtttctaaaacctggatttcaacgatcactccttcctcaagagtgcagcagctccccggtatctactgaatcaagcctgagctttttgtcatggctcagtcactcagtctcaccctgagctccatgcccatatagaaattttatttttgttactaaattttaaaacagctcgatgatagaaaattgaacactgccaataagaaaaaggaaaagggccaggcgtggtggttcatgcctgtaatcccagcactttgggaggctgaggagggtggatcacttgaggtcaggagttcaagtactgcaagaacccctgggggctgctggctcagccctttgctttatccacgtatacttgggtatccttagaacatctgtgctggtgcaattgacctggtatctccaatttatatgtttctaaaatcaatttggagtagaaatctctgtaatgttttccttggcatatatagaaacaaaaatgcatccatgaatactttttactatgaatggatttttaaaaacacttttttaaacttaaaatttaaatacatttaaatgcatttaatttaaaaataaaaaaattaatgttcatcattaggtctgctgattctctagttgacttcctccttttttaggtgtttaatgtaattgactctgggtttctttttaagatgctactaatatagtatattttatttttgttactaaattttaaaacagctatatgatagaaaattgaaaactgacaataagaaaaagaaaaagggccgggtatggtggctcatgcctgtaatcccagcactttgggaagccaaggagggtggatcacttgaggtcaggagttcaagaccagcctggccaacatggtgaaacctttgctctactaaaaatagaaaaatcggctggcagtggtggcgtgtgcctgtaatcccagctacttgggaggctgaggcctgagaatcacttgaacccgggaggcagaggttgcagtgagacaagattgcaccactgcactccagcctgggcgacagagtgagactccatctcaaaaaaaaaaaaaaaaaaagcagcagaagaagaagcaaatggaatttataagctggcatccttggatcttcaggcttgaaacttctgaatgttctttaaccctttctctctctctttgactcttcatctcacatctctagtcacatcaaaagggtgaggaacagcagccaggtatcaggaacagcagccaggtatcaggaacagcaagtgcaaaggctcagaggtgaaactgtctgagatgtttcgggtccagtgagcagctgagagtgtcaggaaagtaggtgttgagaggatgtttacaagacaaggatgagaccgctgggagcagagacagatagtcaagggacctgttaggccaaggagatggggggttacaggcttcctgctggaagcccttggagacctttcctcggggtgtgtcatgatgagggtggaagaatggaggaggatctcggcctgggacagtggtggctgggacaccagtatggaggcaactgtgccaggcccaagcctcgagctcgtgacagcgtggtaccaaaggcaatggaataacactaggagtgccctgtgggcctcagctgtgcgaaaggaccaacaactctcaaagaggacattactgagacaaagtgccatgttggccatactggggcctgagacaaagtaaatcagcaggactgattctgtcttcatctaaaattccagtagtttcttcatcatggatttctgggcattcattttgatttttaaaatattatattaaatactatttgtatcaatttattaatgagggttaccccttaaaatttaatgtcatgctttgctgttttatacatgactcgttttgttttattccacaaatattcagtgtgtgcacactgggcatggcacatgcaggccacagagctaacctgaacacaaacccgaccctcttgtaatgcaggaaaggggctcctttcaccaccttatcacatgacagaaaccttctggcctatgtgaagccaggggacagatataggcagaccggagaattctctgattcacacaaaacatcctcctctcaggtcactcctgtcttaaagctgaagttttcagccaccaacccatcgttttgaagcagcatgatactttttagtgactatcctgttacttgcatgctgcaggactcctatgacaacttctccccctccactctttctaaagccttgtcatttctggcaccggcttcctaatgctcacttcctccagcctggccttgctatgaaataacaggaattatatttagatttgcgaattcagcactgcaggctgcttccttctggggagtgagctcatggtggagctggcagagttttgacagctttggcagtcccttccatggtgtgataatgtgaacaagcccctcaaggtcgagttagtggccttctcctccatttcacagatgcagatactgaagcccaaagagatcagagatcatgagtgtctcagactatacagctgactccgaattttgcctacaattaaggtagtcacagaaatttggaagtgagagagactttgggaatatcctgggtcaacctcctcttatgccaagggaggaaattaaattccagggaaattttgtgattgccctgagattaatttagttgaggactcctccaactcttttagtcatacctgttccttccccttccacataaggcttgagccccctgctagagaaggtggggggtacctccatggccagaggtaacccccaccttcttatgccatagttcagagctgtgattatagtacaagcccagtaagccattgctgagagaagcatcatgcatgccagtgatcagacttggaaaatcaataacggtaaaagccagcatttattgagcatgtactacgtgctaggtactttgtgtgcattatctcattaaccctcacaactaccctgtgagggaggtcctattatccccatgtttatattatgataaaaaacacataacaaaaaatttaccatcttaaccatttttaagtatccagttcaatagcattaatatattcacatagttgtagttatccctgtttttatagatgagaaaatttgactcagagaggttaaataatttgcccagatcctacagcaaataagtgatagagctggaattcaaaatcaggtctgattccggagcctatgctctcaacccactctggatgatacaggctaacttgtttcaacttggcccctcaccagggcaggcgactggcttcagcacctacgttgcctctttggataccttcctctctgtccctggagacagcacccattccctctaccaacccagtaatctttactgtgacacatgtgcccccacccctgccttgctattggtccccaaggttagacattttgctagaggggagcgtcagctcttaagggcctgtttcagactttgggaggaagagggagagtaaaaagaggaaaggacagatggcaggggaaatgggaaggagagggggtaaggcacatgggaggcaggagggaatgcggtagcggccctctggggtctggaatatgctcagaagtagggtggctgaacagagcagctggaaggacgccaccataatccatgcatcctttctcaacacccgaggcagaaaggccccctgagggtcctggagtggaggggctgtgttcccttacacacaagcatcttgctgccagggctgtttcttactatccacttattaaccgtataaagtaatttataagtttctccaaacagttcacaccctacctttttttttttttttttttttttgcttgtttcttttttttcctactgagatctgcaaatattttgtggtagtctttggcatgtctgaacggctgagcttggttataagcagtcagaaattgggctgacttggcacaagcaggagtagggatgattctactaataccctgtgtccttcaaaaaccctggtaggacttaccctatcagaggcagttatgcatcaggcacaccaccctgagactgatgagatggcaaggaaatgatgctatacctgccttaagaagttcttagaagttttgtcacttgatttgacagctgaaattggcatggcccttcccctctctgactttaggggccagtggtccttggggcctccaggaatacaacacttctctttcctttagcacattggaatgcttgctggactctgctctcaccacccacctggcagaggtcttgaataaaggaaaacttcctcacaaaactacataaaagcagattgcaaaaaccaaaaaagttaagggagactcctgtgttcatagatgacacagactcttgggtttggaagaacactaagaggtcatgtcatttagtcccttcactgtgtctgactctgatgtgctcattgttctgatgaggtgctgacagctgcaccgtgcatgtgttcactgtctgtcctctaccagcataaaaatgcaaaactgacgtctcttaaatcgaaccagctgccaataggtttgtaaaaccaagcgactgagaagtagttctagtcatgtttctgaaaatgcaattctacataattccagaaaataaaagtgtcttaagaatttgaatatgttcttttaaaaattaacttaatgggggaaaaaggaactttggctatatctacatggcatgatatatatatagtattgtcatctacttgtcctggcatccatttctgcaggtaaaagcaaagatattttcaggaagtaaagagtgattttgagggatggcattcaagaactcatatattgaaaaagtttgacccagttaaattcttcttagctctgagaaaacaaagatattgggaatgtcttgtatgtaggggtaggggtgaaaggaagcattgtaattcattaaaagcatctacaaatgtttgtcaataatacatttaaataaaaattttgaagcaatatctttttttttttttgagacagggtctcactctgtcacccaggctggggtatagtggcgttatctcggctcactaaagcctcaacctccctggctcaagtgatcctcccacctcagcctcctgagtagctggaactacaggcatgtgccatcatgcccagctaattttttgtattttttgtagagacagggtttcgccatgttgcccagactggtctcaaactcctgagctcaagggctttgtccacgtcggcctcccaaagtactgggattacaggtatgagctactgtgcctggccaacaatatctagtgggtcaaaaaaatatataatcgtgggtccccaaaatacactcatttatggtaaatataggaaattgtttaattatcaatttttaaattgtggtaaaacatacataatgtaaaattcaccatttcacccatttcaaattgtacaactcagtggcatttagtaaattcacaatattgtgcaatcaccaccactgcctagttccagaatattttcatcacccctaaataaaaccccagacccatgaagcagtcattggcaattttaaagcagattttcaaaataatttacttttgaggtattttcatgaatagcttttgttttcatcatgctaagaggttgttaatagaatttaccctaataggtagcatcgggtatattaagcccaatcatctaagatcggtttggcaactgtgatgatcttcgagtatgaagatgatgtgaaatctgaagtcctgccatggtaaaaaagagaactctgaccttgaacaggctgtaaagatcatctaaaagccaaaacaatcatatatatgtacagagttcatttttttcaatgattttatattacatttgccattttcttttttgaaattatagttctcatgtttgtatgtgattctcatagttatttgcagtgcaatgaaatactcttcctagtatgttcaatattgagtagggacattaatacactttttatgcttaaaaaattatttttcataatgaagtttttatactttgaaccaagtaagattgtaaaatgaaggggtaaaaaatggaatggggctgggggtcatttcactctaggtacgagctcagactttcttgtcttctactccaagcacccttggtcatagcctccctctggggaactcccgtttacttaggtgtggtctcccacctctggcctttccctccttatcaccatgttcctgaacaatgatccatttatccagctaggctgttgattgaaccacctctgtgagtgggtaggagagctctctgcccccttggtctgagttggttatcagataaatgagtcctgcgtgggtgctagtgacagatgactcagtgcctgaacctattacacttaatgatgtttaattttgaaccagaacattgagacactgccatatcccaagtagatgcctctctaacaacacaatccagggcaccagggaagcacagaccaggaggaagggggcattcattgagctcttactctccggtatacagaggtactgttctaatacccctgctttatgttatatattattgagatattattattcccatttttcagatgaaaaacctgaggctaaaagggattaagtgatcttctcaaagaccacaagctggtaagtgcagagcaaatgttcaaatccacatctgcctgattctttcttttcagtaagacaaaaacaccttccaagggcacctcttaaaataccacgttggtgctgtgtgcttggtctgtatataagaccagctctgctcttcataattataactcactctcagattacatgaacgattgtgggagcattctttgcaaaatatatagcagtaggataccagacacacctgagtcagtgtggaattcaagtttgggcctggaacacacaattgtctgaaatactgacagcaggaatcctcagaaggctttctgactagtaagtgactgcttttttaattttaaaacaaacgtctatgaaaagtgaagaacaaagcctgaatgttacattggccagtaaattacacaggcagacatggaggggtcgtctagagcttgaacaggtgacctggcctctctgggcctcacctttctcacctgtggaataaaggggctggagaggtgtcctttcagtcctcgcaaggcgaatctctgtgcttctccatggaagcctgtgtctctgcacattgtagaagcaggcaaggcccgagtcctcatggaacccccgaccagcactggctgcataatttctggggcccaatgtaaaatgaaaatgcagggccccttggtcgaaattgttaagaatttcaggactgcaacagcagagcattaaaccaggcacaagctccgagcacaggaccctgtgcgactgtatggccacacgcccaggaagctagggacctgtgctgcgtgttccctacaatgtgtgaaggaagggaatctggagtaggtctggggcccccagccagcatgggaggcagggatgctcctggggtaatgagagccttccttaggaaactggccaacagagaagtgtggctcagcaaacagtcaccacatgtccctcaagctggcttctttgtcttgcttttgaaataagcattgaaatagccatgctgggctgagggaaatggtctgtttggaggcctagaccacagtgctgcaaaagggttgtgaaaacattaggttaaaaaataaggcttcaggtgtagcttctggtggactccctttcagaagggaggtgaaggcaggacaggtaggaaaaggtggtgaaataaggaggaggaggggcttgtggggagggctcttttctttttggaacaaagcacagggaggaaggaggtgaagtcagactttcttgctcattgctggatggagacaaatacgccagtaatgaggaggcttaacacacagtgaagaggagcaacctcctgagagagggtttccaccgcagcagccaaccccagtgtccagtgtcagcccaacacaaaagctgcttccctacagctgtgctggggaaccccgaggtcatgtgggacctagaggacggcagccagcatcacacttcagggttctctgctcccttgatctggagcagggacttgggtaggggctggaattccaccccatcagcaggtgaggcccatttctggagcaacaggtgaaacatactctaaattcctaataatgtgcatggttcctaggggcctaggaaacccagcataaacgtggaatgaaaaaactaaggctgcctttgagcgcttaaacctcaacatctgacagagcaaacacagagaagcaaggtcaccctcaagaagcagaatggccccaagtctgtgagatttaagggggacctgatggaatgtaatcaccaatccagagacacagggtgtccaatgggaggcagtagcggtacctctctgacctccaatctgcagagacggagtcttggttaggtggacttaaaaggcctccttagtgaggctctgtctacagtgggcaagagcaccacagccctgcaagcctgggggcaggattacccaagagccttgagcatctgacattacaagagacagcgctcttctgagcacaggaccctgggtccttcacatagacctcctctcatcattcctaatatgcagaacaatcacacaaagcgtttcctgagatccagattcaatcgaaaccaatttaaagagttattttggaggggggcggggagacatagaaatgcttaatagagctggaaaaaagtctttaatgaaaaagattgaacccttaaagcctacccatcggtttcaaaaaaatatatacacactggccacagggagaccagacaagacagggtgaatcctgctccagaaactctcccagctcatggaaggattattccaaatacatgcctcttggacactgccacagaattttcatatataaccaagaagattaaaggatggacaagcaaacgcatttcatctctcctccaccagctgctttgtcttttatccaatgtccttaggcaacatattctgctctaggataagcacagtgtgtgcacctctgtccagaatttggccttattattattattatttttgagacatggtctcattctttcaccaggctggagtgcagtggcatgatcttggctcgttgcagcctcaacctcctgggcgatcctcccatttcagcctcctaagtagctgggactgcagacgcatgccaccacaccagacttatttatttatttatttatttatttatttatttatttatttttgtagagatgggtgtctcattatgttgacccggctggtcttgaacttctggctccaaacaatcctcctgcctcagcctcccaaagtgctgggattgcaggaatgactctctacacccagccagaatttggccattggatcagactcacaagcccttgaacttcttaatggctgtgttatgacataatatgctttttacctcaacattaagaatttccactcaagatttgctcagtctacttgaagaagtagaaacagactatttattacaagatgaccttatgtctggaaatcttttcctgctctcacttttctacccaggagagagcaacttatagctcaatggtgcatatagttcatgggatctagttttgtttgacacaacttttaaaaaggaacatcaaattgaaatgcaggcctaaggatttattgcccctcctctaggcaatccctcatccaaaccatcccagaccggaaacccagtgtgatctgagcaaagaccacaacaatggcaaagatatgtattgcctattctgaactttaaatacacgttgtcactataagcaaatagaaatgaatatttgcttattgttctgaagagaacatgtcacttagtctgaatcagggtttctcaacagtggcaatagggacattttgggccagatgattctttgttgtggagactgccctgtacaatgtaggatgtttagcagcatccttggggactaactactagtgtctgtaacactccccagttgtgacaaccaaatgttcccttggggacaaaattgcccctgatggagaaccattgattgaaatgatccagctatgtcttgcgggaggctggggaaggatgtttctgtggaatctattaagaagccaaagaaagcgaagtgttttaatttccctagaacaagctatcctttaatttttctctccctttttttcttgctcatgtaagaccttctttgaaaatgaaccaagctgataaattctcccaagaacagatggggttaaatcacctgtagggagaaaacaagagatcgtctgtaaatacatgcctgaagagtttggcaccagcccagttcttttcaatccagtaatctaggaggcagggctggaaaataactgtgatttggtccttggaaacctaatcaattgtatcatagtccatttggaaacatgttgtgtgaagaggaaggtgttgttcagccatggtacacaatcactgggtccagaagagaggttcctcggacatgtggactctggtttagggttttcctagcacagccatgcccagagtgggtgaggaagttgccttgagttttcttggctgatgactctgaagtccactcgcactaagccagtttctgataacgtggctcccatgtgacttgcccacagggagaaagaacccttctcagctgctctgggtagtccatccattggtgtgccgcaagatggtccagttaagtggcttctcatccagtgggatgcaggtaggcagtgtgaggggatgggaaaccagacggtccaggaagtggatctaatctccaccactagatgctgtgcctcctgcctgcagctcccctgaagtttgccaccccagttaaaaggagttggaaccacaaatatgaagagcaagagagacagcaaatgccactcagcttgggtggtttgaggtactggtggttgtgtttgctttttattgacttggtatactgactaagtggcaaatactcttctgggaacttcagtccatgttgtctcacttggtcttcacacaagcctgtgaggaaggcatctctagcttcgtttggcagctgggaaaactgaggtgtagagaaactgaatggcttcagctagtaactggccattagaatcagccctgttgggccccaatggcatggtccttctaaatatatcaagaaatatttcctgagagtcctgagataaaatggtagcctttgagaatgtaacatatgtcaaatgtggtctctgtgcttaaaggatcacagcatcagagctgagagggactttgggaaatgttctcattttgtagtttgaaccaaacaaacataggggacatgggggagctaataacctatccgggatgttgtggaagaaaaggaaagaaaagccatatatggaagagaagagccataaagaaaacctgcagggtgtggtaggtgagtgggtgtcagctgaggtgaagagggaaaggtgagtcagtgtgagggctgacgaggataccatcgaccaaaacagggaggatctgagagacagctagttgtggaaaggtgaaaagaaggtgaatttgtttctgaagaactgaaccagaaaaatcaaggaagtaaaaactccagttgaaaactccaaaccctgagaagagaaggcatgtctcagaatccattagaaaaggtctcagtgagacccctaccaggaagacccagacacccacagcagggttctgtcatgcttaacattattagtcacttagatgaacgcagagaaggaatgtttgtcacatctgcagtccatgcaaagccaagtgtcacagatgtcagaatcaatagacaaaatagtcaaaatagtcagaaagaagaaaaggaaccaacatgaaacttatcagggatcaatggaaagtccctgtttattttcagaaaatcaattacacaactatagaattagaataacaacagtaatgatattaatagctactattttgaaagtcctataatcactatgtgccagttgcttcacagaaaaatttatttaaaccttacaatagccctacaacattggtactgttattattatctttatcttacaggtgaggaaaccaaggagattaggcaatcttgcctaaaatcacacaaatcttgatttttctaatggaaaaatgccatactctttaatcaataagataactggggagacccgatttgaccacacttgtgtcaaagaccttttctagttgtaaaaatgagcaggtatgtgtttgtttatgctacaaagaaaaatacacaagcacagatgatgaatcaattgggaggttattaaaaactaaacatttcattttcaagttagttttactaatttgaaaagggatatttgcaaagtgattcaggattgtaaattttgaaatgttcccctagaaaggtgaaatttttatgatcataggaatgtttactgtggaacgattgaaacccagctctagccaggtttctgatcataactttaccttatacaattaagggaaaatcatggctaggaatcaactaaaagaccctaagtgtctatggactcctactgacagagaagcctactttagcaggcctcggtgggagcaaagacatgagaatctgtgctcacacctctctgtggtcacaagcaacttagccatctcacctatctctattcttatacagcagaaactctcaaggtgatgacccatccccactgggttcatccagaacattccctttcttcttcattttgagaattccttgtctccttccaatcctgcatgccctcctttccttggatgactctgcttcccctctcctcctagtaattccttctgctccactctcttttcagtcctgggaatatactccctggatcaaggtcattcctttcagtcctttggatggacactcactgtccttctatttttgtggctaagaatttgagcaaattctcacctaagcctaagagtataaacataactgtccacttttatggtcatctggtgccaaataattacatggttaatcaaccttcagaattgatgtcaaccagtcaggacagaggacacaaatcacaggaggcaagtatttcatctattgactcctcaccatcctatctatctaattatggaaaagagttaagatggtgcttcgagcccattgagtttacaatttcatttctttgaaaagttccacgtcaacagtacattttaccacaacaggatgattctataaagacaactgagtaatcaagtggaaaaaaagttacttttatgtaagcagatgagtgtagtgtatgattatccatggtataattttggttttctatcccataatctatggttgtatattgcccatcaactactctgtgatcaagctggactttgtcccaaagggaggaatcataaaatgatttaagttctagcacctttacttaaattcccacctggattccctgaaagagaatgcatttctgtatagttctacattatggaatatgtctgaaaacaaaaaaaaaaaaacatttggaatcctcctgttcattcagaggaaggtgcctagttagtttctttgccatgtctttctgccctctctttccctcttccttctcactgccatgtcccaagtccaggcctacaaccctggatgcttgggttacttaagcgctcctccctcccaccagatccctgcctccagtgtccctcccactccaacgcatcctaccaggctcctttaagcctactgtcatgacattgctaacagctaacagcataacctgttctccaactccctatggtcagggcactcaccatcctttgcaacctggacccaccttatttgtccaatcataccaggaccttcaggtcccacattccctactctttagtttctgctggacagaaaactctcctcactatcccacaaatggaccgtacttgtgttaagctttgagtgacagcctctgtatttcctccctcccagcacataacatgtttcctccaattctccagtattttataattttacccacctctcaaagcctacctcttaaaagtatcttctctatgaaacctcctcctgctactctaagtctcttcttacattccttctgtcgcttacagcttccattgtatcacccccgcccctcatgagggtgtagctatttgagaccaagggcaagaatgaggtgccttcttgtcccgtcagtgctgatcacacagcagcactcaacagcatgttcttgaaatggttgaacacagctgatgttgcctactgatcccagatcattgatgcatttcacattaccttttaccaagcacctcctaggcataagacctgtattctactgtgaagggttgtccctctgccaatccagactttctcttaaatattgtctcaaaagcttcaattctctggctcattgttatctgtgattacttgtctgctacatgtgtcacatcaccccctgaacatttggctaagttctaatatgtagtcagaatagaaaacactccctgaacagaggggaacatcacacaccggggcctgtcaaggtgggggactaggggagggagagaattaggagaaatacctaatgtagatgacaggtcgatgggtgcagcaaaccaccatgggatgtgtatacctatgtaacaaacctgcaccttctgcacatgtaccccagaacttaaaagtataataaaaaaaaaaaactgttaaaaaatgtgaaaaaaaaactgcactcccagaactttaaaagttccagtctctgaaagccatgatgccattacaatgagacaaaaagaagaccttcaaaagcaaaatttggggaagttgtcttttccatagctccttgactcacgcccatggggccgcttctggtttattctttttgagaggcttgttatggatattgttacattgacatgagggcattggaaagacagatctaatccccccaaacacacttgtcatatacacccacaaaataaatgagacaataaaacaatgaataacaaatgattacagctatccttaaaattaaatagtaacctgcaataaaatgggtgaggactcagtttagagaaacccttccttagaaaagttggttgcattcagattctaaaagttgaccttcagtagaatctaagcccttggcatttgttttattatctttccagagctttacactttattgtaagaggcagctaaagcaagtctctcttgttcctacacatttctttaagaactcagttcacttccctatagcaagtgccacccaatgctttccctaaaagctcagtccacttccctatagtaagtgccacccactggaaactagcaaagcattccaggatttcagtatttctgagatgccataagagcactggggggaaaaaaaggagatgaagaagggtattgggtggggaaaatcttacctcaacttctgactggcggggacggttattttattaagcttgtccattctgtttggtaattgtaagagacacgaataactgtccagtggtcacgtcagcagttcctggccctcctagggagcagcatggtaagcctctggtctcaagggttccggccactcaagt

SEQ ID NO: 1547 - DNA, 79819 bp, Homo sapiens; identical to SEQ ID NO: 1546

SEQ ID NO: 1548 - DNA, 79819 bp, Homo sapiens; identical to SEQ ID NO: 1546

SEQ ID NO: 1549 - DNA, 79879 bp, Homo sapiens; identical to SEQ ID NO: 1545

SEQ ID NO: 1550 - DNA, 79819 bp, Homo sapiens; identical to SEQ ID NO: 1546

SEQ ID NO: 1551 - DNA, 79819 bp, Homo sapiens; identical to SEQ ID NO: 1546

SEQ ID NO: 1552 - DNA, 79819 bp, Homo sapiens; identical to SEQ ID NO: 1546

SEQ ID NO: 1553 - DNA, 79819 bp, Homo sapiens; identical to SEQ ID NO: 1546

SEQ ID NO: 1554 - DNA, 22493 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtacgtactatcgggtgggaagcgcggcccgggctgggtgtgaggggcggggacctgagtgagtagaactccggagaaaccctgggggagtaagcggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccggtacgtcattggttatttgtcatacggcagtggtgggggatggatttaccagaaagatgatcagcttataattcagagaggtgacgtatcctataatattgaccactcatgaaatgcttggtcagctcggtgatattacttcatccctattcctgcagcagtcttctcgaccgagttccaggagggatttaagctctaatgccctaaggcatccattgaatggaatgaattaacttgctgtgcacccaaaatggtactatttatgtaccatccttgggagaactgagaaaatggtcactcagagcattttctgtgttctgtggtttagatgaggccttagatgagaaaggctgcagggctccttggatatgctttttcttttacctcctgtttcagaaatataggggttacccccaaatagtgctctcagcactttcctgttcatgcttttcctcaaggatctcttcacactttcattaagtcgcttctataaatatgacttctttgtatgtatttgaaacttgggcccctctcttaactcttgtttacttctccatctgctagctggatactttgacgtggctgttttgcactaatctcacgtaaggcatgtacataaatgaaaacatgtctcatcctgttaatggtggtaggtcactctgacttgaaactttgaaattgctctggactttttcctctctctctccttccacctctaggggattctcctatacaattccatctccttgtaatttcacctttaaaacagctgttgaaaggctggttcacctccagtcttactctttcaacgcatctgtcccgctgctgtcacatcactgtcccaagataaagcttcagtcatgtcattcctgaactcagaaaccttaaatagctcctcactacttattaacaaaggtccaaaccattaacttggcatttagaggcccttactggccttccggtcttaaagctcactattgctatgctgcatatgccccatgcctctccagaagtatcctgtactgtattccagcctttcctcatgctgctttctttacccatattgcatccattccactcctgccatagatttcttccccatttggaaatagtcctcacagattgttggtgggagtggaaattggtgccaatttcttaggagggcagtttggcaatgtctgtttaaaaaatgcataaactctttgtcccaacagtctacttctaagaatttatcctacagaaagtgacacaaatatgcagataagcaaggaagctcactgcagcattgtctgaaatagcaaaaagtgaaaataacctaaataatccatctatgggggactggttaaacaaactatggtagaattctattctgctaaaaataatgtagtagatccctatatgttggtatggaaagatacctaagatatatgttttaaaagttgcagaatggtatgagtaatatttcgtttgtcataaaaataatatatgcatagatacgcaaagacaatttctggaaggctctgtgagaaactccagagtagctcatgctggagttagagggtaagaagaagtatttttacttttcagtttgtgcctccctctgtagtgttttaagtttttacagtgagtaacactcgaatagacaaagagaaatgaaaactccatccattctttgagccttagctcagtgtccacacttcctttaggaatttttcttagacttccctaatgaaagtcgctctcccctgaatttccataacattttctgtttctcattttctgtgattcctcacttctcatattctgtgattgctcgtattgtgcccttccagggaaggagacttgccttatttattgttgtaatctcagaacctggtacataatatagatgttcagcaaacctttctcgtatgaatagaataaggaccctccctttcttcttctttactctcgcacaataaagcaccttgaacttagtaattaaatatatataaaaacttgagtgacttcttaaccattggaagcagagggtaaaagagagaaaaacaaaacaaacaaacaaacaaaaaatgagtaactgagactcatccaataattaaccagaacattggggtgggaggagggtttgtgagttaaaatgtatgtatatattgttaagcgaagtgaattagttgttattccttaaagttgaaatgcccttttttggggtgttcctatcataaaacattaagaaaattgttttctatatttattaatacttaaagttgctgattgcattgttattttaatcaagccttaagcaacggcataattggtggatataatttattcacttcctatacagttggtacattaatatccctaagtgcttcacttttctctctctctctctctctctatattttttctttttttggtttttgtatttttattttatatgtggagtgcttcagtttctagttagctcttacctatttgaatgttgccttgcaactttgagaagtccaaagtttgttcatgtgtttcgtagggttaaaataaaaattatataattttattttgattttcaaaaagcttacttcgaatatgatagcatgttgttttcctcaatctttttttttttttttttgaggcagagtcttgctctgtcgcccaggctggagtgtagtggcacaatcttggcacactgcagcctccacctcccaagttcaagcaattcttgtgtcttagcttctcgagtagctgagcttacaggcatacaacactacgcccgggaaatttttatatttttagttgagatggagtttcaccatgttggccagactggtctcaaactcctgacctcaagtgatccgcccacctcagcctcccagagtgctgggattacaggcatgagccactgtgccaagactgtttttctcaattttgccaaaatttaaatctgtggcacaaattgtacttagaaatgtgtcacaagcaatgtgttgtgataactgttctatagagtgatgtaatttgatgttactgatggttaccagactataattgaagagagatgtttcagagtttaatattaatcataattttagtgtataattttagtaaagtgaccatcttacttttttttctctgattataaatcagtgattccatcttacaaaccattaaaccctatttagaaattgtatttttcttggtaggaatggtgattgatattcatcttagatgtttttgaatacctggcacaatgcttacacttttattattcaaaggaaagtgatgaggcattgatctcagcatcaggtctagatttatacacaagacaatgattatacactattttctatggtaaattaagttgctgaatcttaagagagaagaaattcttagaaaatccctcttctcctccctaacaaataacacaaccctccttttacatgtaaataacatatcgaactatatcaaaatcgatgttgacctacatttttgtttccatagaattgaaaacatactttattttaggcattgcatttttgtttatataatttcttcatgcttttgaaagcaagaatgctttagttcagtgaccgttacccacgttttggcctcaggctcctttattttatttttatttttatatctatttatttttttgagacagggtctcgctccgctgcccaggctggagtgcagtggtgcgatcatagctcgctgcagccatgaacttctgggctcaagttatcctcccacctcagcctcctgaatagctgggaccacaggtgtgtgccaccgtgcccagccattctgggcttgagcaattctcccaccttggcttcccaaagtgctaggattacaggtgtgagccactgcccctggccctcagactcctttgataatccagtgaaaactataagtcctctgccctgaaaaatatataaagatacagaattttgtgtatgttaatgttcatttatcatagactttaccttatagtagtaacttaaaaacattttttgaacattcatgactcattttttagaggaagctcagaggtaaaagtttaaaaagaaaagaaggatacctgtggttgggagactgtgtgtgtgccctcaaccccatttgtgggctcctttctacctgctactccccaacctccttttattagctgtgtcaatttgaaaggttccggctggtcagagtgcagtggtgtttacaactaattgatcacaaccagttacagatttctttgttccttctctaatcccactgcttcagttgaccagcctaaaaaaataaaataaataaaaggttcctaaatttgatttttgctggggacaggtttaagtgacacttctccagatgaagggttaatagaggacttgactatagaagacaaagcagtggagcaactggcagaaggattgctttctcattatttgccagatctgcagagatcaaaacaagccctccaggaactcacgtaagctaataaaaaaccagatatacactcatttcctctgtggcatagtcacaatttgtataattgtatactgtgttaagacataatattttttaacatgcaattataattgagtatgtctatatctttattgatagcagatgggaatagaggagtacatagtattctaaatgtaaaaagtgaaatgaatactcctagggtgttcgatctcttctaagaagtactcctaaatcttacctagaatctgtgattaggtttggcatttatcattattttatgaaagtattgcctattggggattgttcaggtggagatacacctgtttctgagtagagttgaaaaattgcctccataaaagtcacgcttgttttcagttgctggttcaaataagttgccagagatctgtaagtatcttttctgagatgatctgtttcattcccagtagataactttactagtaagtaaagattagaggatatgttaagaaaacagtttaagatagaacagaacccatagagtgggatcagtatacaaaaacatatactctggctttatcagctcccatccacagacaacacactcagcttctgcctcctcctgggtcgggacctctctggatagcccaggctggcctgtctgtcatttctttctgtggtggtcagctttacactggctataaactgctgctgctctgagacctaccctttgaaaacttacttaagaggcctttattagggcaaaaggagaggaataataactgtgcttattttataattataagtaatgttataatccttagtgttaaggtgctaaatgcatataaaagtggtactgaggccaagtgtggtggcttacacctgtaatcccagcactttgggaggctgaggcgggcggatcacttgaggtcgggagttttagaccaccctggcgaaaccctgtctctactaaaaacacaaaaaattagctgggcgtggtggtgtgcacctgtagccccagctacttgggaggctgaggcaggagaatcgctcgaactcagggggctgtttgtggtgagctgagatctgcaccactgcactccagcccaggtgacagagtgagactctgtctccgaaaaaaaaaaaaaaaaaaaaaagtggtactgggttattctaagactacatgtgtactactatagttagggagttggcaaccttctcagttttgtgctaatcccaaacaagattttttttatccctagcgcgcgatataccttatattttgatgccaatcaatctttgttgttgtatgaggtgtgatagatggaaggtaagaaactgcaagcgaacatatctgaaaaatactttacttgcaggaagctgggaatcaagttttaattgcagagtttaattgatgatgatattgtctaaaatttagtgtttcgaatagcccctacttatcttcttaggcacccagacaacaatgattattttgacgatgatagtaaaattagctactgtttgttattatatgtactatatgcccagcactttaacatatctcagttactcctgacaccaactttatgaagtatctagtattatccttatttacaattgaggaaactgaggctcagagaggttaagtaatttgaaaaagattacacaggtagtagtagaattagctattgaatatgatgcattagtagttaatatgcttcttgactgttaaggaaaggtaaacaaatttcagagaaaggaaaaagagagtatttcctcctcttttccccatctctccacaaatttcactattaataaagatataggggaaagagtactggactgagagccacctggattctagtcctggctctgccatcaaacctttggtaaagcctcttcaccattatagaaacaggtccacagagaagtaaaggagaaggtagtggtaggtagggattaagtttattttgtagctaacaatgagtaaggaagaccaagaaaaaaatttagctttatatataagaaaggttataaatattcatttatatgtatttatcattttaagaacattggaaactaaaaaaacaaggttctgggatccaggcccctaaagcagccacagaggtgcagttgtcagtggcctccatggagctcccttcgagataattcacacttggaacttgtaaggaagtagcttttctctcagataatcattcctcagacactgcattaaggcttcacaaacattgtcagcatatttactgtaaattatacaaagcttcaagggaatgaagttgagtcatcttttctgccccactgtattctctggaactttctccctttttttgagactgagtctcattctgtcatccaggttggagtgcagtggtgggatctcggctcactgcaacctctgcctcctgggttcaagagattctcctgcctcagcctcccaagtagatgggattacaagcgcgcaccactccgcccagctaatttttttgtatttttagtagagatgggtttcaccatgttggccaggctggttttgaactcctgacctcaagtgatctgcccaccttggcctcccagagtcctagggttacaggtgtgagccactgtgcccagccacattctctggaaccttctttgagagtggccagacttatgggtcaggaaagcactgtacttaaaattatagttgtattataaagggtacagatcaggacaagccaatgcagagacacacagggtagtgcctgggaggttcctgaacacaaaacttttgtttcctctcccagtgagaggaaacccccgctgccagcacatcagtgtgttcagcagcttggtgttcgaggctgcagtgaaccatggtcatgccactgtgccctagcctgggtgacagagtgagaccctatctcaacaacaaaaatttagtcttttaatctatgtacttggaatgtctctattatttagaagttctttctttgttatttttcattagcctcccatcttgaagctctaggggcccatcatgagtcactttattagtgtaaactcaggtgtgatccaaggagctcatggataacaaagacacttctgtcacttggaaaattccaaggattttagaagctctgtgccagaaacctgggacaaagatcagacaaattctttgttagataacaggtgtctgttcagatcttttgctcattttaaaattggattgtttttcttattgttgagttttaagagttctttgtatatttttgatatgagtcctttatgtgttttgcaaatattttctccaagactgtggtttgtcttattactctctttacagtgtcttttgcagagcaggagtttttaattttaataaatttatttaataaataagaaaaaatatagtcggttttttcttttatgaattgtgcttttggtagtgtgtctaaaaactcatcaccaaaccaaggtcacctagattttctcctgtgttttcttctagaagttctagttttgcattttacatttagacctatgatttattttgagttaattttgtttgtttgttttgagatggagtttctctcctgttgcccaggctgtagtgcaatggcacgatctcggctcaccacaacgtctgcctcctgggttcaagcgattctcctgactcagcctcctgagtagctgggattacaggcatgcaccaccacgcctgtctaatttttgtacttttagtagagccggggtttctccatgttggtcaggctggtctcagacctcaggtgatccgcctgcctcggcctcccaaagtgctgggattagaggtgtgagccaccacgcccggcctattctgagttaatttttgtggaggcttgtaaggtctgtgtctattaatagatgcatttctttgcgcatggatatccagttgcttcagcaccatttattgttgttgttgttgtttgagacagggtctcactctgttgcccaggctggagtgcagtggcgcagccttagctcactgcagcctccatttcctgggctcaagtgatccttccatctcggcctcccaagtagctgggaccacaggcgcacaccaccacacctggctgatttttgtattttttgtagagatggggtttcaccatattgccctggctggtcttgaattcctaggctcaagtgatcctcctgccttggcctcccaaagtgctgggattacaggtgtgagccactgtacctggccaccatttgttgaaaaaactatcctttctccactgcattacctttgcacctttgtcaaagagaagtttattgtttttgtgtaggtttatttaataagggttttctattctgttccattgatcagtatgtctgttcttttgccattaccatgctgtcttgatttctgtagctttttgttgttgtcattgtttgttttttttttgagacagggtctcactgttgcccaggctggaatgcagtggggcgatctcagctcactgcaacctctgcctctcaggttcgtgattcttgcacctcagcctcccaagtagcgggattataggtgcgcgccaccacacccagctaatttttgtattttttatagagatggggtttcaccatgttggccaggctgatcttgaacttctgacctcaggtgatccccagcctcaggctcccaaagtgctgggattacaggagtgagtcactgtgcctggccagatttctgtagctttataataagtattgaaattgggtactgtgagtcttccaattttgttcttcaatgttgtattggctcttctatgtctttgcctttccatatgaactttaaaacagtttgttgatatctatacgataacttgctgggattttgattggggttgcattgaatccttagatcaagttggaaataatttgcatcttaaaaaatattgaagggctgggtgtggtggttgatgctggtaatccaagcactttgggagcctggggcagaaggatctcttgaggccaggagttggagaccagcctgggtaatgtaatgagaccctgtctctacaaaaaaatttaaaaagtcagcctggcgtggtggtgtgcacctgtagtcatagctacttgggaggctgaggcaggggatcccttgaaccaggagttcaaggctgcagtgaactatgatcatgccgctgcagtccagcttgggtgacaaagtgagaccctatctgaacaacaacagttgagtcttttaatctgtgtacttggagtatctctctattatttagattttctttgatatttttcattagagttttatactttttgcatatagctcctgtatatattttgttatatttgtaccaccatatttcactggggatggggagctactataaatggtattgttttttaaatttcaaattcattgctggtacataggaaagaaattgacttctgtatattaaccttgtatcctgaaatcttactatacttgcctattagtttcaggaggtttcttgttgaatctttgggaatttccacataggaaatcatctgggaacaaagacagtattattgctttcttctcaatttgtataccttttatttctttttcttgtcttgctgtattagcttggacttaaagtatgatgttgaatatccttgatgaacattgatgcaaaaatcctcaataaaatactggcaaaccgaatccagcagcacatcaaaaagcttatccaccatgatcaagtaggcttcatccctgggatgcaaggctggttcaatatacgcaaatcaataaatgtaatccagcatataaacagagccaaagacaaaaaccacatgattatctcaatagatgcaaaaagcctttgacaaaattcaacaacccttcatgctaaaaactctcaataaattaggtattgatgggacgtatttcaaaataatagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttataccccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatataaatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatacccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcagcattattcacaatagcaaagacttggaaccaacccaaatgtccaacaatgatagactggattaagaaaatatggcacatatacaccatggaatactatgcagccataaaaaatgatgagttcctgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatacgtaactaacctgcacaatgtgcacatgtaccctaaaacttaaagtataataaaaaaaaaaagtatgatgttgaataggagttgtgagaggggacatagcttgttctagttttaggagaaaattatgtagtttctcaccctaaatgttagctgcaggtttttcaaggtattccttattaagttgaggaagatcctctctcttcctagtttgttgatggtttatagtcatgaatagatgctggattttgtcaaatgctttttctacatcaattgataggaccatgtaatttttcttctttagcctgttgatgtggtagattacattgattgaatttttgaatattgaaccagctttgcgtatttggcagaaattttacttggttgtggtatgtaattctttttacacattgttggattcaatttgctaatattttgttgaggagttttatatcgatgttcatgagagatactggtctatagtttttctttcttgtaatatctttatctggtttggctttagggtaatgctagcctcatagaatgagttgggaggtgctccttttgcttctgcagttgttgccctttatccaaaggaggatatgttccaagacccctagtggatacaatattttaaataattttgtgcatgaaacaaagagttttgactgtgacttatcacatgaggtcaggtgggtcattcattgtccaaatgtttcaggttttgcaacattttggattttcaggttatggatgtcagcctttatacactatgttttttcctatacttacatacctatgataaagtttaatttataagttaggcatagtaagagattaacaacaataactaataataaaatacagcagttatactataataaaagttaagtgaatgtggtctctctttcaaaatatcttattgtgctgtacttacccttcttgtgatgatatagcacagctgcagttgactgtacgtgcctaaaactgaagaaagcaaaactgcagataaaggaggactgacatattttctggaagagactgtggggaattggtatcacgtcttccttaaatgtttggtaaaaattaccagtgaagccgtttggtcccggtactgtcttttttggaaggttattacttactgattcaatttgtctaataaatataggcctacataaactttttgtttctccttgtataagttttggtagtttgtatctttcaaagaattagtccattccatccacattatcaaatttatgagcactgagttgttgaaaatattcatttattatccttttaatgtcatgggatcagtggtgattactgctctttcatgaataatactaatactttggggtttttttttcttgattggtctcactagaggtttatcaattttattgatcttttaaagaaccacctttttgtctcattgatttttttgttttcccccttctattgttttctagttctaacagcctatttttgctgtcctgtgtatctcagatggttgacttgctgggttttcctctcatccattctgtatttcactttctgtgatctctagtccaagctggagggacaaagttatttatttatttatttatttatatttgtagagatggggtctcaccctgtcacataggctgtagtacagtggtgtgattataactcactgcagtttctaactcctgggctcaagcaatccttctgcctcagcctcccaagtagctcggaccacaggtgtgtgccaccacacccagctcattttttgtgtgtgtgtgtgttttttttgtttttgtagagggtcttgctttgttgtccacgctggtcttgaattcctggcttcaagcaatcctccttccttggcctctcaaagtgctgggattataggcatgaaccactgtgcccagccaagagacaaatttatgacctgtagggtatgccagactcagtgctggatagtagagatgttgtaattgccctgagcctgttcgttgttatttcttttttttttttatcattattctctagatagcacagttttacaagcaaatgacatatttttctttgtagcattctttaaaatattcaggtaggtgacccttttaatgtcacttattcctgtgatcctaacattgattgatgtgtaaagaaatatcaaggaagttggcttctcttcctcaatgagttttgaattagaattgtaatgagaaacattagaaattatctggtctgatcttctcactttgtaaatgaggagatttaggccagagaaataaactgaatttctaagatcatatagctaactggctgttggccggggaaagctatgatttccagtcctgtgcttttttcatcttactgcttaattattctttttgacttactatcccttgatacttcatcttcctcacctctaatctgaaaaaccattgttcctcatttcctttatgggaatgttgcaattttaagatatataaaacattgaacttcttgggcaaaatactataaaaaacttcttttttggaataatacagagagttgttaaaagtaacaagtaataaaatacttttaaatgattggattattttagttattagaaattgaagcaagaataaaagacacatttagttatcagaatgtggctttagaatattattttgaaaaatcttattctatattaaataaaccttagagagttaatacatttcctacttaactaactgttaccattaaccaagatgaatatgattccttttaatggaccggcactttaaatatgtagagtttgtcttggctgtgtgtttttgtttcagacagaaccaagttgtattgttagacacactggaacaagagatttcaaaatttaaagaatgtcattctatgttggatattaatgctttggtaagtatgatttagttgatgtaatttaatgacatcttgtcttagcaatagctaagacttagctaagcaatagctaagattttaagcttagaatttgtctttttaacaagaaaccttgattgaacttctgttgtgttgaattgttatctttcaaatgttgaatttatagtaggaaatttaacttatttgtgcatttggaatagatctgcttataattgaagacttagaaaagagaacttagacttggcatagtggctcatacctgtaatcccagcactttgggaggctgaggcaggaggattgcttgagcctagcagttcaagaccagcctgggctacatagtgagaacccatctctacaaaaagtaatttagaaaaatagttgggcatggtggcacatgcctgtagtcccagcttttccagaaactgaggtggaaggattgcttgagcccaggaggtcgaggccacaagtgagctgtgattgtgccactgtactccagcctgggtgacaaagggagaccctgtctcaaaaaacaaacaaacaaaaagagcgaactggaagtaatgaacctttggggtaccattttttttttctttaaagaaagtgcatttctctttaccaattacatggtttcttaaattagcattttatttaattatatggcatattcataatgctataataaattaatgctataggctgaagtggacgctttgagaatgatcagttatatctttcaatataaatagttgaacagttgaatttcatcagaagttctatagctttttgatgagaggaagtgatactctgtattataagaaacaaggaattaaccaaaaaaaggaacttgttttgctacctttattttctgatgaacattaaaaatagttttgtttgtgggcagggcacagtgacttatgactgtaatcccagcactttgggaggctgaggtaggaggattacttgaggcgtgcagtttaagaccaacctggccaacgtagcaagaccccatctctattaagaaaaaaagaagctgggtttacatgactgtagccattcatgcatacctcaaaaaaatggacttttctttggacaaagatggtttactaatgttttccatttgtaacaattaaaaacaaagttcatattctctggcattagaggcctgtggaagtaaatacagagccatctgcccagtagttcctggtttcttgcgagggaggtgggcaaggctacactgacctatttttgtgttccccactgaaatcctgttgcaacagaaggaatatttgttgaatgaatgaatgttgaatgaattaaccaagcagatgtaatactgttgctttagtctgaaggggcaggatggagtcttcctcttttttcttctcttagtcaagagtagtttttattatcatctgggaactgaaaactggaaggcccaggatatgtaaaaaggcactgtaacttctgagctaatcagacaatgactttacttgcagctacattaaggctgtgaatctctctactgacatttctttcatttcttctctttctgtaaccttgtctgaaaatagggtgcttttctccttctctctgacatctctaggcttgcatcatcctcccatcttctcctgacataagacttcattttagattatgcaggttggctgagttgtaaagtctgtacttaagactcctcaagaaggaaagtgtcctcacagagatcattctgcttagtctgactaaagcagcccaaggaatggattaaacttgtccacagtcctttctgtccagggctctgtggccacagtttgggttttccttatgggcagacacttcacttaaactgtttcatgtgctctggctcagtctgtctcttgtaaaggcagagagaatgttttacttttcttaaatgaaactgatagcattattagatagtcttatctgaaattttagaattatatgtttttaaagcaaaatattgtctatgcccatcttaatataaatgtctattttatgtttagtaacacttttgtcaatctgaactaaatcaaatgtctttcaaatcctactaacaatataaggaaatctttattttggaattaaaatgtgaagataaggctgtaaaaattttgaccaatttaggaagcacaaactatcatttatatattgccttatttattcattttgatattttagtctattttaacttgacttttcatttatttttccatgttaagtttgctgaggctaaacactatcatgccaagttggtgaatataagaaaagagatgctgatgcttcatgaaaaaacatcaaagttaaaagtgagttgaaaattctttcacattctttacaaaagtagaggtttaattgttttttgttgttttttttttttttcagtattctttttttttttgagacggagttttgctcttgccgcccaggctggagtgcaatggtgcaatctcggctcactgcaacctctgcctccggggttgaagcgattcttctgcctcagctccccaggtagctgggattacaggtgcccgccaccacacccacctaatttttgtatttttagtagagacagcgttctaccatgttggccaggctggtctcaaactcctgacctcaggtgatacgcctgccttggcctcccaaagtgctgagattacaggcgtgagccactgtgcccggccagtattcatattttgacttttataccctcatatacaatagcataattcattcatggtacattgttttctttttaaaaatgtcattgtttaagaaatattagagacagggtctcactacgtttccgaggctggtcttaaactcctgagctcaagcagccctctggcctcgacctccctaagtgctgggattacagacatgagccactgcgtgcagccttaaaaatatcatttttttttcaactgcactctgagcatttttactaatagctgggctgataggcttagattctctggatatgccctacagttctcatttaataagagtttagagcaacaaatttttttgaatcaaagggaccttaaattatcccaaatttaaatgtccaagatgaagtttattagtgtgaatgaattacctcaaagcagagcactgttattttcaaattaggctaaacctgtaacccctgattgctctcttggtttttaaattttttttttaacacagaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaatta

SEQ ID NO: 1555 - DNA, 36778 bp, Homo sapiens
gactttcaagctttctagtaattttattttatcaaaacaccctcccctcccatctttatgacaccatttcattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaatttcaggcacaataatttcttggcctttgctcagaagccactatcccagggaatcaaagaagaggtgcattcccagatgtagagaggggcctttttgtattgagtgggagcacaaaggctccagggctcctaagcttgggatttcctctgagaaagtgaaattggggcttgtggagaagagaagtagaaccaagaagcttattggcgagctcaggattcttcatccatgacatctagaatattgctcagaagaattttgaaagtgggacgctcatctgctttctaaaaccaaagaaaaagtaaagtgttagagtggctagaatccagaattcaagggaaatgcaatgagtaagcagcaaatgtttattaaatatatgctctatgcccagtagcatgccctgtcgattacaaaaggaaaaaaaaaaaaaaaagaaatagcagctctccataaagtctttgtgcacttttcatctttagtaactcaggttattagtgtgataagaacaatttgcaaattaaactgacaatcacactgatcaaaattgagggcaagttcattatgtaactgtatacaacacattcttattttggatcctcaagtgaaaaatggctaccaaacaagttcaagtggttggcagaacagaaatcccatgtgataatttttagtgattaatatttcaaaaccacaggctgtattactgagcagggattctgagtacctgggacctttttttttttttttttttttttaccactggtaacaaaaagactaaggtttttttttttttttctttttgagacagagtctcaccctgttgtccaggctggagtgcagtggtgtgagctcagctcactgccacctcccaggttcaagcgattttcctgcctcagcctcccaggtagctgggattacaggtgcacgccatcacgcccagctaattttcgtatttttagtatagaccgggtttcaccatgttggtcagactagtctcgaattcctgacctaaggtaattcccccgcctcagcctcccaaagtgctgggattacaggcgtgagccaccgcgcccggcctacgactaaggttctttttgatggccatggcccataagcccccgaggtatttggtatttagtggttcagggaacattcatgccagaatgctctcaatctgttagaaccaatggtcatcaatttcttgattccttgactcagtgattcttaaacttagctgagtatcagaatttcctgggaagtttaaaaagagatttctgggttccacttcaggcatagctaatcagaatttctggagaaaagtcccagttacctgaatttttttttgtgacacagtctcgctctgtcactcaggccagagtgcagtggcaggatctcggctcactgcaacctccacctcctgggttcaagtcattctcctgcctcagcctcctgagtagctgagattacaggcacacatcaccacgcctggttaatttttgtatttttagtagagacagggtttcaccatgttggccagaatggtctagatctcctgaccacgtgatccgcttgccttggcctcccaaactgctgggattacaggcatgagccaccatgcccagccagtaatctgcatttttaagagctccttagggtttctgatatgcatccaattttgaccactcctttaaacaggctgtggataaagtacctgtctgaaatcatttttaattagcagagtaagaaggtcctgattgggagggagcatagccaatcacccttaatcctgcatcacacagaagaaagaaggagtcctccctttctgcactttctctgtgatctgtcatttgttcgagggaaaccagccatgctcggatccagatacccacttttcacctcaccaagaaggctccagattcacatatgcacttgttggacactctgaagagttgagcatttatttcctactagaaatttaggttgccaaggatctactgaaaagtagagaaggcatcttgggaagaactcgaggtaagaggagcaaagcagtttaatagtagtaggacagatttccttatttccaaaataccacacctacccacataccccacgatgcaccatattaaaaagcaaaacaaaacaaagcaaacaaaaaacccactacctgttttagttccctttcaagcagtaggttttaaaaaaaatctcatttagccgggcgctgtggctcatgcctgtaatcccagcactttgggaggcagaggcgggtggatcacaaggtcaggagatcgagaccatcttggctaacacggtgaaaccctgtctctactaaaaatacaaaaaattagccgggcgtggtggcgggcccctgtagtcccagctactcgagaggctgaggcaggagaatgctgtgaacccaggaggcggggcttgcggtgagccgagatcacgccactgcactccagcctgggcgacagagaaagactcggtctcaaaaaaaaaaaaaaaaaaatctcatttaggacctcagccagaaacggttggcagctaataaagtagaagaaagggccaatgacacacaaaggaatgaacaaactttcatgacttttcttttgtaatgcccattcacttgtctgaatgcctctggctgcctgcttatgctagatgacatggccccacaacacctcactccctaaagctgagctggcattggagtgtactaatgacactctagtgagaatcggagtgggcctgggaaagcctctggccatcagatgatcaagttgcaggccaaggtcagagaatgtgtgcaaggcctggcgtggtggttgatgcctctaatcccagcactttgggaggccgaggtgggcggatcacttgaggccaggagttcgagatcagcctggtcaacatggcgaaatgccatctctactaaaaatacaaaattggccaggctcagtggctcacgcctgtaatcccagcactttgggaggccgaggtgggtggatcacctgaggtcaggagttcaagacctgcctggccaacatggtgaaatgctgtctctactaaaaatgcaaaaattagctgggcacggtggcatgtgcctgtagtcccagctactcgggaggctaaggcaggagaatcacttgaacccaggaggcagaggttgcagtgagccaaaatcgtgccactgcactccagcctgggtgacagagcaagactgtgtcaccaaaaaaaaaaaaaaaaattagcttggtgtggtggtgcacgcctataatcccagctacttgggaggctgagacatgagaatcgcttgaatctgggaggcgaaggttgcagtaagccaagatcgcgccactgtactccaacctgggtgaaagagcgagaccttgtctcaaattaaaaaaaaaaaaaaaggaaaaaaaagaatgtgtgcagctatcagtctttggtggctgaatggccagctaaatgggcaagtagattcaaggaaataatttaagagatcctaataaagcacttacctcatgccagcaactgtacatgatggtatataccttctctgaagccagatgaggcctgtagagacgtaggccttgggcaatgtgttcagcagtctcactgttagtaaatctctcatatggcatcttccccagggagtaaatttcccacatcaaaacccctagaaggtgaaaaaaattattaaattggtttgcagtctttttggatagcaggggtcctagtcttcctagatcaacctcaaagattagaatcagttggttccccgctctgtgctttttatattttgcccaaatttctgctatagtactgaccacactagatggagatcaaggtcgtactagactattaactcctctagaagagagacagcatcttatttgtctttgcagttatagggtctggcagagtgcctggtacataatcagtattcagaagctgttgaaaactgaatgaattgttttccttaacatggtttaagttctaaaaaggcagagatcatgtccagtttagttttcatcctcagaaacccctgtggtggctgacacacagtaagcactccccaaggattggaagaatgaaagcaagaacaatatctctgtggaggttgcaaagtgtgaattttcccattgcatttcttatcctttgagctgtataatctgtgtaatcttatccacttaccaaaagcccaaatgtcagatttgctgctgaacttgctatacatcaggacttccggtggggaccaccggactggaaatttggagcctactgagcttgtgtattcatcatccaggacatacctgcaagggattcaggacttgttgcattaggatttggaggcttgatatttgcttacgttttcttggcacggtcacaagagtgtcacaaacacacacaggctttctcaaaagtctctcctcctcaactagtatcttctacaaacgttacttttaacgaatttcctgtttttgtatctgattgagctttcctgattgacaatatggttacaagaaggatgaagtgaaataagatctagtaggtactcccttcctcttctctatccacctttcctttctctgctcttctccttcccttccttttatctgcagttgtcactgggaattagactgattaagaaagaaggaggaatggagtaaagtcatcaggattaatagatcaagataaggtattggggaaatagatttaaaaaagaggaggtagagataaagggagaaaggaaggaaagggatatgacaataaaacaaaaggatgaaagaggtggcttaaataactcagaggaagaaaaagaatagaaagatcggcagaaaacgctagaatgagaaaaaaaagaaaaggagaggattaaaactgtaacacctacccatgtttcatactgtgctatttttacttctggagggaaagatgaaaaagccacactcacctggacaggccgaaatcagatactttaacaactccttgatcgtttaccaaacagtttcgagctgcctgtagtgcaaacagagaccagtgagactccgtccccagcacagaggttaaaggcacaaagcttctgctgaccagtagaatgaagccagggaagcttcatctccttcgactacagacaccttcccacctaataggaatctgttgatgccaccaagaaattttgattcatttccaccacgtggaaagcaacctgctgtgtagtcctaggtaaagcactgaggacatacagaacgattgcattctcatgggcaattccacaccaccccattccctcactgatatgctgaaagaattaagggagaggctgggtgcagtggctcacgcctgtaatcccaacactttgggaggccgaggtgggtggatcacctgaggtcaagagttcaagaccagcctggccaacatggcgataccccatctactaaaaatacaaaaattagctgggcgtggtgttgggcgcctgtgatcccagctacttgggaggctgaggcaggagaattgcttgaatctgggaggcggagtttgcagtgagccgagatggtgccattgcactctagcctgggcaacagagcgagactccatctcaaaacaaaacaaaacaaaacaaaacaaacaaaaaacaaagaagggagaatgagaagtaagtttttttgctttctgcttttctgccagtgagactaggacaatttgagccttggcctgactgaaagaaacaggggcgcaaactctgatgcttacaggggccaggcaagttaagtaagagtgaagtgaagtggatcgagattgcaggaaatggagagtacatgcctagaggaaaggaggcggttcgtgagaatgtggacctggtatttccagacggtgtagattttcaagagaagctggaaattccagggtttttttttttttaagcgaaatgtttctttttaagggtttgctaattattatataacataaaaaaaacccacacatgtgggccaaatgcatccacaggccccagtatgtgactctgaaggaaccaaatgatggccccatgccaggagcagtcccattgggaagcacagtcccttctgttccaaatccagaatggccactgaaagaccccaccattttcttgtgggtggtagggggttgggagtgagtgactgctctgattcccaccacggcagacttcatggagctgaggctggagatatttgatgggctcagcactggggcagaggcacgcctaacttatagtactttctagataaaattgaaatgatggcaccagcagcccccctcaaccatgtatgatatatcttccactgctacttccaccccatcagccctttgtcctaggccaatccttctaaggtcccaccaggtctcggtgaaggaactgctttgactccaggtattccatggcttcacagacatccttgcacatctctagcagctgctgagtctggaagcggtggcgcatctccctcaggtagttcaggaggcagccattggccatgtactcagtgatgatgaagatggggcgctgcttggtgcagacgccatacaactgcaccagcttctcatgggaaagattcctacaggaaaggcaaggaactagtcttctccttttggctctgcataatagcaataaaggggctggggaggaaggggctgacctaggagtagagcatcagataaggggtcacaccagcaagtttattttcctctttcccaccctaaatctcaaaagtgcttaaaatgtggaagcaagcagggatttggagcccatcaattgaaaaagaaacaagtccaggaatgaaagaacgctaaggctaaattagaatatttctcttgaaagtttaattttctacatctacccccaaatgctactgagatggtacacacccatgatcaccactattctcaaccaatatctaaggcacagaaactattatcttagcacttaggactaccgccagttaaaggtaaacttcagtccctcgtcccaaacctctcttactgtaagtcatctttaagcctcagtgggttgttgtgtgaattcctagactccagcaaatagattgagagttgagtttgggctataactcacatcatgactttggcttcttcaatgaattcatcttcagacatggagccttctttgatcatcttgatggccacgtcgtactggcctctccatttcccatacttcactaccccaaattgtccagtccccagctccttcaagaaggtcaggtcctttggatcaatttcccatgatcctaacaataaagtcttggtgtgattctttggggtcatgaatgtataattcttacaatagacaaaaatccctactggggtagaaataggaaaactagtaaaagggaaatttttagaagtactaatctgtctttgcttaagtcaatctcagaaacgggattcattggttagaggaatctgggaattttaggttcaaggtggccataaggcaagaagatagactaagcaacctccccaaatccctttatgattatgttagtgatggtagttaatgaactcagggatagtactgaaaattttcccacaattaaaaataaaagacaaaaagacccaagacaacgacaaagccctttatgaatctatgtttttgcagtcccagtcgtagccactagaggaagaaaatcagtgaataacttttgcttggatctgtcttgagcgtccttgaggcagctgctgcagaacagtgtacctcaaggacactccctaaggcaaggccagcaaaggtagtttttgcaactggccagtccaccctaccccagagaaataaggagttaccgtatcccaggcctgcagtggaaggtgcattcttgttttgttgagacactggatatttgagcctggatatgagtcctgaaacagagagagaggtcatgctgttggtgtggtgtaggaggtgggatgcctcacacatcctcacttaaagcctcacacttccggtgtgtatctttctagtacattttgaatcccagaagacctccatgaacccacatatttccagaggtttctcctctcacaaaatacttttcagggacaaaaaagagaaaatactaattgaaatacactgcctaactgaatatattcccacctcccagcccaggcttagctcacatcctaccttcttgatgaagctgttcccccatatccatgccctcactaatgtctcagtttttagaaattttacagtgcttataaactttcttctgatgttgtctaacctgtatgttctttgaggacaaggacctcgactcagaatgttcccgtgttctcctctagaactgaggaaatcgctgagtacacagtaggaactcaatgaatacttgctgatgaatcagtcaccagcctcttttgtgtcttctcttaacactgaacatcaatcaccaaataaagagtcagtccctgttgggtgtaggtctgcctctgaccacctctttaccagcttctacccagtatcacagggatttcctttcacagtgaattcacactgtcctgtgaggcagattcttcctcttatcaccttgtcctgcattgcttatcctggtgtctgtaactcccttctcagttgcccctggtactcacctgcagagttgtgctgatggtagttaatgagctcagggatggtgctgaaaaggtgcttctcagccaggtaatactggctctgaggtgtggaacacacaacataatgacgtatcaccccttgagggtccctgaagaagtggatgcttagtcagtaacttgggcacaaaggtcaacagaacccaggaagtgaagtgagatgagttttgagtttcagagacagaggaagtgggacgggcacagcatcaaggagctattaggagggtacccctgttctttgtcctcagggccttggaatagtagcactcaccctgtggatttagcaaacacagacactgtatatttgccagctttgctggagtctctgacaatgaaacctccttctttcccctgaaacaacgaaaaagaagctgtctgtaggaggaagtggtgctcacacctgcatcccacctgcccaaacttgagagagaaaatagaacaacccctgattttactgccaagttccacgcttgagctacagcctcattgcttttaatattaaaaggtgcaggccgggcatggtggctcatgcctgtaatcccagcattttgggaggccgaggtgggcggatcacctgaggtcaggagttcgagaccagcctggccaacatggtgaaaccccgtctctgctaaaaatacaaaaattagtcgggcgtggtggcatgtgcctgtaatcccagctacttgggaggctgaggtaggagaattacttgaacccagaaggcggaggttgcagtgagcccagatcacgccactgcactccagcctgggtgacagaccgagagtccgtctcagaaaaacaaaaacaaaaaaaatggtgtaattgggatcccagacgatggcagctttgacactgccttgcccaaaggtagggggcagaacaggccctcagttcaagatcctcacttatgcaaggagaatgctgtgtgctagtggttccacacttacctcttgctttagcagttgctcagcctgactccgagtcatgtgtttggaataccacctgtgaagggagagtgctgcttgagtggctcctggtcataagcagattggaggttacagcaccctccagggcttgtccatgtcagtgattcagtcaactcactcaaaccctatttactgagcatctgtcatgtgcatagcacactgtatccctttcccaaacccaggttggcattgaagattcatggaaatggagagtagcaggcaaaggcaagcagcagggagttgcagggaagagatcagggactagggcacttgagaacaatccacttccatgattagggaggaaaggacaacagtagcagtttgacattttaattctttcatcaggtcgtcaactcctttttctttgagtgtgattcttctggatttgagggcatggtgacctctccagctctcataaatggagggtgtttggggggtaaaggtaagacagatacactaatttgaggtggtggcatcatttgattcagatggtactaattttaatatatatcttgaaataaaaaatatgttgaaagtagaaaaaagtgtatatatatatatacacacttgtgtatgtatacataatatacctatatatacaccagtgtatgtatacatatgtatacatatatacacttgtgtgtgttatatatatatataaatatatataaaatatatataaataaataaatatatatatatatagagagagagagttcctcctggaagattgtggactgacataaacatacttactcatacatttctatggagtcttctgcttcagtgacatagttactaggaatgtagccttcctgcctgtgaaggaaacaatgtggcagttcatccagcacctccccagcctccaggagacagattcatatgcccacgtccctgagctcagaacaaatctcaaatggaggtatatgtatcatgcacctccctcaaagacaatcatgtctctgatgcatggttaggcagtgagccagtgaggtgcagagcttatgcacatgttgcattggttatatgtgcccaacaacagaggctcagagatgtggcagaggccatgtatagggagctgcacgctgggaagtacttggagggagagcatgttcagtctggtgtgggaagaacagtctctgatgaggatgctgatcacgggaattatgccgcagcactttttgcgtgtagggagtgggcaggcaccaggctcaggaagggctggtgtggactcacccatttttatctcgtgctctccaccatggtaagttgctttcctccaagataaaatattcatcacccttccgcagctgtagatcatttgcattcattggcatgtaatcataaagggccacaacctttttcagctcacttgtggagactggtgctgctgctggctcaggcggtagtggctttttcaagatctatgtagttaggagaaaaggtaggagggtttgtcaagataccaagcactcttctcttctctcccaactctctggcttactcaagacacccaaatcaggcatactaaaatattactcagcagtcattcaacaaccatttttaagcaccagtgcaggagttctcagccttgcacacatataaagaccatgtatggaacttttaaattccaatgtactttcggaggccaaggcgggcggatcagttgaggccaggagttcgagaccagcctggccaacgtgacgaaaccccatctctactaaaaatgcaaaaatcagctgggcatggtagtgtgtgcatatagccccagctactcaggaggctgaggcaggagaataacttgaccccaggaggcggaggttgtagtgagccaagaccacgccactgcactccagcctgggtgacagagtgagactgtctcaaaaaaaaacccacaaaaaacaaaaaaccaattccaatacctagtcagtttcctcacagaccaattacatcaaaatcaaactctcaggaatgggacccaaacattactatttttaaagctcactagacaaaaaccatttatagctaaggtcaggaaaccggcttggcactaaacttgtacgtgaatctactaagtggctcagaaccttggtttccttctttgtaaaatgagtataataatacctgctctacttacttacaatatgtgagaaagggctttctagccctcaagaaggaaccaaaaaaaaaaaaaaaacttctgaagtgttagtgataggtggtgttagtgctaagtgttgagtatgttggtattaagtgttaaattcttctaactttactgtatgtttgaaaatactttccagctgggcacggtggctcacgcctgtaatcccagcactttaggaggccgaggcgggttcgagaccagcctgaacaacatggtgacacccccatctctactaaaaatacaaaaattagctgggcgtggtggtgcatgcctgtaatcccagctactcaggaggctgagacaggagaatcacttgaatctgggaggcggaggttgcagtgagccgagatcatgccattacactcgaacctgggcgacagagcgagactccgtctcaaaacaaaaacaaaagcaaaaacaaaacaacaacaaaaactttacattaaaaaaatcaggttttgttctaaacaggtgattggattacatggttgctgagagccttctatctttccatcgaggaggaaatcctaattagaagaacaaatcccccatcttagcaagaataccaattaacactgccaagtcccagggtaattctaagactctagtgtgttcttagggcttgactataagtttccatttaagcagtggcagcacccagtttccctgtatacctggtcctcctcaggcgttgggggaagaggcttttttgtcttccggtgagaactcccaggttttaagcctgcaaaacaagaagccagtgatgatatggaatgcactttaggaaaggggccaaggacaggtttggtcagggactttgccgtccatattgagtgcctttaggcaagttagaaaaagtagctaggcatgccaggtcacatagcttggagagcagattaccagctggatttcagcccccatgtgcctcctccctcccccaggaccctttgtttagcacccaaagtgtacaaccttatgctatgaccctgggcttgacagacccttgggagagtgatggaaacagtcaaaggagaaagaaattatatcgatcagattgcttacttccattcctgttctccaaaatttggcagcccatagcatttttggctgtctgagagcagcagagatactgcccatcgatccagaagcaagggtgatatttctgaaccagatcactgttgtaccggattactgtagcaggaaagaagagagagatcacatctgacatggaggagaagccaccatttgcatgttttcctctttgagcttagtggtgaacttcaagcaactgccccctccttggccaccctgaaggagagcagatcacaggaccagttggctcacatgactggcctgcctgactgtgccctggtcccagacagttcctgtgcagttttctttagtggtctgtgatgaggagtatctcccaatcaacaagataagactatctgatggcttgagagcccaacaacagaaatatgttatctatgttttcccagtagccattacaatgttcctgtaaggcaagtgtttcccagataagggaaacagtgtgcccaggccaatctccccagcttttaatactgatttctcagttccttgagtgatcttttagggataattagccttagtgagaacttctgcatgaggctttctgtatagaatagtcaacagagctgatctcaagggcaaatgaaggtgactttgcctctagaatcaacatgatttgaatcttcctagggccactgaggtagactgagctcattgccagaggtaacacagcagcttcattccctcatggagttgtgaggcccaaaagatctcccagagtaaaagtattttgcaaagaatagagtggatgcagagaggaggaattagtattggtgtttataatactatggcatatcaaaaaccttcacatgaagtcaattagaaaagttggccagacgcggtggctcacgcctgtaatcccagcactttgggaggccgaggtgggtggagcatgaggtcaggagttcaagaccagcctggccaagatggtgaaaccccgtctccactaaaagtacaaaaattacagcgtgcctgtaatcccagctactcgggaggctgaggcaagagaatcgcttgaacctggctggcggaggttgcagtgagccgagatcgcgccactgcactccagcctgggtgacagtgtgagactctgtctcaacaaaaaaaaaaaaaaagaaaagtcatccagggttcatagtgtcagataactgagagaagcaaagacaattgaaataactgatagcagcaaacactagagcaaagacccaggctggtccaggaacacgcacatttgagaacatatacatttcagcatttacagctaagaagaatcccgcacattattattattattattattattattattattattattattattattattggagatggggtcttcctgtgtttcccaggcaggccttgaattcctggactcaagcagtcctcccacctcagcttcccaaatacctgggactacaagcactcaccaccaggtccagtggctggcataactttttttaaaaaagacaaaaacaaaacaaaaccttccactgtagaaaacaactaaaatccggctgggtgtggtggctcgcacctgtaatcccagcactttgggaggcagaggcgggtagatcacctgaggtgaggagttcaagaccagcctgaccaatatgatgaaaccccgtctctactaaaaatacaaaaattagctgggcatggtggcatgcacctataatccctgctactcgggaggctgagacaggagaatcacttgaacccaggaggtggaggtcccagtgaactgggatggcgccattgtgctccagcctggccaacaggaacgaaactccaactcaaaaaaaaaaaaaaagaaaagaaaaaagaaaaagaaacaactcaaatccttaagggcttgctagtcacacttcactcacttaaggctttgcaggaaagcctaaaagctgctagtagctggtgcattttgcaggcaaatgaacaaaagttctttttttttttttaagagccattttggtacttttctccacatagatttgaaaacttcaaaccattctcccctacccaccctcaccctgactttttcagcactcctcttcaccagtgtaccaaggacagaatggtgggagctgttcagatagagtgcaggctataagggactgcattgcatagagggaattttttttttttgagacagtgtctcgctctgttgcccaggctagagtgcagtggtgccacctcggctcactgtaacctccacctcctgggttcaagcgattcttctgcctcagcctcccgagtagctgggactacaggcacgcaccaccaagcccggctaatttttgtgtttttagcagagacatggtttcaccatattggccaggatggtctcgaacttctgacctcgtgattcacccgccccccatcgcccctcaaagtgttgggattacaggcatgagccaccacgcccagcccctagagggaattttaaaacaataataaaaccgacccaaagtctgtctgccttttgttattactaagcactggtagagttgtgaacaatgtcattgatactcctccctgccaggattgattactcctaccacatccacactctggcccctccccgcatgccactccctgtcacctagggatttgaagatcctcaagtttgctctgtcttctgcagggctgggcaccagtagacatgccaaagaatacctaatcgacaattagccactctaataaactaagcttgctaatacgataatgaggggaaataaggcttcttgtcttccccacccctagcacactcattaagaaacctccctacattctcaaataatgtctgcctcttaagaggtcccttgaagatgacaccccttcttttgttggctaatccaaagctggtatttccagctacttaggacaggattgcaaaagcagggtgtacaagtgggagggctgggggagactgcttgcttcaccaatgcacattcccctattgggaagcactaatggttagtacatattctccaagcacttgatgggctggtcttttctatccatatttatgaggttaatgtctaaaattctgtttcaggcatacatgaatcattcctttccatactgtttgtaggagatttgccaatgctattctcttattcattttggtgaggtcaggtcatttgcctacttttgaatttgcaattaggataggttctattgagcttgaccaaagattcaagaataagtataggcaaatatttgtggtgctggaacatagaagggcccactgccatatttaaggaaatggaaagagagagtctgtggctaagcccacaggaatacaacctttgcatggcaagcaccattgagaaaatgtggcagctggatatgaggtatctgaggctatgcttttaaaattgaggtataggcctggtgcagtggctcacgccttgggaggctgaggtgggcagatcacttgaggtcaggcatttgagaccagcctggctaacatggtgaaatcccgtctctaccaaaaatacaaaaattagctgggcgtggtggtgagcgcctgtaatcccagctacttgggaggctgaggcaggagaatcgcttgaacgcaggaggcagagtttgcagtgagccgagattgtgccactgcactccagcctgcacgatagagcaagactctctctctcaaaataaaaaaaaataaataaataaaattgaggtataatttacatataataaagtgcacagatttaatgtgtacagcaaaccatatttttccacacccatttaacctccttgagatccagcacctcatgcctcttcagtcaatatccctgcaaaggtaaccagtattctcatgaggtccccttttcatgtcaatgatttcttattggtgcattttacccaagagtaggataataaaaacataaaaacaaacaagaaaaaaacaaaaagagtggaataatatcattattttgtggctcctaggctaactcactattgacattggcagcacctgggactgtcctgggattgttaggacttgcacctaaatctcccagcaatcatggtatttgtcagaaggtgcctactttttggctcttgttgttagcccaggacggttcaacaagactatacccaggtggaactactgggaaaaaaaatgcctttggtgaaacataagggaagagaaggcaaagatgtgcctagccacactccctgatcacactgatgacccagctgaagtgatggtgtttctgtttatttattttggctttatttttagcctgttgtgaatttacttagctaatgaaccttaaaagcagcacataatcaagattgtaaggttaacatctgagttaggaaaccaagctcggctgggcatagtggcttacgcctgtaatctcagcacattgggaggccgaggcaggtggatcacctgaggtcaggagttcaagaccagcctggccaacatgatgaaaccctgtctctaccaaagatacaaaaattagccgggcatgatggtgcacgcctgtagtcccagctactcgggaggctgagggaggagaattgcttgaacctaggaggcggcggttgcagtgagccaacatcacgtcactctactccagcctgggcaacagagtgagactccatatcaagaaaaaaaaaaaagaaaaaaagaaagctcacaagctcacaagctggatatccttatcttcggtcattactcacccttaaatatagtggacattcaataaatatttgttgggccaggtgtggtggctcatgctttaatcccagcagtttgggaggcagaggcgggtggatcacctgaggtcaggagtttgagacgagcctggccaacatggtgaaaccctgtcgctactaaaaatacaaaaattagctgggcatggtggcaggcgcctgtcatcccaactactcgggaggctgaggtaggagaatcgcttgaactcgggaggcggaggttgcagtgagccgagatcgtgccattgcactccagcctgggtgacaagagcgaaactccatctcaaaataaataaataaataaataaataaataaataaataaataaataaatatttgttggactaaactatgactggttttgaaattagtatatgaagtgtaaagaagttaccaacttgagcatgccagtttctcccttatttctccttcagctagtctgccttgcattcccccatttccagactaaaacctagccatttatcgatgtggagcccaagctggtgatggttgtttattcccacagataaatcagttaacacaactactgatccctttctgtgtgcaaggcgctgtatgaggcattgtggagagaactaaagaagtacaagtatacatgtcctgcagagctcttatcccagtctctgcaaatatttctgtggctggagatagtatattggttcaggacatggagtctggggcctgaattcaaagcctgaccctgccatttaccaaccgagggcctttgggcaagttacttaacctctctgtacctcagctttcttatctgtaaaatggggatgacaagataactgcctcatatggttaatacaaagttaatatatgtaaagaacttaaagaagagcctgtatcacaataagcagtattaaagagtttgctcattttgtagccccagggctaaagcagaccccttatcttaaaatatgccaagaactgaactgtgtattgcaggatatcacctatttgtaatattcaacatagctttactatagaatattttgcaaccaactacatgtgaaatttctggacttggaaaccaagcagcgcaaaactatgcaatgagcttgggctttggagtcatacagacacagggatgtgataagaatccaggctccaccattcactgtgtgcccatgagcaagttgcataacatctttgagcttcagtttcctcatctgtaaataggggaataatacatacttcttaaggctactgcaaagatcaaataagtaatacatttgaagcacttgggacagagcctgctacatagtaagtgctcattaagtgttagttatcattgttgttgtttttaggccaaggttgttgtgaaaattaaatgagataatatataaaaggtatttagctcaatatctggcacatagcaataattgaatagatgatccttcatcttcgttcctcctgttccctttcagtttgaaagacttggctaatataattttgaccaaccaaacttgcattcaagggagtgtacaaggctggtatagccagccagtgagtatcagaatctaaatgtttattaagacaaagggctgtcatgcaataacccaaccataccattatcagtctgccatccttcctgtttctctaggcagcctttcctgatgtcaactcaaccagttaatctctcagtcacttgacatgtggctatatatacacacaaatatgtgtgcatgcatcctgtgctgcaagcatttacagtcaagtttatctgaacacactgtatggttgatgtgaaatgctgaaactgttcaagtttaggtcctcacaaagcaaggaatatgaaatatttccttgggaaatatttatccacaacaaagagatgtacagtgctttcgtatacagtgatttacagttttccatgtgcttttacatgtattattacttcatttgatccttacaacaaccccagaggtagatgtggcatgaattaccattattctcctttgagaagaagaaactgagcatcaaagaagcttgttggccttcttgccagaaatcacccagtttgtaaatggtaaaagagggcttgaaaccaggttctctgactctgacttcaagcactctcatacatcatctatttaattttttggagctaggtattttatacttaggattctaaatattgcataaccattgaatgccacaccacccttgtattcagtgcaaaaaatgggacttttcttaataaatagagaaatggaggtgcctaaaattacaaaattgcactagagagatagtgatagaactgggaaactcttagtctaatattttatcttttattcatatgatggaatactaagctcaattgtattactaatattgaaacaaaatacaaactttcctttgtttctttgttatttgtctttctttcctccctcatccccttccttctttccttgcttccttccttcctgtctccctcctcccctccctctctctttcttttctccccttctatccatttttttcttcttttctctctacgtttctcctttctctttctttctcgtttctctcttccttctttccttttcctcccgtctatctcctcttccttcctttccttctttctttggaaacatttattttccaaataattctcaccgtttttgagctggtgaatccaccgcttccttagttcttcagttggggagaagacgtagagaggcccttcatcatatacaacctgggtcgatgaaaacacagacttcagcagttaggattcagaaaaaaggagaaagaccttgaaagtactaatcttaggggacaatttgtatatttattgtagaaaacaaagaaaggcagaatcttcagtcagcaatggtgttcaggttatgtgaactatctgaaggattcctgaactcttcatatctaggaatgtagcgtttaaaagctcttagaatttttcatactcttaggtcctcctgacttgtgcttcaattcatgcataaacttattttataaggtctccgtctgcccttgctggagataacatttttgtttatccaacaaagggtattttatcttattattaaattctgactttgtatagaagagaaatgaagtgataatctatataaattaagtcttgattagtacatatgggttattcacttggataatatggagtaaaattttaattcatggctaattacctccacctccactacctagtggcctcccctcaccaatattagccaaaataaatcaaatttggaactacaaacctacttcaaaaagggtaaggtatataataagcaatatcatcaagtcaaatagtatttttttaaccatgtacaaggcatcatgctaggtgttacgaagatgcatgaaatatataagatgtggttccaaccctcacagagtttatagacatcacataataaattctgaagtcaaatataaattaatttaaaattatctgctgttcagcattgttcactagtgcagccaaacaatgtcatcttgttgaaaggcattggtagtaaaaactgtgtctgaaatacccctctttcaaaggtttcgtaaatttgatatagtcagggacacgaacaagatccttttacatttttctttttgcttgttagtcttgctgtgctcataaatccatgacagaaagccccctcccctgagactttccacttccttttctggctttcactgttgcagaggctgctatattcacgacatgtggcctacagagttctcaggatgtaagcaagccaaactgaagaccaaatttgtagttcttgctctcctaaacagatgcatatgtggcacttcagctcttccagattacaacagaatttaggtttatgcataagtctaataagtcttcctcatactgaacttcctaatactactccccttttctatcttttcaacccacatgaccactattagacagatagtcagaaccagaaggaagtgaaatgctcactcaacaagcagagcatctttctcaatgcagttatcatagacaagacacactatgatagaattggtgctgctatgtattctttttgaggtatagagactaaaagaaactatgttagattaggtaaatagaaaagcaaacattcttagcccatgccagtctcatttcttggttcagcatccttgtccacctcaacttctattcactgggtcctcgtagccttccctctgccctgcaccccaccaccccttctaattgtgttacaggggcctttcgagatttggtgagagaaaataactcacctggaagggataagggaacctttcaatgattgaaatttgctccatttcactggactcttcacctcttctctgtaatgaaataagaaaaaatggttattggttgatgcattgctcttttctgaatttccttaggtactagaagccttttgctgtggcttcagaagtttctcctgcacagacaaggctgattcttagtgattactttctataggccaatagggacacatatccaatacgacccaacacatacccagtcaagagagactcaggtatttcaaatcactgggaaaatggaggtttctaaaaaattgttgttgggacaaatatttaaccactaacgttgtggggaggagaggagttaggtagctatgctacaccatacaccaaagaaaattccagatggattcaagagcttaatataaaaaataaaactatgaatgactgagagtaaatataagcaattatttatataatcctgtgggaggcaagctttttctaatataaggatgaaacttagaactattaagaaaaacctgaactaatttgatgacatagactttaaatccctatatggcaaaaagcatcataaacaaaattgaaagataaaggataaactgaaaaacattttcaacatactttacagttaaaggataaatgttcttatatcaagatctctttaaaagtattagaaatgaggtaaacatctcaatgtaaaaaatggaccaaaaattaatgggcaattcacaaataaaatataaatgagcagtagaccaactttatgagtaaaagaaattgcaaaataagttagcaataaaatgctattttttttttttgagacggagtcttgctctgtcgtccagcctggatgtgcagtggtgcgatctcggctcactgcaacctccgcctcctgggttcaagggagtctcctgcctcagcctcccgagtagctgggattacaggctcgcgccaccatgcccagctaatttttgtatttttagtagagacggggtttcaccatgttggtcaggctggtctcgaactcctgctcatgatccgcctgccttggcctcccaaagtgctgggattacaggcgtgagccaccacgccccacctgaaatgctatttttcttggctgtcaaattaactaatatttaaaatatctagtgttgggctgggcacagtggctcacgcctgtaatcccagcactttgggaggccgaggtgggaggatcacttgaggtcaggagtttgagatcagcctgaccaatctggtgaaaccccatctctactaaaaatacaaaaattagcagggtgtggtggtgggcgcctgtagtcccagctactcaggaggctggggcaggagaatcacttgaaccggaggcagaggttacagtgagcggagatcgcaccactgcactccagcctgggcgacacagcgagactccatctcagaaaataataataataataaaaataacaaaatatctagtgttggaaaaaatgtacagaaacaggcactctcatacatagcttgtaggtgtgtatgaaattcaattccacttctagaaaatgaaataaaaagataaaaataaccaaagtgcacagattttcttaaagagaagaacaaaattttacttctaggaaattatcataaggaaaagaataaaaaaagtacagaaagatgtatgcaagattgttcctctcaacatggtttatactatcaagtacttgtagacaaaccgaatgtgtaataatgggagattaaacaaattacaatacatccataatagggaataccatacagtcattaaaatcatgttattaaagaatatctattgtcatggggaaaagtttcccacatatcgttacattgaaaaagtacgttacaaagcaagatgtgtactatgagtctatgttttaaatatatgacatatatataagtgtatgcgtatgtgttctcagtgaagaaaaacatctgtaagtctatgtacaccaatatgttgatagttgttttaactgggtaacaggattatgcatcattttaatctttttgtattttttatatattccagagtttctgtaataaatacgcaattctcctgtgatcaagaaaatactgaaaatggtcagacccagtgggtggctcacgcctgtaatctttgcactttgggaggccgagacaggcggatcacttgaggccaggagttcaagaccagcctggccaacatggtgaaaccccgtctctactaaaaaaatacgaaaaattagccaggcatggtggtgcacacctgtaatcccagctacttgggaggctgaggcatgagaattgcttgaacccgggaggtgaaggttgcagtgagccaagatggcaccagtgcattccagcctgggcaacagagcgagactctgtctaaaaaaagaaaaaaaaaagaaaaaaagaaaatactgaaattgatatatattttttaaaagtgaactcaaaaatcagtaggttttatgtctctcgctccggaaagtgagaagagaataaatagtaaggtattaaaggatatcatgtgactcagagccctaggattatgacattcagacttacttaagcctctaaatctgatcctgagagaactgagggaataaaatcaatgatctctgaccagtttgaaaactagatatagcatcatttaaaagtttgtgttaacaaattttccatgtttagtgagatgttctgaatatgaaggaaagaagctaagattctttataaccaatatggtagagtgaagaatttttaaaggaaacttgaccgtgttccacgttgcacagcatcaccagtctatttacagagaatttaaatgttgcaaatttcttcaaatctgctgttccccatctcagacattggtctcttcttaccggaatctgtctttctggaggaggatttttttcaggaaccactgtttcaacacaagtgatcttctcaacatctattgaacccttcttactgcctcttctctgagaagtagaatgaggaagaaaatggagaaagattaagagggattaagcaaccagatgattagattttgttatctaatcattcaacaaagtgaggtggcaccaggacctgtcatgtgggggaagaaaaaaaaatccttccagatctataaatctatgactaccaaatggagggcaaataccatggaagagtgaatgactgtatgtaccttcctcataggaagtaaggaagcaatttccaactcttcgatttcattttcaacaatcatttaatgagtgctcatcaattccaagattccatggtaatattttccttgtggcttcttaggacctttgactttccggctttagctagttataggctaggaaatattttgctgaatttgaaagaacttaggtccattctactcccctcctcctaccaacgaaaatttacctcttccccaagaaagatctaaggccaagtccttgatatcttgaaactcagttttcatagtcgagaaacttaccccacgttcaaagtcatactcatagtaggagagtttgtgcacggtcaagagaaacaggcgcttcttgaagtttagaggtgatgttttctttttctgttgggatcgcttcagaaagatgctctccagaatcactgcggccatagcttcttctttctggagttcacctgtgtgctgttgataatgaaagttcctgaggacccaggacattaatcctcatccctcttggttccccctcagcctagctacctagtttcaaatggaacaaaaatgtgcacagctcacaaaataatttcttcctaccaacctcctcccacagcccccagctctgtcaggtttcaggtataatggatgcacactgaattggggggggattggttcgatgttgtgagctcatataaactgagttcttgtataaggcaatggaatgctctagatgttaaatggcacgcacctgtgtgcttggtaaggtgtagaggtagctttacactattcacctttatatgatatgtgtagaatctgtgaaaagcaaaagtatctgtgcagctgttgatcttgatatacccagaagggataatgcaggtgccagaactccactgaggcagatattggactttcagttcccaatttcctagacggtgaatataatttttcaaacattgtcccactggggtctgtaaccaagggaactaataaggatatggaggctgcacctgcagttctggacacacactaactgctgcccaactgattttgcccacacccactgactgagctacaaaggatagaagatttgttctaaagttgaaaacataattttttttggtgggttttggtggggggggggtagttgttgttttctgaccttttccccatttagcttaaattagttcttttagacagcatcatgcaaaagtgatgcaactgtcttactgatatagatgccacctctgttcatttatgaaacacaacttatttagcctccccaaacctacaatactccagaaggattcaatttaggtaactgaaacacagaaagacaaataaagttcccaaagtcaccactggcttttttattcacaccaagcaacacttcatatcagttattcacttacagtttatgcacagtgtaatattattactaattccgaactttcattggaaagataaagtgaaaacaaatgctgtcataaaaatagaacactaggccggcgcggtggctcacatctgtaatcccagcactttgggaggccgaggctggcggatcacctgaggtcaacagttcaagaccaacctggccaacatggcaaaaccccgtctctactaaaaatacaaaaatagccgggcgtagtggtggatgcctgtaatcccagctactcgggaggctgaggcaggagaatcgcttgaacccaggaggcggaggttgcagtgagccgagattgtgccattatactccagtcggggcaacaagagcgaaactccgtctcaaaaaacaaaatcaaaaacaacaacaaaaaaacactaagtaagtaacgaaaaaaccaccagccctccattcaagtttaattagtggtagggatttttcctctggtgggggggtgggggtgggaatgtgtctattttttaagtaaactccttatgcttttggtggcaccgtggaagcagaatgaataaagccagcagtttttttctactttttaagcagattattgctcacactaggaaagcaagggagtgaattttatcaaagcctgggggctatccacactgttattttgctctttcctgtggtgtaggaggttctattctcatgctggggagacgaaaatacgtcaaaggaacaccaggggtgttctggaagatcgctttgccacttatctaccatgtgtatgccactatcttctggaggtggattaattcaatattttgtaaattagattttgagaaaaattgggcaagagtgcaaacctttccctccaccctgccacacaccctgactccctggtttaaatggtctctcactggagtgacaaattgatgagtttacaatcagcccttcccaacactcagttttagctctaaactcaaagaggttcattttaacattacaattatgcatttactcaggagtagtggtaaccaaataatactactctattctcaggaactaccaactcattgagagccctgtaatcataccacaattattcttgtggcaaattataattaagtacctcttcacaatcaaagactcaaattacaggataaaaaataaaaccctaaataaattgagtactgtgaccagtaaatggggtcagaagcatcccaacaaaccatgtctggtgtacttctcttagccgaataaatcgcaggcaacattttatctttagttttgttgcaggctcttggtggatacattccctgcttagacccaccatctgtttcattcttgtcccctgctcttacttcctataagacaggtccttctggaagctgcctctactctttctctgttttagaacaaatccagtttgtacaagaggaagtcttcctctctctcaagtatctgtgtttgggcagggtttagtgctgctctgactatgaggaagtaagcaagtctctcactagccatcgcccctctgagcaaaaggtgaaatggcctccacctctagatcattgagctagaggtctaccagaattgccatgatttggtaccaccttctttgactgcttttctcctgtttcttatgatccagtccagactcacacagcctgaaaatgtggtagctcttccttaggtgccactggtccatcactcaataatgtgaaaggaaagggatccatttttgagtcctccagaaggttggtgtgtaacacacagctctgagttaaaaagtagttagagggtaaagcttctgtgggtacttattgtgaaaggccccattttttttttttttttttgagacggaatcttgctttgttgcccaggctggagtgcagtggcacgatcttggctcactgcaacctccatctcctgggttcaagcaattctcctgcctcggcctcccaagtagccgggattacaggcgtgtgccaccacacctggctaatttttgtatttttagtagaggtggggtttccccatgttggccaggctggtcttgaactcctgacctcaggtgacctgcctaccttggcctcccaaagtgctggaattacaggtatgagccaccgtgcctggccagtaaaggccccaatttttttaaaacaatttcagtagcctacagagtcggtttgaccacaaaatatgcacaatgatggctaaccctgagctccactcagggtgaagggtggaaatggaagtgacttgaatgtctcaaacatacagacacacacacacacacacacacacacacacacacaccactgttgtttatagaaagaaagaaatgggggaggagaaaaaatagacacagagctcttcatttaaaatatggagttccagtgttacaatgtcccctttattaaattataaatgcaaagatttttacagggccaccttttgcagcctcccagctccctatggagcaacagaattcagaaagacgaagcttattaacaagagtgcagccatcatacaaactgcagtatgccaaggaattaatagaaatagcacttgcagaatcagtaaactaaaccatcttgggctcttatcttcgctcataagataaaatactattaagaataataagtccaggcgcagtggctcatgcccgtaatcccagcactttgggaggctgaggctggcggatcacttgaggtcaggagttagagaccagcctggccaacatggtgaaatcccgtctctattaaaatacaaaaaattagccgggcgtggtgacaggcgcctgtagtcccagcaactcaggaggctgaggcaggagaatcgcttgaactcgggaggcggaggttgcagtgagccaagatcgtgacactgcactccagcctggagtctcaaaaaaaaaataaaaaataaaaataaaaaaaaaaaagaagaagaataccagagcaaaattcagaaaactacacagccagcctatgattgggaagagtctatgagatatgatttaaaataaaataaccagtcaactgtacttcaaatgactacttagccaaaatatccaagaagtagtgttttctcttgatttctccttgaaagcactactcaattggctaggaagattctggccattccctgtctttccttagggggatggaatggaacttctgttcctttcagtgacttctacctgacaggcattttacaggcattatttcatttattcctcacaacaaacagatgaggaaactgacacagaggttatgtgacttgtccaacctcatccatctgtagctcttggtatatcatctatagcccttgctttttttgtggtgtttcactgcctaccggagggatttttgttcgtttatttgttttttggtctttgatgaggttgatgccatctgccttggggcccctgtcattctccatggctatcatcaaagagcagttgtgacaaactcctctccattttctaggaatgttcagcaagagaggaaatggtggtaaatacaggagataagagagtattcaagatcctaagctctttcctctgcaatattcctccaggctggtaaggatgatctgtctctggtaactgtcaactatactttttttgcacttgaggactcttcttagtcttgccaggttttcttacattttccctctttaaatcattcccaaggagattctgtctaactagtgaatttctagagtcacttgttgtttcctttcctggatgtttcattgttgatggaatgaaagcacagtgtttaggtggaacatccacccttctctgtccctagggttcttattgcttactgtgaatataaaactttgatcaaatataccttctatttttttgagacagggtctcactctgtcacccaggatggagtgcagtagcaagatcaccactcactgcagcctccacctcctgggctcaagcgatcctcctgcctcagcctctcaagtagctgggactacaggtgtgcactaccacacccagctaatttttaatttttttgtagagacacgggtctcactttgttgcctaggctagtctcaaactcctggatgcaagtgatcttcttgtctcagccttccaaagtgtggggattacaggcatgagctgctgcacctggcctcaaatatactttgttttatattatgaaatatttcaaatagaaagtacagggactataacattacaatcttggactcaccgcttagctctacaaaatcctaaaattgtgccatattgcctcacgtgttaagaagtgagatacaatctatataatcaagacccctttatgtactccaaaatcttagtcttctccctccatagagattaccaatatcttgagtttggtgtttatcattcctaggtatgttttcatattattattacagatgtaagtatctataaaagatatatagtattggtttacatgtttaaaatttacatatggccaggtgcggtaactcaggcctgtaatcccagcactttgggaggctgaggcgggtggatgacaaggtcaggagtttgagagcagccagcctgaccaacatggagaaaccctgtctctactaaaaatacaaaaactagctgggccaacgctactctcccagctactcaggaggctgaggcgggagaatcccttgaacccgggaggcagaggttgcagtgagccgagatcttgccattgcactccagcctgggcaacaagagtgaaactcggtcgcgaaaaaaaaaaaaaaaaaaaaagaaaatttatatatatatatatggtacacattctccagcaacttgcttttttcccctcaatataatatgttaggatttatttatctggctagttctacttcatatgttttaattcatttttatatgcataaaatattctatatgatgaatacattccaatatatttattcattctcctgttgatggacatttaggttgtttgctttcagtgataaacaatgctgctgtgaacattattttgattttttgatctcagaatgaattctcagttacttagacaaactggcaaacctaggtccagcttatcttttggactatgcaatttgcatcattccttcttgccttttcagtcctgtcttcctgatgcttcactatgaaatgtggtagaattatcaactatctctagtgggaggttaaatttggcctacggaaaatctcttcccagtcccaagaagcatccttcacgttctaactgagatttcaattgagaattccttggccttgggaccagaagagaacgtgttaagaactgaaatactatctatataatcaagacccctttatgtactccaaaatcttagtcttctccctccttagagattaccaatatcttgaatttggtgtttatcattcctaggtacgttttcatattatcattacagatgtaaatatctataaaagatatacagtattggtttacatgtttaaaatttacatatggccacgtgtggtagctcatgcctgtaatcccagcactttgggaggctgaggcggctggatggcaaggtcaggagtttgagagcagccagcctgaccaacatggagaaaccctgtctctactaaaaatacaaaaattagcctggcgtggtggcgcgcacctgtaatcccagttactcaggaggctgaggcaggagaattgcttgaacccaggaggcggaggttgcagtgagccgagatcgtgccactgcactccagcctgggtgacagagtcagactccgtctcaaaaaaaaaaaaaaagaaaaaagaaaaaaaaatcatacccacagcaacaaagcaacctttaatcttgttaaattcccaagatgcttttgttcgggccccagtgaaacccaattattttatgataagcttcatagtcaaggctacaggggaccaaatttgtgatgaaggcatcaagccaaactcaattttcgaaagctgcatgctgaccagggaaactctcctgctgtagtcatttacaggaggccttagggctctctggttcttccacagcagttcatgttttatttatttatttatttatttatttatttttgagacagagtctcgctctgtcatccaggcttcggtacagtagcgcaatcttggctcactgcaatcgctacctcccagtttcaagcaattctcttgcctcagcctcctgagtagcttggactacagccgcacaccatgacacctgcctcggcctcccaaaatgctgggattacaggcttgagccaccgcgcctggccttatgtttttagcattttacatttttcttctgtggttttggaaacttctaggtctctgtgattcatcatctctttttgtcttgcattagcgacaatatattctggccaactgatgatggaaggagagccagagagccaatctgcaagtttatagtcagtgccagatcagatcagtggtaatactttcaatattctccctctgctctgagggtgactgctggggtgtctgtctttcactctggacttgtgtgcccttttggccttctttttcaacctagtttttgttttccttggcttaaacattttatttattttttccatcgatatcaaaataacacacgcagctgggtgcagtggggtgcacctgtagtcccagctactcaggaggctgatattggaggattgcttgagcccaagagttcaaggtcagcctgagaaacatagggagacccccatctcaaaataaaacaaaatatagtaaaataaaacatgcttattgtagaaaatatgtcaagtacagggatataaaaaagaaaaaatcattcataaactcatccagaggcattaatatatcggcatattccttccatttttttctgtgtgtgtttcttataatatttgagatcatattgcacattcagttaatttacctatttttcgtaacatctatgtatgtatgtatgcatgtatgtatgtatctatccatccatccatccgttcaaggtacctttttccaaaaaaagatctaatgttcttatttaacattattcctaattattttcccatgttattaggatctctatacaagcatcatttccagagtcaaaaaagtatgtgcattttgcattttgatacatactgccaaaatagtttccagaaacattgtcccaatttcagttccaaatagttttagagagccccctttctcattatccttatctcttttctggtccatttctaatcatttttaaaactctggttttactgcagacaaatcttttttttttttcattgagtcaatgatcttaaactccagtatattccaacttccagcttgtctaaaacttaacttctcttgactctagaatttccttcttctagggtgagctaacagactacagtttgttttcagttcagggaggtagggcagtgagaggagcttctccttgagattcaaataaccaatataatcctaaagacatcttgtgagaactttctaagagcggagagaagagcctggtattaaagcttctgggtttccaatgctctcagattgccctcagccactgcacatgaatctccatagaaactgaaagtcacacgtggcccaattgtttcagggtcctcagaggagttctccctcctccttcccctccccagatggcttcatgcataaccaagtagctttggagtcaaatatgtcaaggcctcttttctagcttcttgctgagcactgtgtcactgaaaattctagttcttccttattttcagtagttagcaatcagatctcagcaatcagatcattgtgggtgtagaagggggtatctgataactctttggagaacgcccaaactttggttttcgaaagctgtatcttccctttatacctaagtcacttcctgatatgggtctagtccactgaaaggaaactctataggaaatttgctcaaatggaaatagcaaatcatagtgataatttaaaattgcaccaatcccccataactggatggaaagttacattagttcgcaccataaggagtttacaaagaattccagggtgggtgcggtggctcacgcctgtaatcctagcactttgggaggcccaagcaggcagatcacctgaggttgggagttcgagaccagcctgaccaacatggagaaaccccgtctctactagaaatacaaaattagctgggcgtggtggcacatgcctgtaatcccagctacttgggaggctgaggcaggagaattgtttgaacccgggaggcggaggttgcggtgagctgagatcccgagatcgtgccattgcactccagcctgggcagcaagagtgaaactccgtgtcaaaaaaaaaaaaaaaaaattccaaacaaaaatatcaatagccatacgcaatggaaatttggacttcaacacaagcaagcagtttaaatagtttgaatataaaaggagtcagaatagacaggacaagccctaagggacactgtttgggtataatgctttaggttgccatgagtatttgcattttgtggcttatttggaaagtgacattattttatcaaataactgaggctccagagaggctggagtctgggcaacttatccaaggatgtcttgattggggtcaccaatcacttttattctaaatgtcatattatttgctctaggtaggccctctgggggacattggcaggtctgaggcagagtaaaaattatagcaaatactgagatccagcacttactattgccaggccctgttttaaaagctttacatgtatttgcacatttactgctcacaaccaccttatggggaaggtgctaggcaggcagggaggaggaaatggaaagggaaaggaaaagggaaaagagcgggggaagaaaggagcaagaaaaagtcaatgcaattcggcaattatttgttaagtgctaactgtatgtcagggtctggtaatcaacagaacagaggagggtataatgaagaggggatataggtagagaaaagaggatgagtgggaagaggaggaggttggagaggaggaaaggaaaggagaaataatgaagacaagagaaaagcaagccatgcacatggagggcaatggtaagaggagaaacctttgccacaacctcaagggttggccgcactgtctgggctgaggcagaggctgctttctcctggcccagtcttttacccattgttaccacgaggttggcacagcttccacacagtcctttaataagccagctctgaccctggcgacatttggcctggtacagctcaaggcaggtagcctacaccctggcctagccaggcctttccctagctcacaaaggtcaacttcataacgtggagcgtgagcttttaccatgttctcagagaatctgcctcttagtatttctttttctaaaggcttcattgacccatgtatccctattgagtcttcaagcactatttgacagaagggcttgtttttatctgactgctccctgcaatattacttttccactaagtttgccagaggtacccctttctaacatttgctacctgttcggatggtcacctcatgtcacatttttctcttcctgttccgcccaccctcagcccttgtcggaaaggaccctttcggcctctctaatcaccagaagggactgccagggccttgtgctgatgacactcccaccctccgtcagcctcctccactagctgataaatggcaccagccatgctgtctctctggtttttaggggtcccaagcaaggtacattgctgctgctgcccagcccctgccataccccagacccacctcagtcctgacttaatgcaggtagcttcccagatgcattgagatgccaggacttggaaggtgggactcgatcgcagcagacactggccctggagacatattcttacagtccagagaggaaggacagtctgagcaaaccccaccctttcacagccactcagtt

SEQ ID NO: 1556 - DNA, 84532 bp, Homo sapiens
tcagaatagaaataaagtactttatagtccataagtagaatcaggcgttaatctagttacatttggttcttgataaacattttcatagtaagtatcatctggtattcccatttgcatctttgatatgtctcctccatagttatatatgtttttctgtgcttgattaaacctgaatcctaaagagaagtgacaaatgattagaaagataccagatataataagatgctcactcaaaatgctactgtgttgtggtctgttccacattccttttcaccattcttaaagcaaatatcttcacctgaaaccagaaacaccccaaatttctgagttcatcccactttcactcccacatatcactgtccatccctacaaaaggctctgcaggacctgggttttaggtctgatctactaataactagctgtgtaatttgggacaaattatttaacctaagtcttagtgctctcatctgtaaaatggggataataaccgcacctacctcatcatattcctgcaagagttaaatgtgacagtgcatgtaaagaacttagagcatctggtatttagttggtgctctgtaactattagctaacttcttcattcacaaagggagaaatgcccttttcctctcaagagctcatgtttctcaatctgctctggatttaccttctcttgcttcttgaagaagtgacacacattatcctcttctccaatgccaacatcttcaatgtatcaccttcactggcttcagttatgcaaatctccactacttaaaataattttcacttgcttttatgctccttccaactaccatcctatatctttcttcttttcacagtaatctcttttaactcagtaacttatattgtttccttttttttttttttttttgagacagggtcttactctgttgcccaggctagagtgcagtggcgcaatcgcacagcctccacctcctgggctcaaacaactctcccgcctcagcttcccaagtagcaaggactacaggtgtatgccaccatgccctgctgacattttattttttgtagagtgagagtctctttatgttgcccaggatagtcttgaactctttgcctcaagtgatcctccaaacttagcctcccaaagtgctgggattacaggcatgagccattgtgctgggtctctgtgctgatttaaatttgtaaaagatgactatctattgagcagagaagggaatggagaagcattggtttggaggctattgcagaagcctgtagaggggtgaaggcaacttgggctgagtgggtggcagtgagctggaaataggtggattggttaatgctaaggatggctcatattaatggagtatgcattatgagataggcactattctaagctctgtgcatgattatctcattatctcacaacctatgtgctaggtactaccgttattcttcttttactagtgaagaaaccgagctagtaacttgcccaagatcatatagccagtaaagagtggagccaaaaatcaaacccaggcactctgaatcaagagtccacaatcctttgggaagccaagatgggcagatcacgagtccagcctgggcaacatggcgaaatcccatcttgacaaaaatacaaaaattagctgggcatggtggtgtgtgcctatggtcccagctacccaggaggctgaagtgggagaattgcttgagcctgggaggcagaggctgcagggaactgaggtccaggccactgcactccagcctgggcaacagagtgagaccctgtctcaaaacaaaaacaaaaacaaacaaacaaacaaacaactccacaatcctaacctctttgctttactgcttctcctatctgctagtaggacagaactcatacaccatcattaggctttggctatgttaaaattattggcgtttctggggtctgatgacactcttcttcaacatgctggcttttacttttagcatttcagtactgctaactactggcagaacaatagtggcctagaacctaaaaactattttcaacattttgaggcatttattttgccaagtgaagtctgctcatgaaaaattgttactaaaactataagtaactttttttcttcactctgtcacccaggctggagtttagtggtgcaatcttggctcactgcaacctccgcctccctgttcaaacgattctcttgccacagcctccgagtatctgagattacagacatctgccaccatgcacagctaatttttgtatttttagtagagtcagggtttcaccatgttggccaggctggtctcgaactcctgacctcaggtgatccatctgcctcagcctcccaaagtgctgggattacaggtgtgtgccactgtgcctgaccagtaacttttaaaaaaggattcatattttggctaggcgtggtggctctcgcctgtaatcccagcactttgggaggccgaggtagttggatcacaaggtcagcagatcaagaccatcccggctaacacagtgaaaccctgtctctactaaaaatacaaaaaattagcggggtgtggtggcgggtgcctgtagttccagctacttgggaggctcaggcaggagaatggtgtgaacctgggaggcggagcttgcagtgagccaacatcgcaccactgcactccagcctgggcgacagagcaagactccgtctcaaaaaaaaaaaaagattcatatttttaaaatcactttattcaaacttaaataatataggacatttccttctattcccaaataacaatcttacatacaaaggtaaaaatgacttgacaaatgcatctaaatttatatactatgcagattactgaaatgttaaatgcctagaaatacgtgtgtggaatgtattttttgttcatgagaatttcctataaagtactgctaaaaatcacctacctttgaagttagccgaagagttgcttgtagcaatttccttccagctggcaatgtacctaagcacattatatgaggattcattaaatttaatcgattcattagtacatacttagactacttctaaaattccacttttcagaaatcttagattaatgatggcatgttcactagcctccatgtgtaactctcaagactttctcaccttctagtagctcacatccagctaagaaccttcaggacaaggagttgaaggaggtataaaaatggtgcccaccatctgccatacttagtgtcctttcacctccctctagcatgccccctcattttatcctgttaattccagaaagatcatgtcctcagctgagtgtttactaagaagttagttaataacatccaaatttaaagcatgggcagaaaactctcctggagacaacaacaaaaactttctcctttgttctggattaccagattcactgtctctgatacgtgaagggaaatttaaagcatctagtttctgagctcattagagcagcagcgctgtctttgcagtgtccagaacacgttaagagatacatttaggtatggcaaatgcagctgtcacctcagctcctgaacagagactgaaatagagagacgagggttgcctgagaagaggtagaatagggaaggacaaggtacaaccttctgtgaggatgatggaaaagcaccaagaggcaggtttcctaagatttatttcaccttaggctccatatcccactttcctaaggtgcctttacaactgcacccactttaatcaaaaaatcaggtcaggatttggttacagtaggtgctaaaagggagctagcacagagaggtggagaattagaactgtcacgtaattggctgggcgcagtggctcacacctgtaataccagcactctggaaggccgaggtgggcggatcacaaggtcaggagatcgagacgaccctggctaacacggtgaaaccccatctctactaaaaatacaaaaaattagccaggtgtggtgatgcatgcctgtagtttcagctactcgggaggctgaggcaggagaacggcctaaaacctgggaggtggagcttgcagtgaactgagatggtgccactgaactccagcttgggtgacagagcgagatctcaaaaaagaaaaaaaaaaagaattatcatgtaattcagaaaacactgtgattttcttttcttttctttctttctttttttttttttttttttttttgagacaaaatctcgctcttgtgccctaggctggagtgtgatggcacgatctcggctcactgcaaccttggcctcctgggttcaagagattctcctgcctcagcctcccaagtagctgggattacaggtgcctgccaccacgcccggctaatttttgtacttttagtacagacagggtttcaccatgttggccaggctggtctcgaactcctgacctcaggtgatccacccacctcggcctcccaaagtgacactgtgattttctaattatttgttccatttgaattatttttacttctgtcaaccctgtgctcctgaagttttttgcagtaggagggtatatacttccaacagtatttaatacttatttttatggagacaaggtctcgctctgtctcccaggctgcagtgcactggtgccatcatgggtcactgcagcctcaaactaatgggctcaagtgatcctcctgcctcagcctcctgaatagatgggaccacagatgcatgtcaccacacctggctaactttttaattttttgtagagatggggtctcggtattttgcccaggctggtcttgaactcttgggctcaagtgatccacctaccttggcctcccaaagtgctgggattataggcgtgagccactgcacttggcctatccaacagtatttaattacaatcagacgttgtgtctgaatttggctccttcttactactgctaccccttggtgctctgcgaactttcttcaatggccttcaataggatactgctgggtgacttaaatgaaaggatgcaggacaagagcaggtggtgtaactccttccacaatctctcagtaggcaattcagtttggtttgaccttaaattttagcagactttgtgctttcagtggttgctcaggagcactataaagagtcatcctgcttgcttggatttatacacagaaaagactttcattccaccttcaagaaaccaagataaaagaccttgatcgatagtgtgctgagccctgacaatctggggcacaaacacttaccatagctaggccccatcactgtccctgctttatccaagattagcacatgacttttattccattattttaaaaagaacttctcataaagaacataccagcagtaattgataagaaatctaagttttacagacatagaagcaagtctgatgaaagcactaccatgctgtttatatcacagagctcatctttctcacgaagaaatttgtagaaatttttagataatagttatcaagtgtgtgtgcagtctacaatgaatccatttgttaaattacaaatttaacactttaagagctcagaaaaagtccctagccagagaggtcacaaaactacatatcttagaaatcaaaggagcagcttcagatatagaaactatccataacagacataggcacagagctctccccaacagagtatcaggaaattatttaatattttctagctggtgattgcttaataggtatgtcaaaattcacttgctgtttgaaaaacgtgatgatcctggaagaggaacatctgaatatccattaggatgaatgccagcaaaagccacggtagctgtcctgtggcattgtgcataactccgtgatggtgatgtggggattgttctgggttctaaacagctgcagcaacatagctctggatacaggaatttgcaacagtactcattagtgtgtttgagtccactagtgaaactggctctatccattcttccaaatgataataacaatgttcggttaatagttgcagtacgcatctgaagatggacatggtttcatctcaggagagcatcggtctgtcataacggactagaacaaaagcctttggggagaaactggttgttatcactaaatatcagtgttcaaggcatttatgccattctaactgtccaactgtagaaaaatgtccatagacgttgaaggatactttccaaggaattaggggtgaccaattctctagaggggacaaatgtcagacttttaaattttcatcaaacaaggtgtcaccaagccagttacaaatatctagaggtctacaaaggtcaaacggggaagtagactgtggagaccataaatgtgctggaaagaaggggcttatgcctaatgtctgcagttagctaggggaaggcctttgcaaagtttggtcttactgagataatcagtgcttgtggccaagtagtgctactgaaatatacccagataatcacacttgaaatttcatctgaaatttttgttgttcaaggctcaatgtaaaaccttgctaagagtccatgttggtacaaaattatgagtatcctcaactcagaagataaactgatagaaattatacataacttggaagcaaggtatttgcatttttttaatggaaattttcagttgctcttatcatctgaaagctaggtatatccatcccactcctatatgctatgaagaaattgcttcaagtcttactggtttatcctgggtttttttgttttgctctgttttgttttgagacagagtctcgctctgtcacccaggcttgagtgcagtggcgcgatctcagctcactgcaagctctgcctcccaatggcatgaatcgtgggttcatgccattctcctgcctcggcctcccaagtagctaggactacaggcacccaccaccacgcccggctaattttttatatttttagtagagatggggtttcactgtgttaagcaagatggtctcgatctcctgacctcaagatccgccctcctcagcctcccaaagcgctgggattacaggcatgagccacctcgcctggctggttttttttttatttattttattttttatttatttatatttatttttgagacggagtctcgctctgttgcccaggctggagtgcagtggcgcgatgtcagctcactgcaacctccacctcctgggttcacgccattctcctgtctcagcctccctagtagctgggactacaggtgcctgccaatttttggtgggttaatttttgtatttttagtggagacggggtttcaccgtgttagccaggatagtctcgatctcccgacctcatgatccacctgcctcagcctcccaaagtgctgggattacaggcgtaagccaccacacccagcctgttttttgttttttaaagggaagccattaagacttcacctactatcacttagcggatgatggcggggaaagtcttatgtggaccgagatgcctattttttcttccctttgaactcaatggttttattctttttatattccagtaatgacagaatatagaatatctggtatcaattttttgtacttgtttgccggcccttagcttgaatcggccaatggtacaagggaaaggcagagcaggatttcaaaagctcacctgagaaaattctctatccagtcctgggaaactcattcaaaatggacctctcctacctctctttccctttcttccctctcttttccactcagcaatttttactcttaggaagaaaagtaaaagcaaggcattgcagctcctttgtttggctgtcatttcttgcatcattattaccatctgcatttgttcagtgtcccaggaactacagacatgctgtctatagggaatctcaagactgaggtctgcacaaaatattggggttattgaatcatagcaatttcttcttatttaaaaatattttaaagcatctactatggacacttagtcctttattttttatcttttccttattattttctgatctatccttctcatcagtatcttcttttttcttttattcttgttttgattttcctttgtcttgatcattcttccccctttttcttcatttatctttccttgcatcattattctctcccctgcttcctctggcttctttttttcatgttctattgttcaatgaccattaacttgatttttcctaccccattttcttatctcacttttactgatttcttctgttttcttacatttctttacttacactatcttcatttaaatttttctgcctcttcatgcagtatccacattctttattgtagttgagtaaatattgaacattttaagcagctttattgaggtatataattcatatgccatacaattcccccatttaaagtatagtatccagtggcttttagtataatattagcagagttgtggctccaccaccataatgaattttcttttcttttttttgagacggagtttcactcgttgcccaggctggagtgcaatggcacgatctcagctcactgcaacctccacttcccagattcaagtgattctcctgcctcagcctcctgatagctgggattacaggtgcccgccaccaggcctgactaatttttgtatttttagtagagacagggtttcaccatgttgatcaggctggtcttgaactcgggacctcaaacagtccacccgccttgacctcccaaagagctgggattacaggcgtgagccaccacgcctggcccacaatgaattttcaattattttcattgcctcagaaagagaccctgcaccccatagccaccaccaccccctccccccagttaattctccacccccaggaaaccactaatctattttctgtctctataggtttgcctattctgggtatttcctataaataaaataacacatgatcctttgtgattggcttctttcacttagcagattcatcaatgttatggcatagatcagaacttaatttctttctttttttttaaatagaggcgctgtctcactatgtttcccaggctggtctcaaattcctaggctcaagcaatcctcccatctctgcctccaaaaatgctgggattacaggcgtgagccactacacttggctttttgtgtgtgtgtgtgtgtgtctcgctctgtcacccagactggagtacagtggtgtgatcatggctcactacagcatctacgtcctggctcaagagaacctcttacctcagcctcctgagtagctgggactacagttatgcaccagcaggcctgggataattattgattttttgtagagatggggtctcgctatgttgcccagactagtctcaaaatcctgggctcaagtaatctgcttggtctcccaaagtgctgggattacaggcatgagccaccatgcccagcccactaatttttattgtggaataatattctattggatagatctatcatatttcatttagccattcgtcagctcatggacatttggggtgtcttctgcttttttgctattatgataatgctgctatgaacatttatgcacaggtttttgtgtagacatgtatttccccttctcttgggtatatatctaggagtggagctgctggatcacatgtcagctctatgtttaaccacttgaggaactgccagattgttttccaaagtggctgcaccattgcacattcccactagcagtgtatgagttccaatttctccacattcttgcaaacacttgttattatctgtctttttaattatagctatcctagtaggtgtgaagtggtatctcattatggttttgattgcatttccttaatggggctacattaaatattctaaaatttcccccacacaagaaatcttaaaaatgttttctaagggccatagtacatcactgaaaacttataacattttagtgtctcatacagaaaggttagggaatatagatgaaagaaaacctttgtattattaatttcatgctcttagccttttttctaaatcccaaagtaagaagcaaagcagactaaagcataagaataaagtctaagaataaagagtcctaagtctaattttctgtttactatttttggatcattcattttcttacccctcatgtcttcttctgttctttctagacaaataatagatactcgggttttttttttctttgaagattgtttgtggccccaagattcaacaaggaaataggaaatgttagaaaaaaactatgatgactgcccttgttccccaagaatagcaacatgtacttactcatcaaagttcagtgtatttgtccagttcagcacttcatccacttcccattccatcacagaatctatccccccatcttcaaaagctctaatcagcccctttgttgcagtgtgaattagtcctagagtttcatgatgtgttgacttagcctccagacttcctgagtagtacctaaataggcaaaagggaaagagaagtaaatcttttgaaataggagattacaagtagatacaggcaatatatattgttgctatttacatattaaaactatttgcatattgaataaagttttcattcctatataactcagatgcatctaaaccaagatctatgtgatggaatcttctggggggaaaagcaacttaaccacactaacttaaaatcacccctcaataagttgcatttttatgatacgaagaaaaactaagttattaaattgttgaatcttagaattatagagtggaaagggtcttagaaaccaaataactaacctactcatttttataggtgaggaaataaatctttgaggagttaagtaaattttacaaaatcaagaggctaatagcagataaagagggaaggaaagtgaaaaaaggaaagagaggaagaggtaaagggaaaacagataccttttctttgtgccaggtacttttcatacagtcttatttaattctttttaaaaagacacagccaggcccagcgcggtggctcacgcctataatcacagaacttgggaggccaacatgggtggatcacgaagtcaggagttcgagaccagcctggccaacatggtgaaaccctgtctctactaaaaatacaaaaattagctgggcatggtggcgggcccctgtaatcccagctacttgggaagctgaggcaggagaatcgctagaacctgggaggtggaggttgcagcgagccgagatcatgaaactgcactccagcctgggcgacagagcaagactccatctcaaaaaaaaaaaaaaaaaaaagacacagccatttgtggcagctatttttattccccttttagagataaagaaactgagacctggagaagttaaaatatcattcaaagctgggcacagtggctcaagcctgtaatcccaacacttttggagactgagtcaggaagatcatttgaggccaggagtttgaggccagcctgggcaacagagagatcctcatctcaattaataattttaaaaatttttaaagaaattgttcaagatcatgtagcagtaaatacttatgagagccagtattcagacccttagttttaaattcagcctccttctgcagcactgcctgtcttaatctgagcacataaaataatacattcactgataatgagctgagtaactagagagaagttagtagtccttaccaagatcatcaaaactttttttggtatttattttaagatctacattggtagccattttaaagggtcacctattatgaagttgtattcatttattaattcaacactcattgattaggaaacagcatagtggtgatatggagcaagactctggtatcgaattatctggatgtgaatcttggttctgtgttacataatctgctaaataacctagcctttctgggcctcactgacctcttccttaaaatggtaatcagggccaggtgtggtagctcatgcctataatcccagcactttgggagggtaaggcaggaggatcacttgaagccagaagtttaagaacatactggacaacacagtgagaccccatctctacaaacaataaaaaacatagccaagcacagtggcacacgcctgtagtcccagctactggggaggcggaggtgggagaattgtttgagcccagaagttcaaggctgcggtcagctatgatagcactactgcactccagcctgggtaacagagtgagaccttaactcttaaaaaaaaaaaaaaatcataacactacttcctcctagcattcttgagaggtttagaagcataaatccatgtgggatgggcatggatggtggctcatgcctgcaatcccagcactttgggagactgaggtgggagactcccttgaatccaggagttcaagaccagcctgggtaaaatagggacaacctgtctctacaatttttttttttttttgagatggagttgctctgtctcccaggctggagtgcagtgatgtgatctcggctcactgcaacctccacctcccgggttcaagcaattctcctgccccagcctcccaagtagctgggactacagcccaccacgcccagctaatttttgtatttttagtagagatgaggtttcaccatattggccaggctggtctcaaactcctgacctcgtgatctgcccgcctcagcctcccaaagtgttgtgattacaggcgtgagccactgcgcccagcccaaattttttttttttttttttgagatggaatctcactctattgcccaggctggagtgcagtggcgccatctcggctcactgcaagctccgcctcccgggttcacgccagtctcctgtctcagcctcccgagtagctgggactacaggcgcctgccaccacgcctggctaattttttgtattttttagtagagacgggatttcaccgtgtgagcccggatggtctcgatctcctgacctcgtgatctgcctgcctcggcctcacaaagtgctgggattacaggtgtgagccaccgcgcccagccaaaattttttaaaataataataataaaaaaagaagtgtaaatctatgtaaagcatttagaacaatgactggtacacagtaagcattcataggctgacactgttatcgggtggcagggctataacagtgagaagatacatccttgccctcatgaaattttgacttcatcagattttaaacggataatgatccatgagagcaaatgctccgttacccaggctggagtgcagtggcacgatcttggctcactgtaacctctgcctcctgggttcaagcagttctcctgcctcagcctttcaactagctgggatcacaggagcacaccaccaggcttagctaatttttgtatttttagtagagatggggtttcaccatgttggccaggctggtctcaaactcctgacctcaagtgatctgcccgcctccacctcccaaagtgctgggattacaggtatgagccagtgtgcctgacctcttatttttcttttttcaacagtgatatatgataattcagatatcttttttctcttattaaggaagtataaaatgcactttgttttcaagagagtcatagtaattgttcaaataatttaattctcaggttttgaactcttttaaaatgttactattggccggttgcggtggcttatgcctgtaatcccaacactttgggaggccaaggcgggcggatcacgaggtcaggagattgagaccatcctggctaacacagtgaaattctgtctctactaaaaatacaaaaaaaaattagctgggcgtggtggcaggtgcttgtagtcccagctactagggaggctgaggcgggagaatggcatgaacctgggagacggagcttgcagtgagctgagatggcgccactgcactccagcctgggcaacagagcaagactccgtcttaaaataaataaataaataaataaataaataaataaataaataaaataaaatagttactattataattaaatggtataaatattgataaaataacaggtttgcaagtagaaagtgtttcaaatatagtgatcagaaataaaagatcactttataaacataatttgttttataaacaaactaatgatcttttaaaaagacctaaaattggctagggtggtggctcacgcctgtaatcccagaactttgagaggcaaaggtgggcaggtcatgtgaggtcaggagtttgaggctggcctggccaacatggtgaaacccaggccctactaaaaatacaaaaattagctgggcatggtggcatgtagctatagtcccaggcactcaggaggctaaggcaggagaatgcttgaacccagaggcagaggttgcagtgagctgacatggtgccaatgtactccagcctgggcagcagagcaagactctttctcaaaaaaaaaaaaaaaaagacataaaatttgtcttcgtaggtaattttgcaatatatttttagttgtattcaccttaacatgatcttatattctttctaaactaggaaatttagagggaaagaatattataagaaatgtttgtctaaatgtcacaacagagagagaagttaaaacaacaaagacctaggaagaatcaaagcttaagttgcaaaggaggttgaggaaagctaagatctataggacacaggaagggactagatttaaaagccagaattcttttagtaagataggggtaaaaaataaaaattttgttgattttgttcattactgattctcagcaacagtcagaatgaagagtgtttaaatgccataaatgaacaaagcacacaaagtaaaatttctcattcaccccctgcaactctatgaaaaggaaatgtaacacccagtcataagaaagcattcattcatttatttattctataagcaacatatattcattaaacatgaactaagtctgagatcctgtgctaataaatagaacagagtctctgctctgtagggactcaaagtttagtggaggtggcagacaaatacacagttaattgcaaaaatgtgaccactgagtatataaaagatccatggggcacatcaaaaggaagtacctaattgtgtctaggtatgtaagggaaggtttcagaaggagctatttgggccaagtatcaaaagatgaagatgttgttgccatgcagctgagcaccctagggagaggaaatatcatgggaggtgtaggtaacggggagcccttaacatattttaagtaaagaaattatttctgtcttagaaacatcagtttagtgtttatacagagaagacgaagggactagagaccaggaaactaattagaaggtagatgaaaaatgatgagacatcacagtggagaatgaaagaaaagatcagatttgggagatattttggaagtggaattaataggacttgatgacagattacatgtaggcactaaaagagtgataaatctaggataagccctctgtttctggcttggatgactggctaaatgcagtgtcataagctgagaccagaagaaatactgagaagaaacaacttttgtgatgcggaagattagaaattcagttttggaactgttgagtttgatatagaaatgcccacataattagaaatacagagctcagttatggatgacgattgtgttgagggtaaataaacacaggaaagaagaagtaaaacgcatattattcttcatgtgcattggcttatcaccagatgctgtttcccagctagtaatgtgacggtgcttcagcaagtcatgccaccattctgtcaaagccagctgtttctaggtgatggcacatatggtaggtgaattttgttgttctcagcctgtaaccacacttcctttgctgttaataggtcccctattagaggcaatgttgtatgaaataaaatgatgacgatggataacgcattctgttatgagaggtgttgttgccagaagtaatgcaggcagagaaataaaattaatatccagaatatttgtctatcactgtgaggacaaatggatgcctcctctattatgggaatggtctattttaatcagcctgtcaccaactagccagcatatctcattactgggggcaaagcaatggcctttgctatacagtcagctgtgactgtagccagaacaactttggtgagggggaagaccaagttgttgagtctatatagggcctccatccctgtaatcctggccactttggacaagactccacggtgcaaccactgaggtgccgggggaaaaaatgacattcacaggatggatcatcttgtccatctgattaccaagagctgtctgcctcatataagccctttggagggcattcacataggacaaaaatatattttgtatccattatgagtatacctctaccctgacctatactcaccaattttccaattttattctttgcaaatgttgatcagctgggaaactataaatgttggtcagcacagtcaatgagatccctacctcaggctttttccccttcaaatgaagtggaaaaccaaacataccacaagttgtgcccactggaaggatatcttttgatcattttctaggccaaccgaggaattgaaatcattaactgtccatttttagatgatgcagcatcctgtatagatccaacttattcctccaacatattcccccctgttaacttgtcatggggacttcctatgaagccaaaggtatggagatgatgtggaggcaatgcagcgtaagtagtggttgcaggagtatgagccacctgctcatgcagcttacttgggccttctggaccttctcagactcattcccatacagaccacatttattttacactaaaacagtgctacgtactctcaattttatggtttaattgattagataaatcccaggtcagtccatgatcatagcacttggtatcttattgtcaagcaaccagtctctaccaggaccaattgcaaatctggaacagattttcaaatggaatatagcttctggcagaagaaggaattcactgccttcttcctaaaccctagaggtctgtgctgtgattctcccattaggtctctttagagactctacagtttttcactaccatggacatttctaatgctgttgggactgctgggccataaagcccaagttgtaaggcagcttgaccacattgtggatctgctacacacctctttcttgctccatgtcccattgaagccagcttgtttgttagatcacctagtaaaggggttggaacagcatgcccaaaatatgtcatacattagctctcaaatcgagagagggcctctaagtgttgtgcttcttcaggatggatggtacaaggtacagtaacttgtctctcatttttgaaaggatatctcaaatgtctttaagcttcaattatatgccagatccttaactttttgcaaagtttatctgcctccttttagtgtgcatttatcctactaagccaccaaggagctgttattttctgctcaccacatccaatcaaggtaaggtcatcaatgtaatggacaggcataatgttctatggaaacagatgtacaagcccctggggacaagagcaggaaaggtgatgtatcttcgggaacaacatgtaaaaacacacggttctttctgtgaaaatacagactgcttctcctgttgcttagtgattgggatgggaaagaacacatttgccaggtcagttgcagcataccaggtgccaggggctgtgttgatttgctctgttgaagaagccacatctggaagcctcgctgcaattgtgccatcagctgacctctaccacttcaaagttccattagtcccagtgaactaaaggaaccagttccatcacagctttccccactgtcatctccagccttgtaaaggacagccaccacagagttcatcaagaaatatgctgctcctgggccagacgtggtggctcatgcctgtaatcccagcactttgggaggccgaggcaggcagatcacaaggtcaggagttcaagaccagcctggccaatatgttgaaaccctgcctctactaaaaatacaaaaaaaaattagccaggcatggtggcacatgcctgttatcccagctactcggcaggctgagataggagaattgcttgaacctgggaggcagaggttgcagtgagccgagattgcgccactgcactccagcctgggtgacagagtgagactccgtctcaaagaaaaaaaaaaagagaaagaaatatgctgctcccctcgctcccctcaccaagctattacttcatagcttgatgaaaaaggtatctcctggaacttcctggggtgatggctagacggtggtttagtagattgcacataacagaaacaaacacacaattccctgaacttttagaaatcctttttctaatggaacagaaattaaaaaaagaaaaaaaaaagaatgtgtaaacaaaaactcagctgtacgtaagaaaacccaactccccctaagaaggagaaagagctggagtcctttaaaaattaactgcctgtttttctgtggctagtgagccttatctctccttctttcccaggcattgtgaagaccctgtttctctagctgtgcagctgcaaggtcactagacagataaactcaagtcataaaacatgttttccttgaaaagtaagaaacgatgtaatgcacttctcaattaattgaataactatctttgtttcttgcttctgtaatatgcttccccctgcacagatctcccccaaccccatgaaatgcttaaaaggtaacttaactctttgttcagggctcagtcctttggatgttaatccgactgggccagtacacctaaaataacaaatatcctcctctaccccatcggtctctctgattccttatcaatcctgctacactacagtataccagagaagttccagcattttgcaaaggtagaactttggttggctctacctaaatcaggctttgattagctaacttaacagaccattaacataatttctggccaaagcattaaatccacaatcccaggtgagtatggccatatcagtaagttcggcccagccaactctcgatctaacaaccttagaatccaccctcacacaatgcttctgagattcctggcaatgtagattagtaatttcttgtaactgttctggtttataaactatctcctcttggagtggaccttgtacctctgtctgggctgtcctgaaatacaaatctcattgtgagctaaaggcaatgagaaatagtagagggggaatcctgaggagaatcagcttaagtgtgtgtggcaactgtgccagtgcagtcactgaaaggcttttatgcagaaaagggccgcttccctcaaaagggagagtaagggttccctacaccaacaaggcactttggaagttcaagattcttagccttgtgtatgtttgcccaaatgtcctaatcccaggcctcagagttctacttcttccccactagtgcccttatcttagtgcaaaagacctggcagagttaagcatttggtagtactgtaggcattgtaaccctgtgacccttgcaatggaacccagggttgccctcaacccatgctgtgactatgagataaaggaccacttcagagctgccagggaggtcttctgattttctgcacaggtttttaattttttttttttttactattttattgaggtatggttgatgtacaataaactacacatatttaaattgtacaatgtacagttttgacatgtctatatacctgtaaatccatcactacaataaaaaataaatctatccatcaccctctgacgtttccttgtactcctttggaatccctctctttttcctctttcctatctccagacaactactgatctgatttgtgtcacttcagatttgtgtcttctagaattgtatgtgaatggaatcatacagtatgtattcttttttgatagatttatttcattcggcattattttgaggttcgtccatgtcattctgtctatcagtagttcattctgttgtactgctgcgtagtattcctttgtgtagatatcctaccacttgcttatccattcacctgctgatgcaaatttgtgctgtttctggtttttcgcaattaaaatgacaaataaaccagctatgaacattcacatacaatctttctgtggacatgtttttatttctcttgggtaagcatgtaggggtggaatgactaggtagaatatttggtgtgtttacttgtttaaaaaaaaacttgtcaaaccgttttctgaagtacacattctaatttgcatttgctccatatccttgccaacaattggcatgacagactatttcagtcattctagtgggtgtgtaggggtatctcattatcattttagttagcacttctctaatgattaatcatagtcactggttgagttatgctaatttgctaggtatgtatcttcactgatggagtgtttattcaaattttttgcccactttaaaatgtgattgtttgagaggttttttttttgttttttttttttttacatattcttgattcaagaactttgtcagatatatattttgcaaatgttttatcccggtctatggcttttaattttgataaagtaaaatttaaaattgtttcttttatagttcctgacttctatgtcctctttaaaaaatcttggccagaacaaaaggcactaagattttctccttcaattacttttagatgctttatggtttttgctcttatatttagatctataatctcttttcagttaattttacacatgctgtaagagaacactcaagtttcatttttctgcatttgaaaatccaatttgttgaaaagactattttttcccaattaagttcccttggcacctctgttgaaaattaattaacaatatacatgggggtttatttatttatttttttgagacggagtctcgctctgtcgcccaggctggatagtgcgaggatagcagtggctggggggaaaggctgactgattccaaggaatgagtcatcttgctcacctgattattaagattcttctctgttgagattgttctttggtgagcattcacatacgacacaagcatcttctcacttggtgcccatctggagaagtctgcacatacctcttccccagaccacttgtcaccaattttctaaccatgttctttccaaatccctgaccatccagtcaaaccatccatcaatcaccatccatctatagatctatacttctggccatcttttctttcaggcacaatatacaaccaggtatgctacttgaggttctgtcccagtaggatttcccttcccctctgtactgcaagtgaagctgtaatgtatatggaacttcctgtgagtcccaccttttacttgacccccttaggcctgttaggacttgagtttgaccaatggaatgcaaaataaatgttgctgtgacttccaagataaggccttaaaaagccttgtaacttccactttctgtctttgatacttttttttgtgtttgtttcgagatggagtctcgctctgtcacccaggctggagtgcagtggtgcgatctctgctcactgcaagctccgcctcctgggttcacgccattctcctgcctcagcctcccaagtagctgggactacaggcgcctgccaccaagcccggctaattttttcttttctttttttttttttttggatttttaactagagacggggtttcaccatgttagcgaggatggtctcaatctcccgatctcgtgatctgcctgcctcagcctcccaaagtgctgggattacaggcgtgagccaccgcgcccggccacatgggggtttatttcacaattccatattctgttccattgacctatatttctgtctatatgccaataccacaatgtcatgattacagtagctttataagtcttgaaatcaagtagtatagttctccaatgttgggattcgatcaggctgctgggaaaaatattagttatgatggccacaaaacctttttggaaggcctgagggttttcacatgacctcggtaacagaccgggccgaaggcggcctggtcccattaactttagttaaaaagattaaagtagtaaacaacgggatgtggcgaagttttacctagttagcttgtttactcatgcggtcttaagacaagcctttgatgtgtgctttttactcgggaagtccacaatgtcagttagcctctaatggcgttcactcaaacttttgttaactaatcttaatgaataaatatgagtctccctagctgattggggccagctgcagtgacaagcctctcttggtgtgtaggcggttggacactcagcaggactggcaaaacagaatatctgtgtgtcagtgtgcgttttattcatctgtcgtttgggtcagggtctgcgggcagaccccctgcagctaatgccctcttgtgaggagcaatacctcatttcaaatttgtttttttcccaaaatactacgtatttccttagtaagtgtttcatcaacttacatttgcctcatccactctatttttctaagttttcttttcttttccaaatcttgccttctcttcagtttagagaaatggaattcactttcctttttgtcttccaccaccataccatcagtagatagccaaaactattgagaaacaaaaatgaacatacaaaatgttgaaatatcgattgtgaggttatctggcaatagacaagaacttctatgtgttcagtaggaatatggcaagatagaaacagaggagaggatagatactttcaaggtatttctaattaagtgatgggtgagtagtacactcagccttcagaagcacatgctacagatagatcaacaaagtactagtgtactgaggtgcttaataagtgttgaatggataaataaacagatatattctaagagtgtctcatcttctcacatgaatagacctgacctactcttagtgctgatggcttttgatgactctaatcctcaaggagtacagccacccttcaggaatgcagaagtccctgtaccatgtcctaagactttgtggtttccccgttatgacattttctcctaactggttgtctattttcccccttccaactcattccccctgctctatcacacataccctagataataaggaaagtttgttaatccttccaaacactatatatttgcccttattaaaccacttaacatgtttaccacactgtactgaaatatcctgtttacttgactgtctccctaattgaaaggcaaactacttaagtctatcccctgcatccagaacaatgtctggtatatggttgatatgcaatagtttattattaaacaaatgaatgaattcataccttgatcattttcacttttcatacttggtatattcttttgtgtttgtttttgttgttgttgttagtttgttttttgagacagagtctcactctgtcgcccaggctgaagtgcagtggtgccatctcagctcaaagtgctgggattacaggcatgagccacagagcctggtcatacttagtgttaatatattcaacataccaaattctacaatccgtatactgggtatataatctgctgagtaccagagagtatctaaagatggtctagattcaaagctgataattaaaagtagaaataaatgtagtaagaaaaagataaattgctgtgccttgaagtattattagcaacccctgagtagctaacttaagcaaaatttatcaattaaattactaggatttattattttaaaaaataattttaaaattaatttttgaaaagacaaatgggtttctaaatacgtaaggttaaaaattaacatttctcttttcttactgtatcagaaactggcctccagccattgttttctatacgatgataccagccactatgatcctcttcctgaagatgatcatttttattatgagatgtatgctttgctggaagttttgcataatttctagggctgttagcacagagatcttcaataggtctgtgagtaaaaatcttatagtatatatcaggtggaaatttaacctgtagaaggaaaagttcaaagagccattgtaatgtaactacaaaaatgttttacattttgaaaaattacattgtttcaatttcataaaaatgtgctttataactactaaataagcattcatccatacttactccacctaatctgaatcgcacatgaatgccagcagcagcatctagaagctctgcctataagaaaatatattattcttatatattattcttcaggattctgtatgtatcaattcactatttctcactctattattttaaataattgctaaatattgactatttaggaaatcagtcaggtgaaccaacctcaaataatcaattttaaattagaaaaattgttaaaaaaatttttttgagatgggatttcactctgttgcccaggctggagtgcggtggcatgatctcagctcactgcagccttaacctcctgggctcaagcgatgctcccatctcagcctcccagatagctgagactacaggtgtgcaccaccatgcctggctaattttgtatttttttttttttttgtagagacaagagtcttcctatgttgccaagctggtctcgaattcttggcctcaagtgatactcctgtcttggcctcccaaagtgctaagattacaggcatgagccactgtgctcagccattaaaaaaaattttttttttgtaattagaaaatattttatgaggccgggcatggtggctcacgcctgtaatcccagaactttgggaggccgaggtgggtggataatgaggtcaggagatcgagaccacggtgaaaccccgtctctactaaaaatacaaaaaattagctaggcatggtggcaggcacctgtagtctcagctactcaggaggctgaggcaggagaatggcacgaacccaggaggcagagtttgcagtgagccaagatcgccccactgcactccagcctgggcgacagagcaagactctgtctcaaaaaaaaaaaaaaaaaaaaagaaaagaaaagaaaatattttatgagctaaggacttaatttctttttattattattattattattattattattattttattattacactttaagttttagggtacatgtgcacaatgtgcaggttagttacataggtatacatgtgccatgctggtgcgctgcacccactaaaaggacttaatttcttatggacatctatggtaaatgaaaaaatgataccaaactgtttcctttttatgcaatatataaacataaaagccaagtaattttttagtcataaaacttaacttttaaataactcctcaaatattacatataaaatattatcttgcaggtaaattcaaagaaaaaattatgactgatcaacctaaattcaacagtagatgacctttcctaattagctattgttaaatttaaaaatccatgtttaaaattctgggccgggcgtggtggctcacacctgtaatcccaacactttgggaagccgaggagggtggattgtttgaggtcaggagttccaaagccagcctggccaacatggtgaaaccctgtctctactaaaaatacaaaaattagctgggtgtggtgtcggatgcctgtaattccagctactctggaggctgaggcaggagaatcgcttgaaccagggaggtggaggcttcagtgagcagagattgcaccactgcactccagcctgggcaacagagactctgtctcaataaataaaataaaataaaataaaataaaataaaataaaataaaataaaataaaataaaatgatataagaattgtatataataggttttctagattttagtttggtatgcagcaccaaatggaaagtagagaaaaaaattcttggtcctttatcggaagacagttcaatcttgtctcctgatcatattaggttagatcagaaaatagatgttattcaacctatagagtcttaaagacaacattaattttgcagaataatcttctcttgactaaaacttttatgaattcaaatatgaagtgtgagatcctgttataaaacatattttctatatttgagccataataatatatacacatttttttcactaaggtggacagatcttaagtgtacagctccatgaatttttacatatgtattgtactctcttgtgcttggcttattttgctcaacatgaatctgtgataaatctctaagattcgtgtatgtagttgtagatagcagcagttagttctttttcactgctatctaacattccatcatataatagaatatatgacaatttatattattgttggacatttgatatgtctctagttttgggttaaaatgaataaaactactcattctgtgaacattcatttttatgtcttctgtgggttataacaatcatttctctttgttacatacccaggaatgaaatatgagaggtcatgaggtatatatggtatgtaagtatacagatggccccgacttaaagtggttcaacttacaattttgactacaatggtgtgaaagtgatatgcattcagtagaaatcatacttcacattttgaattttgatcttttcccaggctagcaatatgtggtatgatgctcttgtcgtgatgctgggcagtggcagcaagccacagcttccagtcagccacatgatcatgagggtaaacaactgatactctacagcaggggtccccaacccccaggccatggactggtaccagtccatggcctgttaagactgggccacacagcaggaggtgagcggcaggagcattactgcctgagctccccatcctgtcagatcagcagcaacattagattctcataggtgcacaaaccctcttgtgaactgcacacgcacaggatctaggttgcatacgccttatgagaatctaatgccttgatgatctgcggtggaacagtttcatcccaaaaccatcctccacatcccaagtctgtggtaaaattatcttccactaaaccggtccctggcaccaaaaagttaggactgctgctctacagtatagactaagttaaattggtaagttatgtttggcaggttaggtatattaagtgcagtttttgcttatgatattttcaccttacaatgagtttatcttaacataaccctgccataagccaaggagcatctgtaatttgctgtactagtgactaccaaagagttttccaaatttttgtaacaatccccccaccagcaatatatgagttctggttgctccgtctctttatcaacatttggtactgtcaatccttctaattttagccattctggtggggttataatggtagctcattgtagtttttaattgtattttcttatgactaaccatgctgagcaccttgcatatgcttattggccatatggatctatcagtcatgctagtagtttatcaattttattaacatattcaatgaaccaactggcttttatttgcatagtggcaccatcatggttcaatgcagcctcaacctccctgactcaactgatccttctacctaaccattccaagtagctgggactaaaggcacgcaccatcgtgacaggctaatttttttaattttttgtaggtaagggatttctccatgttgcccaggctggtctcaaactcctgggctcaagtgatctgtgcaccttggcttcccaaactgctgggattacagatgcgaaccaccctgccagccacttctactttctattcattgatttctgattttatcttcactatttccttccttttactttttttttttttttgagacagagtcttgctctgtcgctcagtctggggtgcagtggcctgatcttggctcactgaaacctctgcctcctgagttcaagtgattctcctgcctcagcctcctgagtaggtgggattacaggcacacgcaaccacgactggctaattttttcatatttttagtagagacggggtttcaccatgttggtcagactggtctcgaactcctgacctcatgatccccctgccttggcctcccaaactgctggtattacaggcatgagccaccatgcccggcccccttccttttactttctttggtattaatttggttatctttttctagcttgaagtgtaaactttgtaaattgatttttaatttttcttcttttctaatatttgcatttagaggtataaatttctgtctgagctctactttagatacattccacatgttttgatgtcacattttcattatgacttagtataaaatatattctaattttctcttttaatccatagattatttaatttcatgtgcttaatttgcaaaaatttggtggttttctacttctgtattctcattaatttttagtttaattccactgggactagaaaacattctctgtgatttcaaaacttggaaatttgttgagactttcattaaatccaagcatgtgatctattacgggaaacattttctgtgcacttaaaaataacattacttttgcaaaactgtagacattttgcagtgttgcaaaagtagtgacagcgttctctctatatatcaattaggtaaagaatttaaaatctacaatatctgtactaaatttttttgtgtgcttgtttctatcagttaccaagagagttgtgttaaaatcttcgactatgcttgatgattactatatttcttctggtaattatgtaagtttttgtcttataagtacagaatttttatatttttctattgaactgactctatcattatgaaactgctctctttatatctcacaaaactttatcccttaaagcttaatttgtccaatactaacataatgacactgattttctttttcttttttctttttttttttttgagatggagtctcgctctgtcatccaggctggagtgcagtggtgtgatctcagctcacgcaacctccaccttccaggttcaagtggttctcctgcctcagcttcccaagtaactgggatttacttttgcctgactaaattttgtatttttagtagagacggggtttcaccacgttggccaagctggtctcgaatgcctgacctcaagttatccacccacctcggcctcccaaagtgttgggattacaggtgtgagcaccatgcctggtctgactttcttttaattaaagtttgcatgatgtatatttttccattgtcttattgttttatattcttattgtttaaagtatgcctcaaaaataataaacagatggggtttttgtcagtctgacaacctttgctttcatttgggttctttagtctatttacatgtaaaacatacacatgaaatcgtataaaatgctcaattaaaaccagagaaggcagtaaagtgaaggaatacagagaaaaaaaaaacaatggcaacaaacaggaaacaattacaaatacaataaatatcgattgaactatatcaataactttaaatgtcaatgatctacatataccaattacaaagggcagatcagagactgtcagagcggataaaaaatcaagacccaactatatgttatccacaagcaacccactttaaatataaagacacagattaataacaaagaaaagaacaaagacgaacctgggcaatatagttagactctgactccacgcaaaaaattttaaaattagctgggtgtggtggcatgcaccagtagtcccagctacttcagaggctggggcgggaggatcacttgagcctggcaggtcaagggcggcagtgacccattatgacaccactgcactccaatctggacaacagagtgaggctttatcgaagaggaagaaagaagaaagaagaagaagaaagatatatgatactaacactaatagaacgaaagctgagctgctatattaatttcagacaaggccaaattaagatcaaggaaaactgtcaggactaaatggagcattacatgatgataatgtatgtacttaacaacaaagcagcaaaatatgtgaagcaaaaactgataaaactgcaagaaaaaatatagtaatttactaacataattggagatttcaatacccctctatcagtaattgacagattcagcaagtcagaaaaccagtaaggccataattgaactgaacagcagcataaattaactggatccaattgacatttataaaacacttcttcgaacaacagaatatatattcttctccagcacagacaaaatatttggcaagacagaccacgttctgggccataaaacacaccttaatacacttttttatttgtacaaatttgtgcagtatatgtgcaattttgttacatgcatagaatgcagagtggtcaagtcagggcttttagagtatccatcacccaattaatgtacattgtatccattaactaatttcccatcgtccacttccctccaaccagctcatccttccaactctccactgtctatcactccactctctacgttcatgtgtatacatttttagcatccacttctatgtgagaacatttgatatatatatataagatcatgtcaccagtagaaaaaagataatctgacttcttattttcccatttgaatgccttttatttctttctcttgcctgattgtgctggctaggacttcagtactgtcctgaacttgagtggtaataataagcatccttgtctttttccaattcttagaggaagcgctttcaacttttccccattccatacaatattagctgtggatttgtcatatatgggcctatcttaacaaatttaaaaggaatagaaatcatacaaagtatactctcacacctcaatagtattaaactagaaatcagtaacagagagataactggaaaaccccaaaacttgaaaattaaataacacacttctaaataacaagtaggtcaaataaagagtctcaagagaagttaaaaatactttgaaataaatgaaaacgaaaatacaacttactaaaatttgagggattcagcaaaaacagagcttacaggaaaatttatagtactgaatgtgtgtattagaaaacaaaaaatatctgaaagaaataatctaatgttctgccttgagggactagaaaagcaaagcaaattaaattcaaagcaagcagacgaaaataaataataaagattagagcagaaatcaatgaaattgataacaagaaatctataaagaaaataaaagaaacaaaaagctggtttgaaaagatcaataaaattgataagcttctggctagggtaactaagaaaaaaagacagatattacacattactaatatcagaaatggtccttgtcatttctgtctaattgaatactttattgtcatgatgatggttactcttcatggacatcttaatcttccacacacatcccctttttttggaataaaatttgtaaagaatgaaaatggtgaaggaaaaaaaaagaaacaaaatagaggtcatcattactgattgcatggacactaaaaaggataataaacaaattttatgagcacaaataactctatgccctcaaattttataacctagatgaaagagaccaattccctaaagacataatctaccaaaaatcacagaagtagtagataattttaataggcctatctctattaaagaaatagaatcaataattaaaacttttcaaaacagaaaaaaagcacaaggcccagatggattcactggtaaattctaccagacatttaaaaaagaaatttattttactatttacagtctcttccagaaaataaaatcaaagggaatacttcctaacacatttgatgaggccagcataaccctaatacaaaaaccacacagagacattacatgaaaggaaaattatagaccaatatctctcatgagcatagacttaaaaatcctcaaaaatttagtaagtcaaatccaacaatgtataaaaataattatacaccatgatcaagtgggatttattttgcaaggccactattatattgtatcaacaggctaaagaagaaaagtcatatgatcatattagcagatgtagaaaaagcatttgacaaaatccaacacccattcatgataacaactttggcaaactaggactagaggggaacttcctctaattaataatatctacaagaaacatacacctaatatcatacttaatggtgagaaactaaatgttttcctacaaagatgtcccctcaccttttctattcaacatcacactggaagtcctagctaatgcaataagacaagaaaaggaaatgaaaagtatacagattgagaagggagaaaaagaactgtctttgttctcagatgacatgattgtctatgttaaaaaatcccaatgaatcacaaggttaatatactaatcaactgctttattatataccagcaataagcaaccagaatttgaaattttaaaacacattgtcatttatatcagcacgcaaaaaagtaaaatacttaggtataaatctaacaaaatatataaaaatcgatatgagggaaactacaagaccgtgatgaaggaaatcaaagaagatttaaatgaatggagagatattccatacacccgaataggaagactcaatattgtcaagatgtctgttcttcccatctttctggatctatagattcaatgcaatctcaatcaaaatcccaggaacttattttgtgtataaggacaaactgattataaattttaagtggaaaggcaaaagacccagaatagccactataatatttcaggtgaacaacaaagttggagaattgacaccacccaacttcaagacttaccacgaaactacaataatcaagacactgtggtactggtgaaagaatacacaaataaatcaatgcaacagaagacagagcccagaaatagacccacacaaacagttaactattctctgacaaaggggcaaaggcaatttagtgacaaaagaatagtcttcaacaaatggtgctggaacaccatttggacattgcgggaatccacgttcaagaaaaaaaaaatctagacaaagatcttacacctttcacaaaacagtaactaaaactggatcataacttaaatgtaaaatgcaaaactatataactcttagaagataacataggaggaaatctaggtgagcttgggtttggtgatgactttttagatataacaccaaaagcataatagatatgacggacttcattaaaaagttgtactcaatgaaagacattaagataatgaaaagacaggtcataaactgggaagaaaatacttgcaaaacacatatctgataaagggctggtatttaaaatatacaaagaactctttaaccttcactataagaaaacaaacaacctgaattaaaaatgggcaaaggacctgtaaagctatcttcactaaagaagatatacagacgatacataagcatatgaaaagatggtcaacgttgtatgtcattaaggaattacaaattaaaacaacaatgagggcccgggcatggtggctcaagcctgcaatcacaacactttgggaggctgaggcaggtggatcacttgaggtcaggagtttgagaccagccatggctaacatggtgaaaccccgtctctactaaaaatacaaaaattagacgggcgtgatggggtgtgaattccagctactcgggacactgaggcaggagaatcacttgaacctgggaggcagaggttgcaatgagctgagattgtgacactgcactccagcctgggcgacagaaactccgtgtcaaaacaacaacaacaacaaaacaaaaacaatgagatacctctatacaccttttagaatgaccaaattcaaatactgacaacactagatgctagcaaggatgtggagtggtaattctttgctggtcggaatgcaaaatggcacagccactttggaaaaagtttggcagtttcttattgaactaaatgtactcttaccataagatccatcaatagagaatttaaaagaacaacagcaagaatataagtcaaaggggataatgagaaataagtgcattgtctgggagaagataaaaatgcaaatctatatatgatttcataagtcaaatatgcatgttgcaatctcttgaataagtttaaaagaatgataatatatagagaaaaatataaaaaactcattcccatagaaggccataacatgttgaaaaagaacgtagaacgtctgagacatacagagagtaaatagtaacagggtagatttaaatccccaaacatcagtaattacattacatgtgaatgaagtaaatgttctgacaaaagacaaagagtatcctactggataaaaaatgttagctaacaacctgctgccaggtcaggtgcggcggctcacacctgtaatcccagcactttgggaggccgaggcaggaggattgcctgagttcaggagtttgaaaccagcctgggcaacatggcaaaataccatctctactaaaaatacaaaaaattagccgggcgtggtggcacatgcctgtaattccaactactggggaggctggagcacaagaatgcttgaacccgggaggtggaggttgcagtgagctgagatagatagtgccacttcactctagcctgggcaacagaacgagactctgtctcaaaaaaacaaaaacaaacaaacaaaaaaaaacctgctgcctataaaaagacacagcaaaaatgtaaagattcagaatgttggaagtaaaatgacaggaaagatgtaccatgcaaataagagacagttggtgtgcgcatgttctcactcataatgggagttgaacaatgagaatgaacacatggacacagggaggggaacatcacactctggggcctgtcagcaggtggcgggctaggggagggacagcattaggagaaatacctaatgtagatgatgggttgatgagtgcagcaaaccaccatggcaagtgtatacctatgtaacaaacctgcacattctgcacaagtatctcaaaacttaaagtatgataataaaaaaaggaaacacaatattactgacagtaaaactttctgatttgttaaaaaaaaaaaaagagacagttggtgtggttgtattaataccagaaatttgagaccttaagggacacactttataatgataaaaggttcaattcaagaaagatacaataatctgaagtattcacttaataacatggtctcaaatatatacaaaccaccagaaaaatagacaaatcttcagtcatagtggaagcttttaatacatatctctcagtaactgatagtataactagacaaaaatattcagtaaggctatagaagatttgatcaacataactgaaaaatttgacctaattgacatctatgcaatactatgctcaataactaaaaaatatatattcttttcaagtacagataaaaatttataaaaaatagacaacagaggattgaaagtacagcacaatcaagataagggctgacaacaaaaagataactggctaatttccaaattaaataactgaaataaagtagaaattttaaaatattttgaactgaatttgatatgaaaatatgacatatcaaaacttgtaagctgcagctaagaccattcttagataaaaatttatgtccttaaatacatataccagaaaaggctacaagtcaataaattcagcatccatttcaaaaagttagaaaaataacagcaaacagaattcaaagaaaatataaagaaggaaataataaacagcagaaaatgatgaggtaggacacaaatgaacaacacaaagaaacaacaaagctaaaaattgtttttggaaaagaccaataaaagtaataaactccaaagagactgctcaagaaaaaaaagaggagatgcaaataaccaataccaggaataaaataaagataactattacagattctaaggcattagaaagatcataaaaagtattatgaataattttaagctaataaatttgaaaatttagatgaaaacttcctagaaaaatacaacttatcagagctagcacaagaagaaatacaaaatagaaatagaactataattctaaattgaatgtaatttaaaatcttttcatggaaaaaacttctggcacagatggtttcattagtaaatccttacaaagtacatttaaggatgaaaataacactcaatgtgaaaaagaaattcagaaaataaacagagtagaaacatttcccaatttgttttaggaggccagctaaatgtgataccaaaatctgacagagacagtaaattagacgttctgcaggaacacaggtgcaaatatttataccaaatattagcaaactaaattcagtgatattttaaagggataagataatcataaccaaaatgtacctattctaggaacgctaagacgatttaacattcaaacaaaaaataagaacaaaagaaaaattgtatctcaattaaagcaaaaaaggtctcataaaatttagcatctgttcttggatttctaaaaaactcttgtctgggcacagtggctcatgtctgtaatcctggcactttcaaaggccaaggcaggaggattgcttgaggacaagagtttgagaccagtctgggcaacataggaagactctgtctctacaaaaaaagttttaaaaaattagctgggcatggtggcccacacctgtggtcccagctacttgggaggctgaggtggaaggatcacttgagcccaggaggttgaggctgcagtgagctatgatggcaccaatgcactccagcctgggtaacagagtgagacctggcctctaaaaataaaatcaaaaaactcttttagttcaacaggaatagaaggaaacttccttaatcagataaaaggattctataacaaacaaacaaacaaaaatagcatacctcatacttaatgatgaaatattgatcctttccctctgaaatccagaataagacagtggttatcacttctattcaccattactgaaggctctagccagtgtataatggcaagaaaaagaaataaaatgtatcatgtttgaaaaggcaaaaacaaaactcattgaggatgacatgattgtttatattgaaaatccaaaataatcaatgtacacattattagaattaataaatgaggattgcaaagttgttgggaacaaagctaatgtgcaaaaattgattgtctttctacataatagcatcaaaaataagaaaataaaaattttgtaattaaccatttataggagcattaaaaagcaagttataaatctagcaaaagatatgtaagacctctctatagaaaactataaagcatttgttcagagaaaatttagaagaactaaataacatttcaaattaggttttccaaaagaagatgcttatatgaagtttgagtgccacaggtttattagggctcaatacctatggaagaaaggggagggaagaagaactgggcagaagaagagttggaactgcaatgtaagccacacaaagcctgggccaattctgcttggacctctaaagtgaatactgccacaatggcttctagacccatctcctcacccaccacattctgctcagtcactggacatgggttgacctagcatcactggaaagggttgacctagcatcaggcagttctttgcaattagggtagaaactgaagatcctcacagctggaggctgtctgtggactgcagtccctgagattgggtagtaaatccttcttaaagagggatctaacagcatatcccttatttcccacaaatgttcatgatttagagctctcagtattgtcatgataccagttttcctcaaattgagccaaatattcaatacaatctcgatcaacattccaacagacttttaatttaattttttatttttattttgtagagatggggtctcactatgttgccctggctggtgtcaaactcctgagctcaagtgatcctcctgcctcagcctcccaaagtgctgggattacaggtgtgagctaccgcacccggccaaaattccaatagactttaaaaatatgttttattttggtaaaaatccacacaacataaattaaccattagtgacatttagtactttcatattatacagccactacttccacaatattttcatcactccaaaaggaaaccccatatctatcaagcagtcacttccttcaccctagcccccaacacctggcaagcactagtcgtctttctcttttttgataatctctatttgttcagacatgtccatgtatctttctcctcagcttcattctacctagatttttaggtttgcctgttcctgccttgtctgctgtctattgcctgaggtggctgcaggttgtatatgattttaaatcctataagctggcccatccctgtgatggcatggagaggtgtgaaataaagggaaactctgtgcaggttcctcggggaactgccagacaaatcaaaatacacaaccaggccaggtgcgatagctcacgcctataatcccagaactttgggaggccgaggcgagcggatcacttgaggtcaggagttcgagaccagcctgaccaacatggtgaaaccctgtctctactaaaaatacaaaaaaaattagctgggcttggtggtggcgcctgtaatcccaactacttgggaggctgaagcaggagaatcacttgaatctgggaggcgaaggttgcagtgagccgagatcgtgccactgcactccagtctgggtgacagagcaagactccatctcaaaaacaaaaacaaacacacacactcaaacataaccacaatttttgagaacaagttctatattttacactctggccccaaaaagccacaccaggaataggggcctttgtttccacagctgctgccaagctggagaacaaggcatgtttgataggtaggcaaaaacaccaccctgctttcttcaagtttagtagcctttttctccattaaaagcattcccctggttgctctaagtttttaattagattccagagttccaataaagttgattctgatggttattctttttttttgagacgaagtctcacactgtcacccgggttggtgtgcagtggcgcaatctcggcttgctgcaacctctgcctccctggcccaagcgattctcctgtcaacctcccgagtagctgggactacaggcgcatgccaccatgcctggctaatttttgtatttttagtagagacggggtttcactatgttggccaggctggtctcgaactcctgacctcatgatccgcccgactcagcctcccaaagtgctgggattacaggcgtgagccaccgcgcctggccgacacttattcttagaattccttactctacaattttcacttccccaacagatttattttggtgtggaaattgaaaagctaattcaaacatttatgtggaaataaaaagcattcaagaatagcctggagtgttttcttgaaaaagaattgtaagattggaggtcttctctaccatttaataggactgttataaagctgtaatagttacgacaacagtagaaaaatagaccaatggaacagaccaatacataaatggccacctgatttaattattttaaaggtggcaccgcagagcagtagggacaggatagtattttcaataaatagcatttaatcacttggatatctgtagggaagaatgagaatgttgacctgggctgggcatggtggctcacacctgtaatcccagcactttgggaggccaaggtgggcggatcacgaggtcaggagatggagaccatcctggctaacatggtgaaaccccgtttctactaaaaatacaaaaattagcagggcatggtggcgggcacctgtagtcccagctactcgagaggctgaggcaggagcatcacttgaacctgggaggcggaggttgcagtgagccaagatcgcaccatgggactccagcctgggcgacagagcaagactctgtctcaaaaaaaaaaaaaaagctggcctgtacctcacaccatacacagaggtcagtcccaggtggactgcagatctaagtataaaatgcaaatcaataaatcttgtataatatgagaatatttttataaccttggagttggaaaaggttataaaaagcaccagctgtgcattctggccagatactatgcttttcgcacgatcttcccaacctgcacaccaggagattccctaggttgcctatgccaacagggccctgggtttcaagcacaaaattgagcagccctttgggcagacaccaagctagctgcagttttttttcataccccagtggcacctggaatgccagcgagacagacccattcactcccctagaaagggggctgaagccagggagccaagtggtctagctcagcggatcccacccccatggagcccagcaagctaagatccactggcttgaaatttttgctgccagcacaacagtctgaaatcgacctgggacactggagtttggtggggggagggacatctgcaattactgaggctagagtaggctgttttcccctcacagagcacctgggggaaggggtggctgtgggtgtagcttcagcagacttaaacgttcctgcctgccagctctgaagagagcagcagatctcccagcacagtgctcgagctctgctaagggacagactgcctcctcaagtggatccctgacccccatgcctcctgactgggagacatctcccagcaggggttgacagacacctcatataggagagctctggctggcatctggcaggtgcccctctgggacaaagcttccagaggaaggaacagtcagcaatctttgctgttctgcagcctccactggtgatacccaggcaaatagggtctggagtggaactccagcagactccagcagacctgcagcagaggggcctgttagaaggaaaactaacaaacagaaaggaatagcatcaacatcaacaaaaagaacatccacacagaaaccccattcgacggtcaccaacatcaaagaccaaaggtagagaaaaccacaaagatgaggaaaaacaggcactaaaaggcagaaaattccaaaaaccagaatacctcttctccttcaaagtatcacaactccttgccagcaagggaactaaactggacagagaatgagttagacgaattgacagaagtaggctttagaaggtggataacaaactcctccgagctaaaggagcatgttctagcccatgtaaggaagctaagaaccttaaaaagaggttagaggaattgctatctagaataaccagtttagagaagaatataaatgacctgatggagctgaaaaacacagcacaagaactttgtgaaggatacacaagtatcaatagctgaattgatcaagcggaagaaaggacatcagagattgaagatcaacttaatgaaataaagcatgaagacaagattagagaaaaaagaatgaaaaggagtgaacaaagcctccaagaaatatgggactatgtgaaaagaccaaacctacatttgattgatatacctgaaagtgatggggagaatggaaccaagttggaaaacactctcccaatacaggaacactcagattcataaagcaagttcttagagacctacaaggagacttagactcccacacaataattatgggagactttaacacccccctgtcaacattagacagatcaacgagacagaaaattaacaaggatattcaggacttgatctcagctctagaccaagcagacctaatagacatctacagaactctccaccccaaagcaacaaaagatacattcttctcaacatcacatcgcacttattctaaattgaccacataattggaagtaaacactcctcagcaaatgcaaaagaatggaaatcctaccagtctctcagaccacagtgcaatcaaattagaactccggattttaaaactcactcaaaactgcacaactacatggaaccttaacacctgctcctgaatgactactggataaataacgaaacgaaggcagaaataaataagttatttgaaaccaatgagaacaaagacacaatgtaccagacttcccaggaaacagctaaagcagtgtttagagggaaatttatagcactaaatggccataggagaaagcgggaaagatctaaaattgacaccctaatatcacaattaaaagaactagagaagcaagagcaaacacattcaaaatctagcagaagacaagaaatatctacgatcagagcagaactgaaggagataagagacacaaaaaaacctgcaaaaaatcagtgaatccaggagctgtttttttgaaaagattaacaaaatagaccactagccagactaacaaagaagagagaagaatcaaatagatacaataaaaaatgataaagatgatatcaccactgatcccagagaaatacaaactatcatcagagaatactatacacacctctatgcaaataaactagaaaatctagaagaaatggataaattcctggacacatacaccctcccaagactaaaccaggaagaagtcaaatccctgatagaccaataacaagttctgaaattgaggcagtaattaataggctaccaaccaaaaaaatcccaggaccagatggattcacagctgaattctaccagagatacaaagaggagctggtaccattccttctgaaactattccaaacaatagaaaaagaggggctactccctaactcattttatgaggccagcatcatcctgataccaaaccctggcagagacacaacaaaagaagaaaatttcaggccaatatacctgatgaacatcaatgtgaaaatcctccataaaatactggcaaaccgaatctagcagcacatcaaaaagcgtatccaccacgatcaagtcggcttcatccctgggatgcaaggctagttcaacatacacaaatcaataaatgtaatccatcacataaaaagaaccaattacaaaaaccacgtgattatctcaatagatgcagaaaaggcctttgataaaattcaacaccgcttcgtgctaaaaactttcaataaactaggtattcatggaacgtatctcaaaataataagagctatttatgacaaacccacagccaataccatactgaatgggcaaaagctggatgcattccctttgaaaaccggtataagacaaggatgccctctcttaccactccttttcaacatagtattggaagttctggccagggcaatcaggcaagagaaaaaaataaagagtattcaaatagaaagagaggaagtcaaattgtctctatttgcagatgacatgattgtatatttagaaagccccattgtctcagccccaaatcttcttaagctgataagcaacttcaacaaagtctcaggacacacaatcaatctgcaaaaatcacaagcattcctatacaccaataatagacaatcagagacccaaataatgagtgagctctcattcacaattgctacaaagagaataaaatacctaggaatacaactcacaagggatatgaaggacctcttcaaggagaactacacaccactgctcaaggaaataagagaggacacaaacaaatggaaaaacattccatgctcatgaataggaagaatcaatactgtgaaaatggccatactgcccaaagtaatttatagattctatgctatccccatcaagctaccattgactttcctcatagaattagaaaaaactactttaaatttcatatggaaccaaaaaaaaaacctgtatagccaagacaatcctaagcaaaaagaacaaagttggaggcatcatgctacctgacttcaaactatactacaaggccacagtaaccaaaacagcatggtactgataccaaaacagatatataaaccaatggaacagaacagaggcctcagaaataccaccacacatctcatccttgacaaacctgacaaaaacaaacacatctttgacactatctcatttttcacaaacctgacaaaaacaagcaatggggaaaagatttcctatttaataaatagtgctgggaaaaatggctagccatatgcagaaaactaaaactggaccccccttccttacaccttatacaaaaattaactctagatggattaaagacttaaacgtaagacctaaaaccataaaaatcctagaagaaaacctaggcaataccattcaggacctaggcatgggcaaagacttcatgattaaaacaccaaaagcaatggcaataaaagccaaaagtgacaaatgggatctaattaaactaaagagcttctgcacacaaaagaaactatcatcagaatgaacaggcaacctacagaatgggagaaaatttttgcaatctatccatctcacaaagggctaatatccagaatctataaggaacttaaacaaatttacaaaaaaaaaaaaaccccaccaaaaagggggtgaaggatatgaacagatgcttctcaaaagaagacaattatgtggtcaacaaacatattttaaaaagctcggccgggcgcgggctgacgcctgtaatcccagcactttgggaggccgagacaggcggatcacgaggtcaggagatcgagaccatcctggctaacacggtgaaaccccgtctctactaaaaaaaaatacaaaaattagccgggcatggtggcgcgcgtctgtagtcccagctacacgggaggctgaggcaggagaatggcgtgaacccgggaggcggagcttgcagtgagttgagatcgcgccactgcactccagcctgggcgacagagcgaaactccgcctcaaaaaaaaaaaaaaaaaaaaaaaagctcatcattactggtcattagagaaatgcaaatcaaaaccaaaatgagataccatctcacgccagttagaatggcaatctttttttttttttttttttttttgagacagagtctcgctctgttgcccaggctggagtgcagtggcgggatctcggctcactgcaagctccgcctcccgggttcacgccattctcctgcctcagcctcccaagtagctgggactacaggcgcccgccactacgaccggctaattttttgtatttttagtagagacgggtttcaccgttttagccgggatggtctcgatctcctgacctcgtgatccacccgcctcggcctcccaaagtgctgggattacaggcgtgagccaccgcgcccacccagaatggcaatcattaaaaagtcaggaaagaatagatgctggagaggatgtggagaaacaggaatgcttttacactgttggtgggagtgtaaattagttctaccagttgtggaagacagtgtgacaattcctcaaggatctagaaccagaagtaccatttgacccagcaaccccattactgggtatataccaaaaggattataaatcattctactataaagacacatgcacacgtatgtttattggagcagtgttcacaatagcaaagacttggaaccaacccaaacgcccatcaatgacagactggataaagaaaatgtgccacatatacaccatggaataccatgcagccataaaaaaggatgtgttcatgtcctttgcagggacatggatgaagctggaaaccatcattctcagcaaactaacacaggaacagaaaaccagacaccgcacattctcactcataagtgggagttgaacaatgagaacacatggacacagggaggggaacatcacatactggggtctgtagaggcgttggggggctagaggagggatagcgttaggagaaatacctaatgtagatgacaggttgatgggtgcagcaaatcaccatggtacatgtatacctatgtaacaaacctgcatgttctgcacatgtatcccagaacttaaagtattaaaaaacaaacaaacaaacaaaaataccaaaaaacgaaacaaaacaaaaaacaccagcttggtgtagtggctcatgcctgttatcccagcacattgggaggccaaggcataaggattgcttgagcccaggagtttgagacgagcctgcgtaacctagggagatcccatctctacaaaaaatgaaaaaattagctgggcatggtggcatgtgcctgttgctccagctacttgtgaggctgaggtgggaggatcgcttgggcccaggaggttgaggctgcagtgaactgtgatcacaccactatgctccagcctgggagacagaacgagaccctgtctcaaaaaaagaaaaagaaaaaagaaaaaaacaaattaaaaaggcaccaaccacataggaaaatattgataaattgaactacattaaaattaagaactttgttcatcaaaagacaccactgcttcaaaataacctagaggttgtagaaagtgggtagaggtatagatgaaataagattggttatgaattgctaactgttgaagctagatgatgggtacatggtggcttatgattttactctttctccttttgcatatatttgacatgttttataataaaaatcaaaggaaagactccattaagagagtgacaagccacagagtgaaaaaaagatgcaagtaacagataactgacaaagggcttctatgaagaatatataacccttgtgcattattggtgagagtacaaaatggtacagccactgtggaaaacagtatggttgttcctaaaaaacttaaaaatggaattaccatatgatccagcaattccacttctggatatatacccaaaagaattaaaagaagggtctcaaagagatatttgtataaccatttatagaagcattattcataatagctaaaacatggaagcaacccaagtgtccattggtggatgactgaacaagtacaatgtagtatatacacacaatggaatattattcagccttaagaaaggaaagaaatcccgcaataaactattacatgggtgaatcttgaggacactgtgctaagtgacataagccaatcacaaaaaggcaagtactgtataattccactcctatgaggtaattagtcaaattcatagggacaggaggtagaatgatagttgctgggagataggtggaagggaaaataaggagttactgtttaatgaggatagagttttggttttgtaagatgaaaagatttatggagatgggtggtggtgatggttggtgatggttacacacattataaatgtgtttagtactactgaactgtattctttttttttttttttttttgagacagagtcttgctctgtcgcccaggctggagtgcagtggtgtgatctctgctcactgaaagctccgcctcccacgttcatgccattctcctgcctcagcctcccgagtagctgggactacaggcacctgccaccacgcctggctaatttttttttttttttttgtatttttagtagagacagggtttcgccatgttagccagggtggtctcgatctcctgacctcgtgatccgcccgcctcggcctcccaaagtgctggaattacaggtgtgagccactgcgcccagcctgaactgtattcttaaaaatcgttaagatagtaaattttatattatgcgtactttaccacaaaaagtaaattgagaaaaaagtagttttaaaaaaatacaaagaactgatttttaaaagaccaataagggtacggtggtttacacctgtaatcccagcactttgggaggccaaggtaggcagatcacttgagtccaggagttcaagaccagcttgagcaacatggcaaaaccctgtctctactgaaaatacaaaaaattagctggacgcggtggcatgcgcctatagtcccagttattcatggggctgaagcaggaggattgcttgagtccaggaggttaacgctgcagtgagccctgatcgtgccactgcactctaacctgggtgacagagtgagaccctgtcttaaaaaaataaataaataaaacaaaaaaaaacccaaaacccataaggatagggaacacacacacacacacacacacacacacacacacacacacacacacacagaggagagttgaataagcactttccacatcacaaaagtatcagggaaatacaaattacaaactgacaatattatgtattggtgagaatgtaaagcactaagaataccaaagattgctagtgcaaatataaattagtacaatagctttgggaaataatctggcattatctcccagagttgtgataaggataatttgttgctcaccaattccatttctaggtgtagtataaacaaaaaaaaaatgtgtacacttatccatgaggagacatgaaaattcccagaaacagttattaaaatagccccaaactagaaaaaatacaaaagtcaatcaactgtagaatgaataaatagcaatatattcataaaagagaataatggctattaattaaaaatgaatgaattttagctacataaatgtattgttggatgaacaaatatataccccaaagcatactataggattctatttatatacagttcaaaaacaggaaattaaagtattatgttagaatataaaatagtggttaccttttggaagaagggagttggcaatgatttgcagggtacccaaagggagtgatttggagtatgaaaacattgatctgggtgacggttacataggtgtttgctttgtgatgattcattgagctatatatgttttatgaactttcaacatatgtgtaatactttaataaaaacagttttaaaaagaaacaaatatgatgagcacactgaattgataaagtaatcacattttatggaaaaatataggatgctatatcaataagtaatgtccttacctctttgggattaatatatttcactatctgacgtggttctccttgtcttcttaaatcaatcagacttttaaagtgttgaaatatagcgacattctaaaggttcaaacacaagatttcatgatcaaaactggattttctatttctacttcgctttttgtctaatcagggcaaaaacgaataaagtaccataaaatagatttttatgtatccacactagattttagaaatattatgcactcagggtttgctttgataaccctagtagtattagtataattctcacaaagagatttattcttaaatttgtaattgcatcactaccaactataaatgtaatatcccaaactttggtaaagtcatctcagtgtactctccagagtaatctagaaaaaaaccaaaatacagactactgattaagaaccactgagtatgggatactcttgtctgggttcagctgttagtatttagcagctgtgactgtcgacaagttgcttaacctctttgcactcagtttcttcaactataaagtgggaatgatagtagccatctcatacagctttggtgagaaatacatgaattaatatttgtagagcatgtaaagctttctgacacaagaaaacattcaataaatattagccattgttaccattgcagaatcctccttattcctatagtaatcccactgatgtattacaggattctgtaatggtaacaacgactaatatttattgagtgttcatctatttttcacattagtgcaaatttagctaaacaatccctaccaattagtccatcttggaaaattatttctttggtaactctcccctcaagccccatctccctaaaaatgctttaataactcttggtaaacaccccactccccatttgcttatgttaaagcaaataaaataaattcaaatttaagtaacccatagtaccaatataacaatctaaagccccactacaattgcctatggaagatggtacagcccatgtctatactaatagtattctttctgaaaggaggatataattttccccaaataaaactccaaattgagtatcaagaaatacttattatggtttaaaatctgaatagtatcttctaaataggtggttactatatcagttgtctactaatacataacaaaccaccctaaaacttagtggtttagagcaacaaccatttattatttctctcttcctgtgggttgacaggggagttctgctggtcttggttggactcatacatgtggccttagtcagctgccagatcagctggagttgagtgatttaatatggcctcacccacatatcagggtcttcagctgaaatttttggaatatctaggatagctgggcctctctttccaaacagaccttcagtttgagcttcttcatagtatggaggttttaaagtaccaaagagagactgggtgcaatggctcacgcctgtaatcccagcactttggaggggcgaggcattaaaaaaaaatttatatatatatatctctctctatatatatatagatatatatagatatatatatatgccgggctcagtggctcacgcctataatcccagcactttgggaggccaaggtgggtgggatcatgaggtcaggagatcgagaccaccccggctaacacagtgaaaccctgtctctactaaaaatacaaaaaaaattagttagatgtggtggcaggcgcctgcagtcccagctactcgggaggctgaggcaggaggatggtgtgaacccaggaggcggaacttgcagtgagcagagatcacgccactgcactccagcctgggtgacagagtgagactccgtctcaaaacaaaacaaaacaaaacaaaacaaaacaaaaaaagtaccaaagacagaaagtggaagttacaaggtttcttaaggccttatcttggaagtcacagcaacatttattctgcattccattggtcaaactcaagtcctaacagggcttgttaggcttggcccctaagggggtcaagtaaaaggtgggactcacaggaagttctatatacattacagcttcacttgcagtacagagaggaagggaaatccttctactgggacagaacctcaagtagcatacctggttgtatattgtgcctggaagaaaagatggccagaagtatagatctatagatggatggtgattgatggatggtttgactggatggtcagggatttggaaagaacatggttagaaaattggtgacaagtggtctggggaagaggtatgtgcagacttctccagatgggcaccaagtgagaagatgcttgtgtcgtatgtgaatgctcaccaaagaacaatctcaacagagaagaatcttaataatcaggtgagcaagatgactcattccttggaatcagtcagcctttccccctagccactgctatccttgcactatgtgctcatgaacaaagtggtcatagcagtaggaatggaggttatgtctgggtgtggtggctcatagctgtaatcccagcactttgggaggctaaggcaggtggatcacttgaggtcaggggttcgagatcagcctggccaacatggtgaaaccacatctctactaaaaatacaaaaattagctgggcatggtggtgtgtgcctgtaatcccagctactcaggaggctgaggcaggagaatcgcttgaatctggcaagcggaggttgcagtgagccgaaatggtgccactgcactccagcctgggtgacagagggagactctgtctcaaaaaaaaaaaaaaaggaatggaggttattcataggctcagcaacatgaatttctacccactagatctggctactgccaccactgagagagtccaacttgccaacacagagactaacactgagcccctggtatggcataattccttgggggaactacctagcttccttgagacaaaaattgattatttggaacacttccattatggaaagggcaacacttcttttctcactggaattgacatctgatccttccatgtgcacagtgtttccacaaaaaccttctgtgtactttgaaaatgctttattctctgtcatggtattccacacagcattgctcctgattagagaacttggttcacaacaagtgtagcacaccaatgggcccatgcttgtgaaattcataaatcttaccttgttcccaatcaccctgaagtaactggcctgatagaatagtggaatggcatgttaaagactcagttgcaatttagaattcagtgataacacttttcagactaggacgacatcctctatgttgtagtagatgctctgaatgaatatcgtgctatttctcacacagccagcatccatgaatttgggaattaagtggtagaaatggaagtggctccctctcaatattatctttaatgatccactagtgaaaattttgcttcctgtccttctttgtacctttgtgctctgcagatataatggtcttagtttccacaggaagaacgtttccaccaaagtacataccaatgttaaaatggaaactgatactgccacctgaccatcttgttctcctcataccaataaaccaacatgaaaaaaaaaagacaattaccatactggctggggtaattaatcctgattcttaggagaaaatgagctattactaccagtagaaattaaggaagatgtctagaattcaggagaacttttggggtgttttttagtaataccatattctgtaagaaaagttaatggaaaattataacaaccccaaacaggcagaattgttaaaggtctagcccctttaggaatgaagttttgcgtcattcccttcctccacccctgagcaaggaaccacaaccagctgaagtgcttgctgaaaaaaagagagaatatgaaatagctagtggaagaaaaaagttaaaaataccagctatgattcccataattagctgcagaaacaggtagtatctatgagtatttcttctatatatctgcatataaatattagccatttttttcttttgttttctcctgctcccattcccctaaaacaaatgtaaagtgtgttaatcatagtgtggtaggcagcataacgctccctaacaaaagatgttcacacctaatccctgtaatctgtaatgtgtaaatatgctgttacatggagagggtgaattaggattgcatttggaactaaggttgctaatcagctgactttgacacagggaaattatcctcattggcccaaggtaattgcaagggtccgtataaaggacatagaagagtcagcaagagtggtgtgatgagggaaagacttgacaggtcattgctggttttgaaaatagacaggggttgctccaggaaaggattttaggaggaaaaaaaaaaaaaagaaagaaaatagaagggcataatgagccaaggatgcgggcaacttctagaaggaggaaaaggcaggaaattcttccctagagcctccagagagaacacaagctctgctgacgcttgattttagcccagtgaagcccatttcagacttctgacctccagaaccgtaagataatacatttttgtggtttaaagcactaactttgtggcaatttttacagtagcattaggaaattaatacaagtacttaaccttccacctggtatttaaagtataagatatcataggtagagtatggttcagcaaaaagaggaataaaaatgatccaaaaagggataaaggtacttttgggaaggttgtgaatatgctttggcctgtatgaggaatgttaggtggaagcatggttttgattctatttggaagttaaatatggttaaaagggatttgtatggatgccaaggtgacaaggggtagactcagctgggttattctattgtcaacttgaccaaacaaggacaaatataaagaaaatgacatatagacacatcataatcaaactgctaaaaaccaaagacaaagacgcaatttaaaagcagccagaaaataaataccacaatactttcagagtagaaacggtaacactatttattgactttttaatagaaactatgggagacagaatacaatggaatgccatctgagtgctgaggggggaaaaatcccaataacatgccagtccagatttctatgaaatgtgataatattctttgaaaataaaaaggaaataaatatgcttttagacaaacaaaagctgaagggatttttcacaggaggtctggcatctaagaaatcttataagaaatactacagacacatctatagttccagaactttgggaggctgacatgggaagatcacttgaggctaggagtttgagacccaccaggtcaacatattaagaacccattacgacaaaaaaaaaaaaaaaagggggggggtggacaaaattttaaaaattatctaggtgtggtgatgcacacctgaagtcctagctactcagtagcttgaggtaggaggatcacttgagctcaggaattcgaggctacagtgagctatgattgcaccactgcactccagcctgggtgacagagcaagaacttgcctctcaaaaacaaaatcaaactacagagaattcttgagttggcagaaaattaataccataaggaagcaaataaggctgcaggaacaaatgaagggctctggaaatggtttgtatctggatagataaaaatagatactgaaggctgggtgcagtggctcacgcctgtaatcccagcactttgggaggctgaggcgggcagatcatgaggtcaagagatcgaaaccatcctggccaacatggtgaaaccccgtctctactaagcatacaaaaattagctgggcatggtggcgcatgtctgtagtcccagctactcgggaggctgaggcaggagaatcgcttgaatccgggaggcagaggcagaggttgcagtgagctgagatagcaccactgcactccagcctggtgacaggtgagactcagtcttaaaaaaaaaaaaaaaaaaaaaaaaaaaaaaaggataaggaaattaaacggaaaaacaccccacattcacagattggaagccttagtattgttaagatgacagtattacccaaagcaatgtacagattcaatgtaatcactatccaaaatcccaacggcactttttgaaaaaatagaaaagcccatcctaaaatctatgtggaacacaagggaccctgaatagccaaacagtcttgaaaaagaataaaataagtgaaaaagtgtgagttggagagccatacttccggatttcaaaacttactaaagctacaataatcaaaacagtttggtactggcctaaggacagatatataggccaatggaatagcatagagagcctccaaatagactcatatatatgtcgtcaactcatttttgacaagggtttcaaaaccattcaatgaagaggacagtattttcaacaaatgtatccgtgacaattatatacccacatgaaaaataatgaaattgggtccttaatttacaccatatgcaacattaaatcaaaatggatcaaagatttaggtggcatgcagtggctcacgcctataatttcagcaatttgggaggccgagacgggcagatcacttgaggtcaggagtttgagaccagcctggccaacgtggtgaaaccctgtctccactaaaaatacaaaaattagctgggcatgtggcgcactcctgtagtcccagctactcggtaggctgaggcaaaagaatccctcaaacctgggaggcggagttggcactgagctgagattgagtcactgcactccagcttgggcaacaaagcaagatttcgtctggaaaaaaaaaaaatcaaagatccaaatataagagttaaagccataaaactcctagaagaaaatatgggggaaaagcttcatgacgttggatttggtaatgatttcttggatataacaccaaaagcacaagaaacaaaatgaacaaaaagataaactggactacataaaaatcagactgggtgcagtggctcacgcttgtaatcctagcactttgggaggccaaggcgggcagatcacttgaggtcaggagtttgagaccagtctggccaacacagtgaaaccccatttctactaaaaatacaaaaattagccaggcatggtggtggtcgcctgtagtcccagctactcaggaggctgaggcagaagaatcatttgaacgcaggaggcagaggttgcagtgaaccgagactgtgccactgcactccagcctgggtgacagagcgagactccatctaaaaaaaaaaaattaaaactttttgtgcatcaaaggacactaacaagagagtaaaagggcaatccacaaaatgggagaaaatatttgcaaagcagatcttcgaaacataaagaactgctacatctcaacaacaaatgcaaaacaactcaatgtaaaaatgggcaaaggtcttgaatatatatttctccaaagaagacttacaagtggtcaataaggacaaaaaagatgatcaatatcactagtcataagggaaatgtaaatcaaaactgcaatgagatacgacttaacatccattagaatggctattaccaaaaaacttgaaaatagcaagtattggcaaggatatagagcaactggaaaccttgtgcattgctggtgggaatgtaaaatggtacagccactgtggtaaagtttggcagttcctcacaaagtcaaacattgaattacataatccagcaattccacttctagacatataccaaaaagaaagcaatggctcaaacagatatttttacatcaatttattagcagcattattcacagtaaccaaaaagtggaaatagcccaaatgtccattaacagatgaatggataaatacaatgtagcatatagatatataatggaatattatccatccttagaaaggaatgaaattctgatacatgctataaattggatgaacattgaaaatgttatgttgagtaaaataagccagatacaaaaagataaatccacttaaatgaggtacctaaaataggaaaattcacagagacacaaagtagaatagagataactggggtctggtggttaggaggtttttgtttaatgggtacatgaggttttgtttgggatgatgaaaaagctgtggaaatggatactggtgataggtgcacaacattatgaatatacttaatgtaattgagttatacacctaaaaacggttaaactggtaaattttatgttatgaacattttactacaataaaaaagtgaacactggctgtttaaaacaagaataataatgtctcctggtacttaaaacaaaagtgtaagtgaaatatctggaaataacaggacaaaggtgaagaggctaaagtgagttaacatgttatgagcttcttacattgttctgaaaagggtaaaagtactaatttaaggtagagactaactaatcaagggcaaatattgtaactttgccctttctagcttaaccctctaaaagaatatatagctgttctaatcatctattactgtgtagtaaagtacctcaaaacttagtagtgtaaaaacaaccaccattttattatgctcataattatgggttacgaattctggtagggaatagtagggaagtcttgtctcatctccacaatgactgaggcttcagcggggatgacttgaacagtagaaatggctgggatggctcaagtggggcccaatatcaaggacctgcattctagctgtcagctaggtctcttggttcttttccttattacacttattgggcatggaatataaaaaatggccttttcacttacgtatctgcttaagtgggctgtaatatctgttaaaacaggatagtcaatcatcaatctctggaggcaacctctccatgaggctagcctgggattcacttcagcatggcagtttcagggcagttatccttcctacatggtggctgttctcactcagaatgaacatttcaggacacagacttggacactgcaatgctttttatgacctagactaagaggttccagaatgtcatgtcctattttagtggttttaatggtaaagcaagttactaaaatagcctagatgaaagggaaaatatgaccgataggaagaggaggttccaagatggccaaataggaagagccccagtctacagctcccagcatgagcaacgcagaagacaggtgatttcggcatttccaagtgaggtaccgggttcatctcactggggcttgtcagacagtgggtgcagcccaaggagcatgagccaaagcagggcaacgcactgcctcacccaggaagtgcaaggggttggggaattccctttcctagccaagggaagccgtgacagatggtacctggaaaattaggacactcccaccctaatactgtgcttttccaacagtcttagcaaacagcacaccaggagattatatcctgcacctggctcagagggtcccacacccacggaaccttgctcactactaacacagcagtctgagattgaactgcaaggcggcagcgaggctggaggagaggcgtctgccattgctgaggcttgagtaggtaaacaaagcagccgggaagctcgaattgggtggagcccaccaacagttcaaggaggcctgcctgcctctgtagactccacctctgggggcagggcatagctgaacaaaaggcagcagaaacttctgcagacttaaacgtccctgtctgacagctttgaaaagagtagttgttatcccagcatggagtttgagatgagagaatgggcagactgcctcctcaagtgggtccctgacccccaagtagcctaactgggaggcaccccccagtaggggcagactgacacctcatacggccaggtgcccctctgagacaaagcttccggaggaaggattaggcagcaacaattgccattctgcaatatttgctgttctgcagcctccgctggtgatacccaggcaaacaaggtctggagtggacttccagcaaagtccaacagacctgcagctgcgggtcctattagaaggaaaactaacaaacagaaaggacacccacaccaaaatcccatctgtatgtcaccatcatcaaagaccaaaggtagagaaaaccacaaagacggggagaaaccagagcagaaaagctgaaaattctaaatatcagaatgcctcttctcctccaaaggaatgcagctccttgccagcaacagaacaaagctggatggaaaatgactttgatgagttgagagaagaaggcttcagatgatcagtaataacaaacttctccgagctaaaggaggatgttcaaacctatcacaaagaagctaaaaaccttgaaaaaagatgagatgaatggttaactagaagaaacagtgtagagaagaccttaaatcacttgatggagctgaaaaccatggcaagagaactaggtgatgcatgcacaagcttcagtacccgattcaatcaagtggaagaaagggtatcagtgattgaagatcaaaagaatgaaaggaagccagaagagaagtttagagaaaaaagaggaaaaagaacgaacaaagcctctaagaaatgtgggactatgtgaaaagatgaaacttacgtctgattggtgtacctgaaagtgatgtggagaatggaatcaagttggaaaacactcttaagaatactatccaggagaacttccccaacctagcaaaacaggccaaaattcaaattcaggaaatacagagaatgccacaaagatactcctcgagaagagcaatcccaagacacataattgtcagattcaccaaagttgaaatgaaggaaaaaatattaagggcagccagagagaaaggtcgggttacccacaaagggaaacccatcagaataacagcggatctctcagcagaaactctacaagccagaagacagtgggggccaatattcaacattcttaaagaaaagaattttcaacccagaatttcatatccagccaaactaagcttcatcagtgaaggaaaaataaaatactttacagacaagcaaatgctgagagattttgtcatcaccaggcctcccttacaacagctcctgaaggaagcactaaacatggaaaggaacaaccagtaccagccactgcaaaaacattgtaaagaccatcgatgctaggaagaaacaacatcaactaacgagaaaaataaccagctaacatcataatgacaggatcaaattcacatataataatattaactttaaatgtaaatgggctaaatgctccaactaaaagacacagactggcaaattggataaagattcaagacccatcactgtgctgtattcaggagacccatctcatgtgcagagacacacataggctcaaaataaagggatggaggaagatctaacaagcaaatggaaaacaaacaaacaaaaaaagcaggggctacaatcctagcctctgataaaacagacttacaccaacaaagatcaaaagagacaaagaaggccattacgtaattataaagggatcaattcaacaagaagagctaactatcctaaatatatatgcacccaatacaggagcacccagattcataaagcaagtcctgagtgacctacaaagagacttagactcccacacaataataataggagactttaacaccccactgtcaacatgagacagatcaacgaaacagaaggttaacaaggatatccaggaattgaactcagctctgcaccaagcagacctcatagacatctacagaactctccaccccaaatcaagagaatatacatttttacagcatcacacgacacctatcccaaaattgaccccatagttggaagcactcctcagcaaatgtaaaagaacagaaattataacaaactgtctctcagaccacagtgacatcaaactagaactcaggattaagaaactcactcaaaaccgctcaactacatggaaactgaacaacctgctcctgaatgactactgggtacataacaaaatgaaggcagaaataaagatgttctttgaaaccaaccagaacaaagacacaacataccagaatctctgggacacatttaaagtagtgtgtagacagaaatttatagcactaaattaccaccagagaaagcaggaaagatctacaattgacaccctaacatcacaattaaaagaactagagaagcaagagcaaaaacattcaaaagctagcagaaggcaagaaataactaagttcagagcggaactgaaagaaatagagacacaaaaaacccttcaaaaaatcaatgaatccaggagctgggtttttaaaaagatcaacaaaattgatagaccactagcaagactaataaagaagaaaagagagaagaatcaaatagacgcaataaaaaatgataaaggggatatcaccaccgatcccacagaaatacaaactaccatcagagaatactataaacacctctacgcaaataaactagaaaatctagaagaaatggataaattcctggatacatacaccctcccaagactaaaccatgaagatgaatccctgaatagaccaataacaggccctgaaattgaggcaataattaatagcctaccaaccaaaaaaaagtccaggaccagacggattcacagccgaattctaccagaggtacaaagaggagctgctaccattccttctgaaactatcccaatcaatagaaaaagaaggaatcctccctaactcattttatgaggccaacatcatcctgacaccaaagcctggcagagacacaacaaaaaaagagaattttagaccaatatccctgatgaacatcgatgcaaaaaccctccataaaatactggcaaaccgcatccagcagcacatcaaaaagcttatccacagggtggagccaagatggccgaataggaacagctccagtctacagctcccagcatgagcgacgcagaagacaggtgatttctgaatttccatctgaggtaccaggttcatctcactacggagtgccaggcagtgggtgtaggacactgggtacagcgcaccgtgcacgagctgaagcagggcaaggcattgcctcactccggcagcgcaaggggtcagggagttccctttcctagtcaaagaaaggggtgacagatggcacctggaaaatccagtcacttcccatcctaatactgcacttttgcaacgggcttaaaaaacggcacaccaggagattatatcccacacatggctcggagggtcctacgcccacggagtcttgctgattgctagcacagcagtctgagatcaaactgcaaggcagcagcaaggctggaggaggggtgcctgccattgcccaggcttgatttggtaaacaaagcagccgggaagctccaactggatggagcccaccacagctcaaggaggcctgcctgcctctgtaggctccacctctgggggaagggcacagacaaacaaaaagacagcagtaacctctgcagacttacatgtccctgtctgacagctttgaagagagtagtggttctcccagcatgcagctggagatctgagaatgggcagactgcctcctcaagtgggtccctgacccccgagcagcctaactgggaggcaccccccagtaagggcagactgacaactcacgcagcagggtactcctctgagacaaaacttccagaggaacgatcaggcagcagcatttgcaggtcaccaatatccactgttctatagccaccgctgttctgcagccaccactgctgatacccaggcaaacagggtctggagtggacctctagcaaactccaacggacctgtagctgagggtcctgtctgtcagaaggaaaactaacaaatagaaaggacatccacaccaaaaacccatctgtatgtcaccataatcaaacaccaaaagtagataaaaccacaaagatggggaaaaaacagagcagaaaaactggaaactctaaaaagcagagcacctctcctcctccaaaggaacgcagctcctcaccagcaatggaacaaagctggatggagaatgactttgacgagctgagagaagaaggcttcagacgatcaaacgactccgagctacaggaggaaattcaaaccaatggcaaagaagttaaaaactttgaaaaaaaaattagacgaatggataactagaataatcaatgcagagaagtgcttaaaggagctgatggagctgaaagccgaggctcgagaactacgtgaagaatgcagaagcctcaggagccgacgcgatcaactggaagaaagggtatcagtgatggaagatgaaatgaatgaaatgaatgaaatgaagtgagaagggaagtttagagaaaaaagaataaaaagaaacgaacaaagcctccaagaaatatgggactacgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactccttgagaagagcaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagacagtgggggccaatattcaacattcttaaagaaaagaattttcaacccagaatttcatatccagccaaactaagcttcatcagtgaaggagaaataaaatactttacagacaagcaaattctgagacattttgtcaccaccaggcctgccctaaaagagctcctgaaggaagcactaaacatggaaaggaacaaccggtaccagccactgcaaaatcatgccaaaatgtaaagaccatcaaggctaggaagaaactgcatcaactaacgagcaaaataaccagctaacatcataatgacaggaccaaatttacacataacaatattaactttaaatgtaaatgggctaaatgctccaattaaaagacacagactggcaaattggataaagagtcaagacccatcagtgtgctgtattcaggaaacccatctcatgtgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacgtaatgataaagggatcaattcaacaagaagagctaactatcctaaatatatatgcacccaatacaggagcaccaagattcataaagcaagtcctgagtgacctacaaagggacttagactcccacacaataataatgggagactttaacaccccactgtcaacattagacagatcaacgagacagaaagttaacaaggatacccagaaattgaactcagctctgcaccaagcggacctaatagacatctacagaactctccaccccaaatcaacagaatatacatttttttttagcaccacaccacacctattccaaaattgaccacatagttggaagtaaagctctcctcagcaaatgtaaaagaacagaaattataaaaaactgtctctcagaccacagtgacatcaaactagaactcaggattaagaatctcactcaaaaccgctcaactacatggaaactgaacaacctgctcctgaatgactactgggtacataacaaaatgaaggcagaaataaagacgttctttgaaaccaacgagaacaaaggcacaacataccagaatctctgggacacattcaaagcagtgtgtagagggaaatttatagcactaaatgcccacaagagaaagcaggaaagatccaaaattgacaccctaacatcacaattaaaacaactagaaaagcaagagcaaacacattcaaaagctagcagaaggcaagaaataactaaaatcagagcagaactgaaggaaatagagacacaaaaaacgcttcaaaaaattaatgaattcaggagctggttttttgaaaagatcaacaaaattgatagactgctagcaagactaataaagaaaaaagagagaagaatcaaatagatgcaataaaaaatgataaaggggatatcaccaccaatcccacagaaatacaaactaccatcagagaatactacacagacctctatgcaaataaactagaaaatctagaagaaatggataaattccttgacacatacaccctcccaagactaaaccaggaagaagttgaatctctgaatagaccaataacaggatctgaaattgtggcaataatcaatagcttaccaaccaaaaaaagtccaggaccagatggattcacagctgaattctaccagaggtacaaggaggaactggtaccattccttctgaaactattccaatcaatagaaaaagagggaatcctccctaactctttttatgaggccagcattatcctgatacgaaagccaggcagagacacaaccgaaaaagagaattttaggccaatatccttgatgaacattgatgcaaaaatcctcaataaaatactggccaaccaaatccagcagcacatcaaaaagcttatccaccatgagcaagtgggcttcatccctgggatgcaaggctgcttcaacatatgcaaatgaataaatgtaatccagcatataaacagaaccaaagacaaaaaacacatgattatctcaatagattcagaaaaggcctttgacaaaattcaacaacccttcatgctaaaaactctcaataatttaggtattgatgggacgtatctcaaaataataagagatatctatgacaatcccacagccaatatcatactgaatgggcaaaaactggaagcattccctttgaaaacgggcacaagacaggatgccctctctcaccactcctattcagcatagtgttggaagttctggccagggcaattaggcaggagaaggaaataaagggtattcaattaggaaaagaggaagtcaaattgtccctgtttgcagacgacatgattgtatatctagaaaaccccatcatttcagcccaaaatctccttaagctgataagcaacttcagtaaagtctcaggatacaaaatcaatgtacaaaaatcagaagcattcttatacaccaataacagacaaacagagagccaaatcatgagtgaactcccattcacaattgcttcaaagagaataaaatacctgggaatccaacttacaagggatgtgaaggacctcttcaaggagaactacaaaccactactcagtgatataaaagaggatacaaacaaatggaagaacattccatgctcatgggtaggaagaatcaatatcgtgaaaatggccctactgcccaaggtaatttatagattcaatgccatccccatcaagctaccaatgactttcttcacagaattggaaaagactactttaaggttcatatggaaccaaaaaaagagcccacatagccaagtgaatcctaagccaaaagaacaaagctggaggcatcacactacctgacttcaaactatactacaaggctacagtaaccaaaacagcatggtactggtaccaaaacagagatatagatcaatggagcagaacagagtcctcagaaataatgccgcatatctacaaccatctgctctttgacaaacctgagaaaaacaagcaatggggaaaggattccctatttaataaatggtgctgggaaaactggctagccataggtagaaagctgaaactggatcccttccttacacctgatacaaaaattaactcaagatggattaaagacttacatgttagacctaaaactataaaaaccctggaagaaaacctaggcaataccattcaggacataggcataggcaaggacttcatgtctgaaacaccaaaagcaatggcaacaaaagccaaaattgacaaatgggatctaattaaacttaagagcttctgcacagcaaaagaaactaccatcagagtgaacaggcgacctacaaaatgggagaatatttttgcaacctactcatctgacaaagggctaatatcaagaatctacaatgaactcaaacaaatttacaagagaaaaaaaaacccatcaaaaagtgggccaaggatatgaacagacactcctcaaaagaagacatttatgcagccaaaaaacacatgaaaaaatgctcatcatcactggctgtcagagaaatgcaaatcaaaaccacaatgagataccatctcataccagttagaatggcgatcattaaaaagtcaggaaacaacaggtgctggagaggatgtggagaaacaggaacacttttacactgttggtgggactgtaaactagttcaaccattgtggaagtcagcacggcaattcctcagggatctagaactagaaataccatttgacccagccatcccattactgggtatacacccaaaggattataaatataaagacacatgcacacgtatgtttattgcggcactattcacaatagcaaagacttggaactaacccaaatgcctaacaacgatagactggattaagaaaatgtggcacatatacaccatggaatactatgcagccataaaaaatgatgagttcatgacctttgtaggaacatggataaaactggaaaccgtcattcttagcaagctatggcaagaacaaaaaaccaaacaccacatgttgtcactcataggtgggaattgaacaatgagaacacataggcacaggaaggggaacatcacactccagggactgttgtggggtggggggaggggggagggatagcattaggagatatacctaatgctaaatgatgagttaatgggtgcagtacaccaacacggcacatgtatacatatgtaagaaacctgcacattgtgcacatgtaccctaaaacttaaagtataataataataaaattttaaaaaaaagccttatccaccatgatcaagtcggcttcatccctgggatgcaaggctggttcaacgtacacaaatcaataaatgtaatccagcatataaacagaaccaattacaaaaaccacatgattatctcaatagatgcagaaacggccttcaataaaattcaacagctcttcatgctaaaaactctcaataaactaggtactgatgggacgtgtttcaaaataataacagctatttatgacaaacccacagccaatatcatactgaatgggcaaaaactggaagcattccctttgaaaactggcacaagacagggatgccctctctcaccactcctattcaacatagtgttggaagttcgggcagggcaatcaggcaggagaaagaaataaagggtattcaattaggaagagaggaagtcaaattgtctctgtttgcagacgacatgattgtatatttagaaaaccccatcatctcagcccaaaatctccttaagctgataagcaacttcagcaaagtctcaagatacaaaatcaatgtgcaaaaatcacaagcattcctatacaccaataacagacaaacagagagccaaatcatgagtgaactcccattcacaattgctacagagaataaaatatctaggaatccaacttacaagggatgtgaaggacctcttcaaggagaactacaaaccactgctcaacaaaataaaagaggacacaaacaaatggaagaacattccatgctcatgggtaggaagaatcaatattgtgaaaatggccacactgcccaaggtaatttatagattcaatgccatccccatcaagctaccaatgactttcttcacagaattggaaaagactactttaaagttcacatggaaccaaaaaagagcctgcattgccaagacaatcctaagccaaaagaacaaagctggaggcatcacgctacctgacttcaaagtctactacaaggctacagtaaccaaaacagcatggtactggtaccaaaacagagatatagatcaatggaacagaacaaagttctcagaaataataccacacatctacaaccatctgatctttgacaaacctgagaaaaacaagcaatggggaaaggattccctatttaataaatggtgctgggaaaactggttagccataggtagaaagctgaaactggatcccttccttacaccttataaaaaattaattcaagatggattaaagacttaaacgttagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggcaacctacagaatgggagaaaatttttccaatctacccatatgacaaagggctaatatcaagaatctacaaagaacttaaacaaatttacaagaaaaaaatcaaaccaccccatcaaaaagtgggcaaaggatatgtcttctcaaaagaagacatttatgcagccaacagacacatgaaaaaatgctcatcatcactggccatcagagaaatgcaaatcaaaaccacaatgagataccatctcacaccagtaagaatgggaatcactaaaaagtcaggaaacaacaggtgctggagaggatgtggagaaataggaacacttttacactgttggtgggactgtaaactagttcaaccattgtagaagacagtgtggcaattcctcaaggatctagaaccagaaataccatttgagccagccatcccattactgggtgtatatccaaaggattataaatcatgctgctataaagacacatgcacacgtatgtttactgcagcactattcacaataacaaagacttggaaccaacccaaatgtccatcaatgatagactggattaagaaaatgtggcacatacacaccatggaatactatgcagccatataaaaggatgagttcatgtccttcgtagggacatggatgaagctggaaaccatcattctgagcaaactatcacaaggacagaaaaccaaacaccgcatgtgctccctcataggtgggaattaaacaatgagaacacttggacacagggtggggaacatcacacaccagggcctgtcgtggggtggggggaggggggagggatagcattaggagatatacctaatgtaaacgatgagttaatgcgtgcagcacaccaacatggcacatgtatacatttgtaacaacctgcacgttgtgcatgtaccctagaacttaaagtataattaaaaaaaaaagaaaaaagaaaaaaaaaagaaagggaaaatattgccacctcctgtcaacaggagaaatagaaaacaacttatggcatctttaatcaatcaaaataactaaaaagttaatagagaagaaaataatgacaaactaacaatatttaattaccaccaagaaagggaaaagggaggggaaaatacaggaagaacagatcagataagtagaaaacaaacagcaagatggtagccttaagcccaatgaatacagtaattacaataaatataaatggtctaaacatgctaattaaaagacaaagattatttagaattatgcaaaattaaatccaactgtattttgtttacaagagacacaatttaaatataagggcacaaaaagatgaaaagtaaaagaataggaaaagatgtcatgtaggtactcaccaaaagaacactagggtagctataacaatataaaataaaatgttctttcagacaagaagtactgtaaaatatacgaaatatctattgaagtgatcacatgctttttgtcctttattctgttaatgtggtcatcgcatttattgatttgtatatgttgaaccaccttgcacacaaaggataaatctcacttgatcattattttaatgtgctgttaaattcagtttgctagtatttggttgaagatcctattcatctatgttcatcaggggcattagcctgtaattttatgatagcatcctcatctggctttggtatccaactcatgttggctttgtaaatgaggttagaagtatgctctcctctttaattttttgaaagagtttgaaaagggcagattattatttcttctttaaatatttagtagaattcaacagcaaggtcatcagtgaattcaacagtgaagccatcctgggcttttctttgacgggaggttttttattactgatccaattttcttactcattattggtctattcatattttctatttcttcatgattcagtcttgggaggttacatgtatctaagaatttgcccatttcttctaagttatcctatttattggcttataattgttcatagtagtttcttattatcttttgtatttctgtagtatcagttgtaatgtctcatctttcatttctgattttatttatttgagtcttctttttttttttttttgagacactttcactcttgttgcccaggctggggtgcaatggcatgatctcagctcactgcaacctctgccccctgggttcaagtgattctcctgcctcagccttccgagtagttgggattacaggcatgtgccaccatacctggctaattttgtatttttagtagagacgaggtttctccatgttggtcagtctggtcttgaactcccgacctcaggtgatccgcccaccttggcctcccaaagtgctgggattacaggcgtgagccactgcaccaggcctacttttacatttttgtttatttatttatttatttatttacttttagagatgtagtctcactatgctgccaaggctggactcaaactcttgggctaaagtgatctttctgcctcagtctcccaggtagctgagactacagacgtgtgccaccacacctgattttcttgtttttattagttagtctagttaaagatttgccaattttgtttatcttttcaaaaacccaactcctggttttgttgatcttttctattgtttttctagtttttatttcaatcatttctgctctaatctttatttccttccttctgataactttggtcttagtttgttcttctgtttctagttccttgaagtgtaacattaggttgtttgagatctttcttgttttgtgatgtaggcatttattgctatgaaattcccctttagaattgcctttgctgcatcccatacgttttggtatgttgtgtctccattttgtttgtctcaatatattccttaatttacctttaaaggtcacatatgacaagcccacagctaacatcatactcaatggtgaaaagttaaaagtttcttctctaagatcaggaacatggatgcccctgcttactacttgtattcaacatggcactggaagtctcagccagagaaattaggcaacagaaagaaataagacatacaaattgaaaaggaagatgttaaattgtctctgtttccagatgacatgatcttatatacagaagaccttaaagactcttatcaaaaaactgttaaaaataataagcaaatttagtaaagttacaaactcaacatacaaaaatcaatggtgtttctataaaccaaagatagaaagttcacaaaggaaaagtaaaactgtcatcattcaaagataacatgactaagaaaatccaaaggaatttataaaaaagcaattagaggccaggcacagtggctcatgcctgtaatcccagcactttgggaggtcgaggcgggcggatcacgaggtcaggagttcgagaccagactgaccaacatagtgaaatcccatctctactaaaaatacaaaaattagtcaggtgtggcggcacatgcctgtaatcccagctactcgggaggctgaggcaggagaatcgcttgaacccaggaagcggtggttgcagtgagctgagatcacatcactgcactccagcctgggtgacagagcaagactccacctcaaaaaaaaaaaaaaaaaaaaaaaaacatggagagaaatttaagatccaaagacatgggccagctgtggtggttcatgcctgtaatcccagaactttgggaggccaaggtgggtagatcacttgagctcaggagttaagagaccagcacgggcaacacggcaagacaccccatctacaaaaagtacagaaagtatccaggcatggtgacccatgcctgtagtcccagctatttgggaggctgaggcaggagaattgcttgaacctgggaggtggagatttcagtgagctgagattgtgccactgcactccagcctaggcaacagggtgagactctgtcttaaataaacaaataaatatacacaaatagaccaatgcaacagaatagacactatagaaacactttacatatatgattacatgatttaaacaatggcaccacagcaattcattgtgaaaaggatggtattttcaaaggtatttgatcagttggatatccataagaaaaaaatgaactttgtacctctaagtatacacaacaattaatttgagatggatactatatatcaatctgaaactaaagcaattaagcctctagaacaaacataaggaaaatatcttctgactaggttagacaaaatttcttaaacaggacccagaaagcactaaccatgaagaaaaagtggtggctgggcatggtggctcacctctgtaatctcagcactttcggaggccaaggtgggaggactgcttgaggccaggagttcaacaccagccttggcaacatacctagaccctgtctctacaaaaaattaaaaaattagccaggcatggtagtgcacacctgtagtccaaacaggaggctgaggcaggaggattgcttgagcccaggagttcaaggttacagtgaactgtgatcatgcaactgcactctagcatgggcaaaagagtgaaaccctatcaaagaaagaaaaaaaaaagaaagaaagaaaggaaagaaggaaagaaagagaaaaagtcacaaattggactttattaaaattaaagacttcttttcattaagaacatcttagaggaacgaggcaagcctgggagaagatattcaacacatatagtatttaacaaaggacttgcattcaggatgtatgaactcctccagagaatacttataacgtaatagtacaggtaatagatcttggcggtttgaagatggagaggagaggtaaagaaaagggtagggatactttgttctcatcatatataatgggaagtcaagtgattctatgtcagcctgatggaacaagaaactaagacttaaatattctttaaaccaataaggtaataaaatagaggaattaaaaaaaaacatgatgatactgggaggggagataagcagggctgtggagggtaagtaacctaccctctcaattatctttgcagaaagccaacagattacttctaaagttaataaaagataattgtacacgcacattatttagaagcatggaagtaactactagaagatctacaataaaaatagttaaaaatgggccaggcgcggtggctcacacctgtaatcccagcacttagggagggagaggtgggtggatcactaggtcaggagttcaagatcagcctggccaagatggtgaaacctcatctctactaaaaatacaaaaaactcagctgggtgtggtagtgggcgcctgtaatcccaggtactcgggaggctgaggcagagaactgattgaacctgggaggcgaaggttgcagtgagccgagattgcaccactgcattccagcctgggcaacagagcaagactccatctcaaaaaaagaaagttaaaaacggttgcttttagtgtatgagggtgaaagaaagtaggatggggtaaaatatttatttttcataataaattattctatattacttattaaagaagtactcatgttactttgattaaaatatttaattttttaaaatccctacatttacattactataactatgcaaataattcacttctacagccaagcaatgtgctaaaactatgcatcctttttttagaagtcacccacttgactgtatctagaatcaagatgctgtgtctagaatcaagagcaaatgtattctcttcacatcttagaacaattttaatctgtcatatctgaaccatgactttcacagttagctctttttcagagtttctaacctcttttttctaaatccagcctctgtcatactttctattgcatggggtaccattttcctcccatatataaccctcttagaggcactcaatatcctgatctaatttaaatttattactatttttgttttcttcaggttctatcttttttttctttctttttctttttgttttgacattattggttttccctaaaagtgaaccttgggtgtggtggcacgtgccggtatcccacctactcgggaggctgaggcacgagaatcacttgaactgggaggcgccaaaattacaccactgcattgcagcctgggagacagagcaagactctgtctcaaaaaaaaaaaaaaaaaaaaaaagaggtggttggagaagatcaccagacaggaagtctagcttctggtctttgttcagagtcagcatggtcttcaaagagggttagatgctcaggccagcctctcaggatcagcacaaatcatgcagtggtgaacagacttgggtgtcgtttcccccaggtgtgggtgaaattcctagactagaccagatatcattgggtaaaaggtgtgcctgtttaacatttggataaatatcactattgtccaacatacagaagtttctgtccacaccacctcctctcagaacaagaatgcctatttccccatgccctaaccaactcatatttttaagtattttattaattttttgactaggtaatgtttgcagatggcacaaaatttaaaaaagtagggaagggcatgcagtgagaggtctccacattcccgtcacagccatcccagtcctgtccccagaaccacaaactttgatctcagcctttctggtaaatggaaagtggtatctcactcaataaatctcacaattatgtgggaaaaaaaaagtgaaccttggttgtccattaatacttaagaatgaaagtctgtgtcagtttttctaggcgctagtacgagtatcttttgttagtattctgtctacccagtgttctcactcaggagtgggaaaattgcctgggggcttcatgacatgagtggagtaagtaattaccaggctttctctaatgggtatcgtcaagtagccagctattaagcagggtgtctctcaaataccaaaattaagaggcaacacaacaaaattaagagggtttcactgtggaatgccaaattcatgctagaactagctttctcagatagttcatttgatttttcatttttcatttttttttaaaaaagagataagactccagggtttctttgtgtcttttttgcctaatagtatgtatctgtctacaagcagatttgtgactagcagtaaacatccacctacctgcagctcttggtctgcaaaagactggagacaactggcacagctgccccatatacagaccttcaattaacccctgtcttcagtccttctccttccagctcttttaaattgttaactccaaattcatatcctctctggggttccaatggcaaaccaattccctcattggaacccctatgaaatgtgtctaggcaagtgtttctacagtttttccaaaggatgctatcatctatttttagttttccaaaaattagataaaatttttatctgctcatgaacccccttctctttgttatggattaaccttctacacagtgtcgtttcaatggggttctggagagatagaaggtgaaaatgtgtcctccgtctacacacacacacacacacacacacacacacacacacacacacacctctttatttacatggcttctctgctgaagctccttcaagggcaaggatgtattctgaaatgcctagcacaatgtcaggaacacaacagctagtcaaaggtgtgtggctggttggatgtgagagaaaatagctgcaaacgatagaaaagcttacgcctagatgatgtgtatgtcaatcaaaaccaactaaggaagaataagttttaaaagaagattagctgggtataacagtgctcggctatagggcaagttacttgggaagctgaggttggaggatcacttgagcccaggagtttgagaccatcctgggcaacatagtgagatccctgtatcttaaaaaaacacatattattttagtgttagaaatcaacatagttataccccagcataggttttatggccttggtagaggcaaataatgaagcaactttacaaaatgggattaactgatacaaaggtggtcttgtaagccataaaacctttgtatcagtgtgtgctagaaacagagccatattacttcacttaaaattaccaggcacagagtcctgctgctatcagagagaaaagagtgaggtcattttacctcttggctctcacccaaccagataattcaacttggaatattccttacacctataagaccagctctacccttataaaagcacaagtgaccacgacattaacccggatatagtgtattattaataaacttgaagctcctcgagaataagtactcaataaatatttaatgagtggctatattcctaacatctgctcacaatgctggttcctcagtcaagaaataaagtgttgagaggtgaaaggcaaataatcttattaatgatactttcattgatagccattataaaagtgcctggcccagatcaggaactcaataaatatttgtgcagctagtgaaataattgtaactttttgaaatgttaaaaaagtctgctttgttgttgttgttgttgttgttgttgctgctgctgctgcccaggctgaagtgcaatggcgtgatctcggctcatcacaacctccgcctcccaagttcaagtgattcttctgcctcagcctcccgtgtagctgggattacaggcatgcgccaccacacccagctaattttgtatttttagtagagacagggtctctccatgttcgtcaggctggtctcaaactcccgacctcagatgatccgcctgcctcagcctctcaaagtgctgggattacagtcgtgagccaccacgcccggccaaaaagtctgctttttaaagtgaagaatggcacacaattctgcaagtatactaaaagctactgaattgtacactttatataaaaagtattgaactggctgggtgcagtggctcacgcctgtaatcccagcactttgggaggccaaggagggtggatcacctgaagtcaggagttcgggaccagcctggccaacatggtgaaaccccgtctctactaaaaattcaaaaattagccaagcatggtggtgcacctgtaatcccagctactggggaggctgaggtgggagaattgctcaaacctgggaggcagaggctgcagtgacccaatatcatgccactgcactccagcctaggcaacagagagagattctgtcttaaaaaaaaaaattgaactgtacactttaaattttatgacataaaaattatatttcaataaaacttctaaataaactcacaaggaaacttttccaggcctgctgaatgactctggcagccttatcctgctttgtaaattctgattcctctttccaaggcatttgaaattcctaaaagaaaatgagcaaaaagggtacatttaaaataattttaatttactttcatttttatttatttattttttttagagacacattcttgctctgtcacccaagctggagtgcagtggtgcgatgatagctcactgtagcctcaaactgctgggctcaagtgatcctcttgccttaacctcctaagtagctgggattgtaggcgtgcaccatcacacctggctttctttttttaattattatttttttgtagagatggggtcttgctatgttgcccaggctggtgtcaaacaccttctggcttggcctcccaaagtgctgggattgtaagcgtgagccaccgcgcccagcctaaaattattttatatgctctattataaaactaccactagaactcaatgaaaattaaatagagttgtataaataaaacaattaaaataagattttgtatcaaaataataaaaataaaaatagtcaccttcttattttttaagagacagagtctttctctgttgccttggctagaatgccatggcaggatcataggtcactgcagccttgaactcttaggctcgattgctcctcctgcctcaccctcctgagtagctgggactacaggcacatgctacgatgcctagctaatttttaaaattttttgtagagacaggttcttgctatgtttcccaggctggtcttgaattcttgtactcaagcgatcctcccacctctgcctctgaaagtgcttggattacaggcatgagccactgcaccaaaagtagtcagcaattattggtgatttaatatgttctaatttgtatatttttttctagttccagcaacaaccctgcataacagattttgctaatatgcttgtgttagagatgaggagcctaggctttaaggcctaaggtcaaatagtgagtaactaaaccagttattgaattcaagtttatcttgaaagtccatgacttttacataccctgttgtatgacttcaaataaacctttcttaacgtgcatagagacagagttgcatccacaaaattgcgcaggtccctaacctaaaattagaccttatgtggtcaaatataaaaggaaaaaaaggtcatgcactgaatacagggagaaacatggatttttacttagtcttaagagttattaatacttcacagaataatgtcactcattacatttacagtagcaatatggttctgacatgctttatcataatccaaagtgaacaaattttgcttaaaagcttaaaattctgggctgaatatagtgactcatgcctgtaatcccatggttttgggaggccaaggcaggaggatttcttgaggccaggagttcaacaccagcctgggcaatatagcgagacccccatctctacaacaacagcaacaacaacaaaaagctgggcaggttggcacatactgtagtcctagctacttgggaggctgaaacaggaggatggcttgagcccaggagttcaaaactgcagtgagctatgattgcaccactgcactccagcctgggccacaaaatgagaccatgtctctaaaaataataaaaatgtaaactctgaattggtgcatgtaaaatgcaaaacgtgtaaggatttacaaatcccaaagccctgacctatttaaacatataacatacatctactaatgtttagaaagacagaggctaaacagaaaactttcaaaaaggatacgccattcataagaaaaatgtatttatatatttctcaacttgccatttttcccttttgacgtttaaagttattcagatgcttaaaactaaaggtgttttcttcctaatttggtaaattgttgttttttaaattcacatttttaagagttgggagaaggttcgctatgaaaaaaacttatgtcttttttgctttccctacaaatagccttattaatataggaggcatgggaagacaggttaagtctttggactctgaggcaagatagaccagggtttaaatctcaacaaattctacctcattcttagctgcatgattttgccgaagttacttaactcactcaaacttcaagttactcatctgtaaaatatggggactcattgtacctaactcatagaattgttaggattaagtcagataacacaggtaaagcatttagtatagtttctgacccaccatagccactcaataaatcatattattataatacaaactattttccaaaataaaaactattcatgtgcattattccagttaggaaactgagataacattttaagtacaattattctcttaatttacaaataactgttagcacaaatgagattaaggaatgatatttcaggcctaaaagatttgttaattttttttttttttttttttgagacagaattttgctctgtcacccaggctggagtgcagagacatcatctcagctcactgcaacctccacctcccgggttcaagtgattctcatgtctcagcctcctgagtagctgggattacaggtgtgtgccaccacgcctggctaatttttgtatttttagtagagacagagtttcaccctgttggccagggtgggctcgaactgctggcctcaagaaatccacccgccttggcctcccaaagtgctagcattacaggcataagccattgcgctcagcggcaacaatttttgtaggatagtttttacaagtggaattgctatgacaaaaggtatgcacatatatatttctgttttttgtttgttttctgagacggagtctcgctctgtcgccaggctggaatgcagtggagcgattttggtgcactgcaacctccgcctcctgggttcaagcgattctcctgccttagcctccccgcgatttccactcactgcaacctccgcctcccgggttcaagtgattctcctgcctcagcctcccaagtagctggcactacaggtgtgcaccaccgtgcccagttaatttttgtattttaagtagagatggggtttcaccatgttggtcagaatggtctccatctcttgacctcgtgatccacccacctcggcctcccaaagcgctgggattacaggcatgagccactgcgcctggtgcacatatatatttgaattgactctctctggaaagggatatgagaaattactaagaatgattgtctctaggaagggacctgtggactgaggagcctgggttcggaaagggaagagatgtttttgttccagtatactcttttatgctgttggtatttttccacaatgtgcatttagttcagatatatacaatataacttcattaaaaaaaacagcgtgcatattgaaacctaacactgccaaactgtcctcaaaaatggtgtctaatttatgcccataaacattctatgggaatgcttgactctaaattttagaaaagtaaaaaactaaacgtaaattagatattaggattaaaatgggtcttttaatactttccaagaactaaactgtgagattttttacctgttatcaatgtagtgtgtgtgttatttaacgtgacagcattagcattaattcatcacaatttcatcattttcccaaatacattcccaattttgtaggtggaaatttaacactggatcttaaaaatcccttgaaaatcctgaaccagtttattgaatactttgatctaaataattttacacgggctttctgcatacacctgcttcctgcttctctagtgacataggctaaagggtgtttagaagctgccaaaaaagtatgtcataaatgccaccattatatgtttatgaatacacaaaatatagaggaaatatattccagcattcaaaattatctgattcagaaataaacaatgaagttccacaatttcaagaaagaacatattcaattgtgtcaaatattgttgcaagggcaagtaaatacagaggaaaaaaagggagatttggccagataaagtcactagtgactgtacaggcactgcttcagtggagtaagcagggaaggaagtttgggttgggttgaggaagtgggaaagttgagacagtaagtacagtagtaattctttggagtgctgtaagggagcagaaaaatggggtgtagctagagagtgagaatggattaaaggtttttttttaaaaaaaaaaggctgggcgcggtggctcacgcctgtaatcccagcactttgggaggccaaggtgggcggatcatctgaggttgggagtttgagaccagcctgaccaaaatggagaaatcccgtctctactaaaaatacaaaattagctgggtgtggtggcgcatgcctgtaatcccagctactcaggaaggctgaggcaggagaattgcttgaacctggcaggcggaggttgcggtgagtcgagatcatgccactactccagcctgggcaacaagagtgaaactcggtctaaaaaaaaaaaaaaacaacaacaacaacaaaaaacgacagattctaaagcatgttaaaatgtaccatccagtagtgagggagaaattaaagtgacggagaacttaaaggggcaaaaaaagggataagttaaatggtaaaacctttgagtaggtgtaagaggacaccatctggagcagaaaggagggtgggaccgttgctggctttagataagaaataagatcgactttatatggttattatgatgctccagataaaataaccattgtgaaaacccttcataagttttaagatactaaaatgtactaccaggccgggtctggtggctcaggcctgtaatcctaacattttgggaggccaaggtgggcagatcaccttaagtcaggggtttgagaccagcctggccaatatggtgaaaccctgtctctagtaaaaatacaaaaataaactgggtgtggtggcgcacacttgcagtcacagctactcggaaggctgaggcaggagaataacttgaacccaggaggcagaggttgcagtgaactgagatcacgccactgcactcagcctgggcaacacagcgagatgccttctcaaaaacaaacaacaacaaaaaactaaccaaataaaatgtactatcaaacaactgctcaggcaatgaagtattttactacacccatgtgccacttgtagattcacagataagtattttccaagcttattatatccctaatcaataaaattttttatcataatagatgatgttttcacttatttatttttacgcttcgtggaaaaaagcccacaagacgtgtttggattcttggtttcacttttaaagcagcaaacaatctttactttgcttgaattggaacctgtatacgtcctattttgtttcctctactaaatttattgaataaacaaatgattcgcgtggcctttataagtttcgtaatttcgcttttcctttttacctgtggtccttgatgctaggggcaggagaagaaaaactaacctattctttaaaaacgcgtttcccttttccatctctaaaaaaactgaaaagacgtaaaacaaatgggagggggcaaaggaaagaaatgaggaaaaatctaaggaagattaatgtgtacttcccggtcagcgggaaggtggacggagtaatatctttgcggaggattggggtgtggggatctgtgaaggcgcagtatgagcagtaaggacttgtcaaccagcccgacgcaacttcaccgagggcgaggaaaggagctctgaggaaggggttactcccgggcaggactgtaaaccagctggaggcctcgctgggagggctttagaggaatgaaacgtccttaagaggggcggatggggaatggtatcaagggtatgggttctttagggccttgaaacaacgaaggctcaaaccagtgggcacaaaggctaccggaacagtagtacgcgctgagagaagggacactattcccttcacctaccaatcgctgctggcccgggcgccgctggactcctaggtaacgtcgcaggcggaaatgacgt

SEQ ID NO: 1557 - DNA, 3058 bp, Homo sapiens
gccactcctgctgggcagcccacagggtccctgggcggagggcaggagcatccagttggagttgacaacaggaggcaggtgaggccagagtcccagagggagggggctgcagagttctgggacccaggggagctggcccaggaggctgggcagctgaggcagggagggagggaaataactgtgcctgattctaggacagggatgggggtgcagcactgatccaggacccagaatgggtgagtggagggaccttaactccttgagccagggcttgggggagggtgagaggcgatgagttagacctaacaactgaagggtaagaccagggttcctgggtcctggccccataacacataagaaaccaggaaaagcctggggtgctagagctggcagtgggacccagcagaggggactgtaggggcagccagtcacccatgctcaggtggatgctgaaaggcgctgagcatgcagaagagtgagcaggtgtcgctttgggcgtttgtgaattcctgtgtgtatgcagagctccaccatctgggtgagccagtgttaattaaataaggagcaggcgctcaatacatatttgttcaatgaaatcgattacctgtgggagtgtatgaatgtgtgtgtccgtgcaagtgagggacagggtctatttgggtatcagttgtgtgtctaggggggtatagtggatttctgagtttgcctactgtgttttgtaggtgcgtggatgagagctgtgtttgtgtgagtgtgtgaagatgtgggtgtgctctgttgcatgtgtggatgtgtgtgagtttgtggttctgtgtatatgcgtggggtcctggggctggattgagagtggacattgagagccccagagggtgcatgtgcacttggggaggactgtgcatatatcattgtgtgcatgggactcaagggtgggagctgggtgtgagtgtgatgtccaacctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggtaagcacccttcctcgggacccagccccttggaccttggcctgacttggcctccagggtgaaggcttggggtggcactgagaatcaggagtccgtctgcccccagtgccccatgaatcctctccagtttgtacttggccacaggggctaagggaggcctagccttctcgggccatgtcctcaggcctctccactccctgtgtactgcctgggccctctttcttcggcttcaccttccccctctggagaatgacttgctttgaccagtgaaagtgaaagttctggcagcaatgctgagtccttgttcatgtttctcttgccagaaaaacgaggactcagagtttagactcaggagccactgccttgctgtgtgacctcaagcaagttattggccctctctgagcctaagtgggctcatctgtaaaatggaaaaataacactgcctggcacatagagagggatcaaataactgaatctgtcccttcacttccttccagcacccccaacactgtccctgcttccccctccccagccccttcaggcttcagagactcacattctagaagaaaggccaggggtaatggaaaagggaagaggtcctgaccaaagtagaaagggagtctcatggaatcaccctgggcctcctagtccaaagcagaccagaaggatcacatagacatttgcagtaatttgcatccgggcatcctacatgtggtacctgaacctgaagccaagtcaaggtcagtgccccagaggggtatgaagtcctcagccttgggcaggaacacagcagagcagccagagttccatgcatttcccagaacctgacactttcccaagtgcctgttcacacttctctccactttacagatgaagtggaggctcagagaggttgagacacttgcccaaagtcacacagccaatcagaatcgatgtcctgaaggcccaggtgcttcattgccctttatcccatagactcagggggtccagctctctccctgaggaccagtaggcattggactctcacttccaatctggcatttctccccacaggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaacatgagcttcagttgctactcggagcattgagagggaggcctaagaataataacaatccagtgcttaagagtca

SEQ ID NO: 1558 - DNA, 8348 bp, Homo sapiens
gcccttcccgcctctggggaagggaacttccgcttcggaccgagggcagtaggctctcggctcctggtcccactgctgctcagcccagtggcctcacaggacaccagcttcccaggtgaggacggggcttggcgcctgggggaggctggcagggccaatatggcagaaagtggtgattccgtaagtgtgagctttgcgtcacctgcctcggagccagttaggctgtttaacagtgcaggtagctgggcccaatcccagacctatgggacccagatctctggggtgagttggggagtctgctgctacccagggcctagcggatgggcaggccacctaaagcgggagcctggcacataggagctttggcatcgcagagacttgagctgagtctggctctgcaccttatgtattggttatcttgggcaagtcacctaacctctctcagcccggcccccctacagagaacagaatctttcagcactgctgtgccttacaggagatcaagcttgcaaaagcttagtgcatgccctggctcaaaatttatcagtaaaccagaggcaggagtgggattataagccagtcgctcctgcccggcccagcatttccccaacaccttgcttatttcctcatactcgctgagaaagctcagcttgactcttccaaagaaataaggggatgtgcaggtagagttacgatgagttctcagctagtactgagtgagcgcaatgtttgtgcagctggggagtgggatgtggcactgcacggggcaggggggaccttatttcttctaagcgccttctcctgtcatccttctggcagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggtcagagcctggggggaggacaggagaaaccgcgctggcaatgatgatgggctggcacaggcaggaggcagttaaaccagatgagttgtaagccctaacccaaggctgaaactcggtggcttttgaaatgggctagaaccagcactttcccactccccctgcccctggcttccccaggaagcccaagtcctgtcagtaccctgctccccaccctctctccccaccaactggtcacagctctccaccccttgctgcctccaactgacagagcccctccctctaaacacagtctttcaaagggattgtctttttttacttctccaaccatcttcccttctgttcaaccactcaggaattcttggatgacagtgataataataaaatagctaatattcattaagaatttccaacatgccaggctctgttggaagctgtaactcatgtcctcgcacataccctatgagggagagagtagcattatccccactttataggagggtaaactgtggccagagagaaggagtgatttcccaagtcccttagctaagaagcagtagagaccttatgtgaacgctgagtgttgctttccttgtgacactacaggctcccgccaccaggtgaatgtgtgctgcctaacaagagcagcaatcatcgtggtggtaaaaagccactttcaccgaacactgaccatgtgcctaccactacccttggtgtgtcccatgcattagtccttttatcaggctgtctggcttcaaagtttatgtttttaccaccaggtacagtggcctcttaacataacattgagttttaagatccagtggatgtgggtttgactcccagccacacaggagctgtgtgacttttatcaaggtgcttgccctctctgatcccgttgcctcatctgtaaaataagaaagcaagagtgcattctcaggggctgaatatcaaattacaggggataatggcatgcaagccatctggctcagagcctggcctatacgtacccaacttattaaagttgttaaattgccattttgtaaaacctttagcaagagcaagagtgagagctgatgcttattcatggataagcaggaccatgcccctgagccaccctgtcttcagagcatagagcctgacagaacctaaagctgtcaccagcattccctggccacactcatctttacagcttcctttccttggtgcacagtgtctggcataactcagggctttcagcaagaaattgatcaggactaggctgaggggctgaggctggtttgcagagcataggagccaaatatcagtaggccttgtctggtcccagggagccctccacatgccagactctggggttgggacagccagcatgtggcagagagggtaggagtttggccacaaccctgctgttagaatagtttgctgggtgatttttgggtaggttgctttctaagttccgatcctcagtttcctcatctgcaagatgggaaattaatcacaacccacttccccagggtgttgagaggatcagagaacagcagcaatagcagtagcagccacaagtcccaatgagagcttggggctcaaggctttatgactctttcccatccatggtctcacctgggtccctgtggccactctgggaagtaggcagagaccactctgctcccccattttaagagaggatacagttcagcctctgaggaaaggtttcctggaggaagaaggctttgacccaagcttcgaatgaagaaaaaacatttggatctgggcaaaggtggaatgggctgcctcgagaggtaatgagctgcccatcactgaaacggtgcaaactatggatggaagagcccttggcagagatgtcatttcctcacactctgctgagaaagttcagcttgactcttccaaggaaataatgtgatgtgcagctagcgttgtgattagttcttagggctgagtgaacacaacgtttgtgcagcaggggagtgcgttgaggcaccacacgggggaccttggcagaggtgtcattgaggaaacttaagaataggctgaagggtcctcaggaacttaaacatggaattgccataagcggtaattcctctcctgggtataaaccccaaagaattaaaaacagatactcaaatccttgttcacaaatgttcatagcagcactcttcacaatagccaaaaggtggaaacttcccaaatgtccaccaatgatgagtggataaacaaatagccaagcgagatggtgcgtgcctgtaatcccagctactcaggaggctgaggcaggaggatggcttgagctccagagttcgagaccagcctgggcaacagagtgagaccccatctcaaaaaaaaccaaaaaccccaaaaccaaattgtagtgtgtaagtggaaggtctgtaagtggaaagacacaaacggtattttcctctgctctcacaccacaacaatcaacacagaagacttctgtgaccaaatgtggggggtttctccccacacaccaagcaagcaatcaaatctgctgggtgtctttccactcagttctgacactgtctaggaatagcatcagaccccacaggctgagagctcagtcccacaagactgctccccctcagacaccatttgcaagtccaggcccccagaacttctgaccaatcagcttcaagttggggttctcacaaccccctgcttgggtttggattctttgctagagtggcccacagaagtcggggaaacacgtttacaagtttattataaacaatactataaaggatacagatgagatgctcagggtgaggtatgagggaagaggcgtgccactgtcatgcccaggtccctgggcatgctgcccccgaggaacctcctcgtgttcagctatttggaagctctctaaacctagttctttgggatttttatggaggctttattatgtaggcacgattgattaagccattgaccattggtaatcaatttaaccttcagccccactcccctccccagaggttggggggtggggctgagagtagaccctctaagcctgccttggtcttcctggtgacgagccccatcctgaagctacctaggggctggcagccatcaatcaatcattagcatacaaaaatacctcactttggaaattctaaggattttaggagttgtctgccaggaaagaggtagaagaccaaatatatactttgcaatatcacatgtacccatacaatggagtattattcagttataaaaaggaatgaagtactgatacatgctacaacatagaaacatggatgaaccttgaaaacattaccctaaatgaaatgagtcagacacaaaaggtcacacgttgtataattccatttatatgaaataataggaataggtaaatccatagggacagaaagcagattcatggttgtcaggggctgggggaaggaggattgagaagaaactgcttaacgggcatagagttttattttggggtgatgaaaagtcttggaactagatggaagtgagggttgcacaagactgtgaatgtattcaataccactaaaatgcttgctttaaattggttaattttatgttgtaggaatgttgcctcagttaaaaatatataggctgagggttaaactagatgaacttaaaggccactttgtcctgagagctaatggcatggaacactggccatgctgaccagtttgagacagcccaccggcttcttcctagttctttgggattaaaaaggggccatcactgccctcttgccagagtcacagctctgagaatattctaccagcagaaacagcctggtatgctggcagggacatcggcttcattccttcctgtatgactctgagcaagtgacttggcctccctgagcctcagtgtcccctttggtgtaggaatcacagtagatgcagggatgctctaagcatgcaaggtggcccgttcataagcagcatcataccctgaattcagaagctctactgaataagagctttcggggaataaaaccccaaactcatagtagcttagttgcctctccactcttgcttcctgtcacttgaactcttgctcccctctgtcatactggcctcctgctgatcctcaacatcctaacctctgtcctgcctctgggccttctccatattctctgtcctcctggaacattcttgcccccaccttttctggaccttcaggtctcagcctaatcatcacttccaagagtggcttccccttggagaagactttcctggtgggaggacttccctcacaaaacccaccacctcccacctccagcccagttactctgcctcccagcatccttctctttctttcagagcaccaatcacggtctatcactatttctatttactttatgctgacccatttatatctacctgtttatatctgtccccactaggggcacaagtccaggagggcagggactgtatccgtcttgttcttcactgaatccccagcaccttgcacagagtctggtagataggggacaatcagtgaacatatggatggaggaatggatggatggagggacagatggaggaatagagggatggatggatgaacggatggatggatagatggacagagggatggagggatgcaggggcagaaggatggatggatggatggatggagggtggatggatggacagatggacagagggatgcagggatggaaggatggagggatggatggatggacagcaggatggagggatggatggatggatggatgcagggatggaggggtagagagatggatggatggatggagaggaggatggatggatggatgcagggatggacagagggatgcatgggtggatgaatggatgcagggatggagggatagagagacagatggatggatggatggatggatggatggatggatggatggacagggggatggagggatggatgcagggatggaggatagagagatagatggatggatggatgaatggatggatgcagatagagggatagagagatggatggatggatggttggatgcaggaatggagggatagagagatggatggatggatgcagggatggagggatagagagatggatggatggatggacggatgcagatggagggatagagagatggatggatggatggatggatggatggatggatgcagatggaggaatagagagatggatggatggatggatggatggatggatggatggatggatggatgataggatcaccacggtggtaacctctcacattgtcttctccacaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaaggtaccatgggatttagcaggacactggtaatactgaccaaatttcccgtctcctgcctcccaagtcacagttgcctacctttgagactgcaaaagcactggcaaatccagcagcttgctgaacccttgcagtaactttgcaaggagggaattctgattcccattttacagagaggaaaactagcatctagaaagtctgctgacttactcaaggtagcccagtaaatgttgaggctaagaccagaccacggatctcttaccattaaattcaggtggagagggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctaccgttatagagcaactgtctgtgccagtcactctcctcacataatctcatctaatccttacaatcccacaaaatatcttcatccccatttcacagatgaggaggctgtcctcaggaaatgtgactcagtcaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagcagcaagagtgaaggccatggttgattagggatgtctgccaggggtgagggatagagggagacagcactcattatccctgctctagctgaagaaggacccccacacaagctggggaggagggccggcctagcaccttccttagcaaggagccattcccctccccacgatcagcagcccccaagaaggtcaagcatatcacagactcaggaagctgggctggagggagacccagagcccctgcctgacactgcctccttcgttttacagatgggagactgaggctcagagagaggcagggccctgcccaaggttccagcgcaggcctccttcttttggtctcagtgatctcacttctttggtctctgcttttccagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaaggga

SEQ ID NO: 1559 - DNA, 4486 bp, Homo sapiens
gaccactcagacaccgtgtcctcttgcctgggagaggggaagcagatctgaggacatctctgtgccaggccagaaaccgcccacctgcaggtgaggcccggacccctgcccaggtatgggcagatggccgtttcctccaccttccgccaccttcctgaaatgtggtgccaggggcagcttggtgtgtgaggggaaggagggttcccactcctgctgggccccggggcctgggctgaagaaaaggccccaccatccatccatggtgaggctcctgggggaggaaggaaggcgagctcccgagggctgaggaggacgggccctggggaatgagagggttgggggcaggtgaggggctggcggggacagctcagctctctccctcccagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggtgagtctgctggcctggtttgggggtttgggtctggggcagggatcagagtgtctgtctggggctgaccaagggggcgggggacagcaggaagtgcttgccttgctgccacgcctgccccagggcagaggtggactctcacggtgtgtctggctcctctatcctcagagcccaggcttcaggccaccccagaggtgaccttgggcccagcgcacttccatcttccttctcctccttacccgattatagggagggaataagagcgcctgcccccaaaggtggccaggaggctcacaggagacagtgcagggaaagtcttcttgccctgcaacatgggcacctggggaagctggggcccacacagtgaatatatccaatgcacgactgccagggttcaaatcccagcccctactgattccctctatgtgaacccgcacaagttacttaacctcgcagtgcctcagtttcctcatctgtaaaacgaggagatggtagcacctgcttcacaaggttgctgtgaggattaagttaacttaaatataaaacagccctgagcacctgggaggtctatacaggtgtaggctattttatcattggttttatcagatatccatgctcacctccctccttaggattctggatagttggaggggtggggagtaggaggtcaggatcgcagccagagaaacttctgttggaggtccacaggcaatccttggcataagagaagggggctgaggctatgaatgggtgactggggctggaactggagccctggggggtatgagtgccttgtctgtgagtgagctgggcacgtctcagatgctaggcatgcctggagccggcctggggtgacactgagcggaggtgatggggtgacagaggcagtggaaaggagggaggccagttgagaggaatgtccttaggagtggtcccaccatcatcttccctcctggatagagggaatggcaccaacattccagaaggaattctccaatttagggtgagcttagggtgagctcaaagctcaatgaggcctccaggtctgccattttccaggagcttgtacttcacagctgcctctgaccacctccctgcccagggtagctgatggccacccgtgattgagcccccaagtcccaggtgtggtctcagttttaggaaatgataaaaccgaggccacaatcccttgaaaaagtgattgaccctcattttgcaaatgtcaaagctggggttcagagagattgagcaacttgtccaaagtcacacagtgggatcctgtccaactctcaagtccacattctccaccactgccctcagctgcctctcaagtcccctctgtattgctgtttcctggccccctctcaattggtggtttgaagacatcacgaaggatgagacgctgctctgctcagcatcactggcagccatcacgaggaccagacactccagagcacgcttcctatggtgtgcctggcacagtgcctgtcccactccaccctttcagggactccctcttctattatgcccgtatctcaactgagcaaatacaggctcagggagggaggtcacccacccagggtcacagatgtgaaggccaggtctgctgggtcccgaccccacactcctaatgctgaggcctaagaggttcataagccatagaggatctgtcataaatgggtctgcacagtcacccagcctgacggaagtcagaggaggaaaggaaacatgagggctgatgggagcggtcaaggagggcttcttggaagaagaaactggagtcagcccttaaaagatgagtatgatttagataaggggagaagaatctcacagaggctcagatcatcagggctggaacagagtgagacactgggattctccagacttgagttagagacctgactccacctcaaactggctgcacggccttgggcaagtctctaactcggcttcctcatcggcaacatgagggaagttgaaccaggccagctgtcatgggggctgacgtgggctgaatggggctggggtgagctggagagagcaggccctgcagtggggcggcttctattcggctccttccagtggttcccatgtgctaacctggggaatccatctcaggagcagatataggttttgtgggactctgaagcttgtaaaatgttgagggtcttctttatgaaaaataatacaaactgaaagatgcgcttgattgcagaggtgagagtggttacaaaaatttacacatgtagcaaaattatattggaaccacacacacagtgtatataaaactggtgaagtctacataagctttgtgaattctaggaatgtcagcttcctggttttgacattatactttagtcatacaagctgtgtcactggggaaaactgggtgaagagtccctgttcttttgtttcttcaactttctttgactctatatttcaaaataaaaaagttgaaaaaaatcagaaatacaaaattaggcaaaaggtcttgaaggggctgatgcaagtggacagaacctgaaacttaagctgcctctgaccaaccttctgattttttgtcaagaaggtctgagaatttcaaattttaaataagttctgaatttgttcatgttgggctccaattaaaaattttaaaaaacattgtgcaggccaaacaagatacttgtggccacatgccatctgtccgtgggctgacagtcatggcatctgtgatcccgcccagctctgagctccctacttgcttcatcacaaatgtggaaactgaggccaagagacagggaagtgccttagacaaggtcagagggcaggtcagtggagaagcaggacttgaaccagactctctctctcccctccagccaaagcctaactccctgcaccctgctcctagggagatagcccatctatgagaaggagattctagagaccaaatgccagcgctgtgttccctggaagacaccctcagggtccctcctccctgtcccccaccctatcactttctctctgccttctccatctccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacata

SEQ ID NO: 1560 - DNA, 4486 bp, Homo sapiens; identical to SEQ ID NO: 1559

SEQ ID NO: 1561 - DNA, 12224 bp, Homo sapiens
cttgggcaggagggaccttcgatcctcggggagcccaggagaccagaacatggtgagtctcgaaggggaatgggagcaggaaactttgtcctgggtccctcccatctttgctccagtgggtccttctctctccccaactctcgccgtcaactctgtctgtctctccctttccttctctctccctgtcttccacctcccaccttccctctctcctgcatcccaggctctcacactccagggctgggatgtggccatgggaataagattgtcaagattgtgggagcaacagcaacctcgtggggctggggcccgagaagattccccaggggaggggacccttgagttgggtctagtaaggtgactaagaattccacaagcagccgagcgcagtgggtcacacctgtgatcccagcacattggggattgtgccaaggcgggaggattgcttgaggccaggagttcaagaccagcctggccaacatagtgagaccctgtctgtatttttttttttatttaaagaattccacaagtgaagaaatctagaacaggccttccaggcagtgggaatggcagagaaaatgttgggaggctggaaagaaccagtttggaggaatggtcaagttactcagatgctcttgcagatagatgttcttttctttttcgacttggggtcttgcactgttgcccaggctggagtgcagtggcaccatcatagctcactgcagtcttgaactcttgggctcaagtgatcctccctctttagcctcctgagtatctgggaccacaggcatgcaccactatgtccggctaatttttaaaatttttattcttgtagagatgggttcttgctatgttgtcagggctggtctcaaattcctggcctcaagccatcctcccaccttggtctcccaaagctctgggattactggcatgaggccattatgcctggtcgtttgagatgttctgcatgacagagatggggaaactgaggcccaggcaggagcagagatggatggggaccctccatggttggtggcagaagcaggttatgccatggattctgtgagtgtcagaaggaatgcaccccaggctaaatgagggtccctgtcatccctgcgtctggaggcctgggcactgagccagcagagctgcgattcagcacctgctgtaacacaggcattgccttgcttcatctgtgtcaaagaggaaacggaagatggtttggatggaccagggaggggtctgatgttgcttcattcctgcattccacccttgagatccgacttgggcaaacgggactctctgattcttcttcttctttttttttttctttccaaaacattttccaaagtaccaaatgatacttggtaaaaactcattctcggccaggcgcggtggctcatgcgtgtaatcccagcactttgggagactgaggcgggcggatcacaaggtcaggagattgagaccatcctggccaacatggtgaaactccgtctctaccaaaactacaaaaattagctgggcatataagcgggcgcctgtagtcccagcacttgagaggctgaggcacgacaatcgcttgaacccatgaggcagaggttgcagtgagccgagattgctctactgcactccagcctggcaacagggccatctcaaaaaacaaacatagaaaaaaaaaaactcattctccctgcctaccccagagcctctgactccttttctttccttttattttgagacagagtttcactcttgtcgcccaggctggagtgcaatggcacgatcttggctcaccacaacctctgcctcgcggcttcaagcaattctcctgcctcagcctcccgactaggtgggattacaggcatgcgccaccacgcctggctaattttttgtctttttagtagagacggagtttcaccatgttggccaggctggtcttgaactcctgacctcacgtgatccacccacattggtctcccaaagtgctgggattacaggtatgagccaccctacctggccctctgactccttttcattgcctcctaccctacctggggcaaccatgggatgccagtttgtggtggatccttccagaaacagtttacagatgcctgagagcacagatgcttagggaacaaagtaaggactagtgtgatgcggggaaccccaaaaccgagctcagcttctgtctctactatgaaatagttgcggagatctgtcctctccgtgcttctgtctccttatctttttgttttttgagacagtgtcttgctctgttgcccaggctagagtgcagtggtgtgatctcagctcactgtaacctccacctcctgggttcaagtgattctcctgcctcagcctcccaggtagctgggactacaggtgcctgccaccatgcctggctaatttttgtatttttagtagagacggggtttcaccgtgttggccaggctggtcttgaactcctggccccaagcaatcttcccgccttggcctcccaaagtgctgggattacaggcgtgagccatcgcacccagcctccttctccttatctttaaggtgaagataatactagaatctacatcataggctagttgagagaattgactgagtgaatgcatgaaaagttcttgtagcagtgcctggtatacagttggcgctcaatgtgggtgacatttctatcctttcccagccttataaatggcagtatgttttgtacagtactctacatctggcttttttaaatgaataacatatagtattattaactagcatttattgagtgcttactgcataccaggcgttgtattaggcattcattaatttccccttaaccttgaggaaggtacttcattcccgtgtagttcaagggagttgcctcctcctcctcctcctttttttcttttttctagacagggtctactgaggtcttccacctcagcctcctgagtaggtgggactacaggtgcatgccaccacacccagctagatttaaaattttttgtagaggtggggtcttgctatgttgcccagcctggtgcttctttctttcttttatcagctgagtaatatgctagtaggaggtttcatccccttcaatggaaatttagtttgcttctaatatttggtctgttttgttttgttttgagacagagtctcgctctgtcacccagcctggagggcagtggtgcagtcttggctcactgcacctctgcctcctggattctggtgattctcctgcctcggcctcccaagtagctggtatcacaggtgcgtgccaccacacacggctaatttttgtattttattttagtagagacgggatttcaccatgttggccaggctggtctcgaactcctgacctcgtgatccacccgcctcagcctcccaaagtgctgggattataggcgtgagccaccgcgcctggcgtccagccacattctttaactcagcatctgcagaccttccagtcctatcttggccgcctgccagccatgctgacctttcgtttctgctgtgcaccacctgcccttcctctctcctttctgcctagaatgcatgcccccccactcccaatgcactttaggcctgcctggtagccactcaaacagagggctctgggctgggcgcggtggctcatgcctgtaatcccagcactttgggaggctgaggtgggtggatcacgaggtcaggagatcaagactatcctggctaacacggtgaaaccctgtctctactaaaaataaaattagccaggcatggtggcgggcacctgtagtcccagctactcgggaggctgaggctagcaaatggtgtgaatccaggaggcggagcttgcagtgagctgagatcgcgccactgcactccagcctggggacagagcgagattccgtctcataaaaaaaaaaaagagagagagggctctggggctcagctctcaggagtttctctcctgtctctgttcttgctaaccgagaagacttggagaggtctgttcatttctctgtagcctcatttttctcttctggaaaatgagtgttgctgttgcaacaagtaagtctcctagggttgctttgtgggttcaatgagataatacacgagaaaggctcaggacagcctggcaatgattatggctgttcttgtaggtactgcgccttctccttcaccctgttctcatccgatcgttcacatcttgcggccagcacccttgtctaagccaccgtcatgcctcacgtcacctggacagttccaatctccgtttcctcccagcttctgctctctgcccctttctccatgcaacagacaagggttgttcctctaatgagcatgtgaatttaggaagaataatagtaccctgccctttgtgctattgtcacatagatatgcactgtgattaggaaattactaagccaacacctgggaagcacatggaatagtgccgggcaattagaacccccagagtggccctggacctgcactgcccaatatgtgggccacgtgccacaatgcagctacctacgtttatttttcactattttattttattttactttatttattttatttttgagatggagttttgctcttgttgcccaggctggagtatagtgaagcgatctcggctcactgtagcctccacctcccgggttccagtgattcttctgcctcagcctcccagatagctgggattacaggcgcacgccaccactcctggctaatttttgtatttttagtagagacagggtttcaccatgttggtcaggctggtcttgaactgctgacctcaggtgatccacccgcctgggcctcccaaattgctggaattacaggcgtgaaccaccgtgtccagcctattttattttttagagatggagtctcgctatgttgcccaggctggagtgcagtggcacgatctcggctcactacaacctccacctcctgggttcaagtgtttttcctgcctcagtctactgagtagctggaattacaggtgcctgccatcacacccagctaatttttgtatttttagtagagacggggtttcactatgttggccagtctgggcttgaactcctgacttcaagtgatccaccttccttggcctcccaaagtgctgggattacaggcgtgagccaccacgcctggcctcaccctagatcttggaggtctttccacatcattatataaacattctttttgtctgtttttttcctttttgtagggatagggtcttgctaggttacccaggctgatcttgaactcctgggctcaagcaatccccctgcttcagcctcccaaagtgctaggattacaggcatgagccactgcacctggccaacttttccattctttttgatagctgtgtagtattctgttgcctggatgtaccatcattaatttagccagtcccctcttgctggacatgtcagttatttccagtctttggagaggtgctgcagtggcaaactttgcaagccgtttgcgtctgaagatcccggaaaccacaggacgttggaatcagcgtattttttctgcctttctgaagtcaaccagaggaaaggactgagtgagctcatggcaggaacggagctttgtcagctgatgagggagtgacaaggcgatgtcagagcagagggtggggaggctccccttacgagggtctgagtcattctgcagtcaaggattgctgggagcttgcgaaaccagcagaggcaaaatttaccttcatgcgtcacagccaaagggaacattcaaaatatttaacaatgtgctaaagtgcagaggtcccctgggcagggtctagggcctcctgctgcacctagcattaactctttagtgacatgaacatggcgacctggagtgggggtgtcccagagtaggaaacaggaacttagggtgctgggagcgggcaatagaagaagtgggtggctgagggcaggggctgtttaccagtgaaaatatttttaaaaatgttaaccttctatttggaaatattttcaaacttacggaaaaatgacaagaatggaacaggctcatatacatatacattttacctagactctccaaatttactgtatctgtctctccattatccatccatccatccatccatctgtccatcgattcatccatccatccatccatccatccatccgttatctagctattttttttttttagacagagtcttgttctgttgcccaggctggagggcagtggcgcaatcttgactcactgcaacctccacctcccaggttcaagcgattctcctgcctcagcctcccaagtagctgggactacaggcacacaccactgggcccagctaatttttttgtacttttagtggagatggggtttcactatgttggccaggctggtcttgatcttctggcctcaagtgattacaggcatgagccaccatgcccagcccattatctatgtatctatcatctatctatctatcatctatctctcaatcatatctccatgtatccattgtctgtccatcagtcatctatctgtccatcatccatgcatccactcattcacccattcgttatctatccatccgtttatttatatccatccatctttctatcacctttttttttttttgagacagagtcttgctcagtcaaggctggagtgcattggcatgatctcagcttactgcaacctccgcctcccaggttcaagtgattctcctgcctcagtctctggagtagctgggattacaggtgcgcgccaacactctggctaatttttgtatttttaatggccttttgtgactggcttctttcacttagcatcatgttttcaagattcatccacattgcagcatgtgtcagcacttccttttcatagctgagtaatattccaccacgtggctaaaccccacctttttcattcactcattagcagatactgacatcttatctttcaataatttactcatggatatgattccaccagtaaatgcccactgcccatagcctggctaaccttgggcaggtgcaatgtaagggaactagaaaaaaaaaaacaaaactatccaggcatggtggcttacatctgtaatctcagcactttgggagttcaaggcaggagggttgcttgaagttaggagtttgagaccagcctgtgcaacaaagcgagacccatctctaccaaaaaaaaaaaagaaaaaaaatacaaaaattagctgggtgtggtggtgcacaattgtagtcctagctactcaagaggctgaggcaggaggattgcttgagccagaggggctggggtgacagtgatccatgattgcaccactgcacataagcctgggtgacagatcaagaccccgtctcaaaaaaaaaaaaaaaaaaaaaatataaaacggggctgggcgtggtggttcatgcctgtaatcccagcactttgggagaccaaggccggaggattgcttgaacccaggagttcgagaccagcctgggcaatacagtgagaccctcctctttaaaaaaacattaaaaattagctgggcacagtagtatgcacctgtagtcccagctgcttgggaggctgaggcaagaggatcacttgagcctgagaagtcaaggctgcagtgagccaagatcacacccctgagctacagcctgggtgacagagtgagactcagtctcaaaaaaaaaaaaatatatatatatatatagtggttcagggatgtggatctgagctcttcaataactgacaaataataataccaatggctgccacttcttgtcctcttctctgtgtcaggcgctgtgctaggtgcttaggcatttttcatcttatttaatctttgaggtgagtgttttaaaggtagaaaaaccaggccgggtgtggtggctcatgcctgtaatcccagcattttgggaggccaaggcaggcagatcacgaggtcaggagttcgagaccagcctgaccaacatggtggaaccctgtctctactaaaaatacaaaaattagcagggtgtggtggcaggtgcctttagtcccagctactcaggaggctgaggcaggagaatcgcttgaacctgggaggcagaggttgcagtgacccgagatcgtgccactgcagtccagcgtggcgacagagtgagactccatctcaaaaaaaaaaaaaaaatgtacaaaactccatctgcaaattcaaatatttagagctgcaaatacagctctcagtatttccagaatgatttctatttcttgctgtccccttttctctgggttggtgtcaaagtggccttcaggactgggctagctccataggtcacaaaactcacctcttggaaatggtcaggggcagcctgtctggtttgcattccagcccgtatgggttcacatcctctctgagtgacctggaacagcctacttcaccttctggtgcctcgtgcttcttcatcagcgaaatgggcatttttttttctttcttttttttttttgaggtggagtctcactctgtcgcccaggctggagtgcagtgtcgctatctcagctcattgcaacttccacctcccaggttcaagtgattctcctgcctcagcctcccgagtagctgggattacaggtgcccgccaccacgcctggctaatttttgtatttttagtagagacggggtttcaccatgttggccaggctggtctcgaacccctgacctcaggtgatctgcccaccttggcttcccaaagtgcttgggttataggtgtgcaccaccacacctggcctgaaatgggcatattaacagaacctccttgtaggttgtggtcaggatggaaagagcaaattccatgccgcatgcatagtaggtgctcagtaagtactggctgctttcgggtgatcactcagtgccctgatgggtgctttactgcagtgtctggtgcctctggacacagatttcacctacaaggctttctccagtccagctgccatggactgcagcctttctttcttgggtgcatgacagcttccttcagctctgtctgggaagaagtgatcaggacctttttgttctatttttttttttttttttttttttagatggagtctcactctgttacccaggctggagtgcaatggggctgtttcggctcactgcaacctctgcctcctgggttcaagcaagtcttctgcctcagcctcccaagtagctgggattacaggcgcccactaccacgcctggctaatttttgtatttttagtagaggcggggtttcactacattggtcaggctgatcttcaactcctgacctcgtgatccacccacctcggcctcccaaagtgctggattacaggtgtgagccaccgtgcccggccagtagggctagactttgacgttaggctgctggatcgtggggaagcccaggggcttcgcaggatgggactgaggggagaggtggcagactggcaaggggtccaactagcatggaatcatttcattttttttttttttttttttttgagacagggtctcactctgtcacctaagctggagtgcaatggtatgatctcggctcactctaacctctgcctcctggggtcaggtgatcctcctacctcagcctccggagtagctgggactacaggcaagtgcaaccacgcctggctaatttttgtattttcagtagagacggggttttgccatgttgcccaggctattctcaaactcctgggctcaagcagtccgcccgcctcggcctcccaaagtgctgggatgacaggcgtgagctacggcatctgcctcaatattttaataagtggtgtgacaccctagttgactctcagccctcagcatccccatttcctagtgagaaaaagccacacaggggaaaagccacatgcctgagccaggatgccccctacccgggcacatgtctgcagactcatcctctctgctctctccgattccccttaggactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggctggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaagaagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccaccccccccacacacaccatctttccatcccaggcttttgaaaaacaaacagaaacccgtgtatctgggatatttccatatggcaataggtgtgaacagggaactcagaatacagacaagtagaaagattctcgcttaaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaacttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaagtatacatgactttaatgaggaaaataaaaatgaatattgaaatgtt

SEQ ID NO: 1562 - DNA, 137800 bp, Homo sapiens
ttcaggttaggaaggcggcaagggctcaaggcctggcaagctgttcacaaacaaagggtcgaaacaaagaaataataatacattttaatgcaagagaaatcatagcctggtacacaccccttccccgatctgtcctgcctggggatgtgtttatggtgagtgtgtccccaggactggtagtcacctggctgtccgggtccccgccctactggcggcagcatgcctgtccccagcattacattcaactgctgctctggctctcgagaggccggctggcctcgggcctccggcttggcgttctttgctcccctgtctccctgctaaggccagcagggccaaactgctaggccaggtcagccagggctgggggaatgggctgtaccctgctcctccccaggcacgactgtccccccggggctccatcaccgggtggggcggagcgtctgctggggcagctctgtgggccacaggatccccccgcacccactgcatctctctgcccagggtgcctgcctcataggatgccccgcgccacagagtctctctgcccagggcgcccgcctcacagctggtcctcgtccacccagatggtcttgcgctgctcctcgccgatcttgtccttgacaacgcggagcagctcctctacgctgccccacatgtcaggttccaccgtggcgtacaggcacggcagggcctccagctccttctccttcagccggcacacgcgcaggaactcctcctccgtctcaggtcggggcagcagctttctgggaggagacacgcaggggctgtggggaggctgcaaggccgtggcgctggtgtggcaccacctgtccggccacccctgactgccgtggtccccaccccttccctgccttgcttctccctatagcgtccgtgcctcttaacgctagggaccgtgccccttcatgctgttcatcggaaattccaaatacatccttattgattgattgattgattgagatggagtcttgctctgttgcccaggcttgagtgcagtggcactttcttggctcactgcaacctccacctcccgggttcaagtgattctcctgcctcagcctcctgagtagctgggactacaggcatatgctatcatgcctggctaatttttatatttttagtagagatggggtttcaccctgttggccaggctggtcttgaactctcgacctcaaatgacctgcctgccttggcctcccaaggtgctgggattatgggcgtgagccaccgctcccggccacatcctttttatttttaattgtgctaaggtacgcataaaataaaatcaaccatgttacctattctttaagtgagtaattcagtagcatgaggtatattcacaccgctgtgcaaccaatctccagaactttctcaacttcccaaactgcaactctgggcccattaaatactcactccccatcttccctccggcagcccctgagaaccacccttctacttgctgtctctaggaatctgactgctctagagacctcacagaagcggaatcacatacagcatgtgtgtttttgtaactggcttatttaactgagaatgacaccctcaaggttcatccatgttggagtgggtgtgagaatctccttccttttcaaggctgaataatactccactctatgggccgggtgcggtggctcaggcctgtaatcccagcactctgggaggccgaggcaggaggatcacttgaagtcaggagttcgagaccagctggccaacatggtgaaacccaatctctagtaaaaatacacaaattagccaggcatggtggtgggcacctgtaatcccagctactcgggaggctgaggtaggagaatctcttgaacctgggaggtggaggctgcagtgagccgagatcgtgccactgcacttcagcctgggtgacagagtgagactccgtctcaaaaaaaaaaaaatactccatacagtatttttgttgtgatacacactgcaccataaacacattcccaggcaggacagatcagggaagggggtatgtaccatgctagtatttctcatgcattaaatgtattattgtttctttgtttcaactctttttttgttaacagtttgcaaggttttcagctcttgccaccttcctagcctgtatggatgggccctattgtgtgtattcactccccacagaccgacccttaggtgacgtctacgttttggctattgggagtaacgctgctgtgaacacgggcgtgtatatgtctcttacagaccctgctctcaattctcttggggatatgcccgcaggtggggttgctggattatatagtattctatttttaatttttgggggcatcgccatgctgtcctccacagtggccgctctcttttgcatttccagcagctgtgcaccgggttccgacgtctaccctcctcgtcaacacttgtcagtttctgtccttttggtcctggccagcctaacgggtgtgaggtatcgagggggatgcccgtctcttttgctcactgctgcgttccccagagcctaacccttcacaatggctcagtgagtatctggtgaaaaggaatgaatgggcctaaactctcagtctgtgattccctctgcaaaatggtggcaggacatttattttgcaggtgcgtgcgaggaggggcggggatccgagatgaagccacttaagggccagtctgtcctcatcacccaggccccaaacctcagcgccgtcctttcgtttttttttttttgtttttttttttctgagatggagtctcactctgtcgcccaggctggagtgcagtggctcgatctcagctcactgcaacctgcccctcccacgttcaagcgattctcctgcttctgcctcctgagtagctgggactacaggtgcccgccaccacgcccagctaattttttttgtatttttagtagagatggggtttcaccatgttggccaagctggtctcaaactaccaacttcagctgatgtgcccaccttggcctcccaaagtgtggggattataggcgtgagccaccgcgcccagcctctggttctctggaaccccagagtgaaccctttcccgaatcctgcaggctcgaccctgaacacggattcggagtcagactgcctctcatcgcctctcagacagaagcccggcccacaccgccaccctgcccgtgtccagaggtgagaggtgcgtttataccctaaagtggaccatgccaccttcagtggcctccagatgcacccagaacaagatgtcgcagcctcccgtggccctgcatggcctggacccgctgcccctcacccctcagcctctcactctccgtccctcaccctccgcccctcactcctcagcctctcacccctctgtccctcaccctctgcccctcactccccagcctctcacccctccgcccctcacccctgcgcccctcacccctccacccctcaccctctgcctctcacccctgcgcccctcacccctcagcctctcactctccgtccctcaccctccgcccctcactcctcagcctctcacccctctgtccctcaccactccgcccctcacccctccgtccctcaccattccgcccaaacatctgtctcagggtctgagcaccagctgttcccctgctgcccagattgcgtcttctttctcatctcctaggcccccctcactgccatgggtctcgctgatggataccccaggccttcccggaccaccctgggtgatgggcactccgccccgtccctcccagctcttgtcccctgggatgcgccccatatgtgagtcaccatctcggccgctgtccttggcatcagctctgcaaggtcagtcccgtacttggtgagggtttacaaaaggggtgcatgaggtgggggcacacaggcctcctgcgatccatggaggcttggtggggtgctagggacaggaggggacagcccttaggggtctgggagccctacctgaacctcttgatgttcttctcacacacccggatgaagagcacgatggggtagatgttggacttgatcaagtctcttgtgcagccgatcccagcctccagcaggcagtgcttgttctgcgggcacagcggctttggtcagcagcagcccacccacctcccgctcctgtgaaggtgcctgcagcggggcctggatgcagggttggggtctatagcggggcgggagccctgaaagccacctgccgctgatccaggagatgagacccccacatgagtctggacactccaggactctgctgaccacagtgatgttcatgggcagagatgaggccccggacggggtgaaccaggtggcgtgaatgagtttgaatgaaacacctgctaccagccgggcgtggtggctcacgcctgtaatcccagcactttgggaggcccaggcgggccgatcacttggggtcaggagttcgagaccagcctggccaacacggcaaaaccctgtctctactaaaagtataaaaattagctgggtgcggtggcccacgcctgtaatcccagctactcgggaggctgaggcaggagaatcacttgaacccgggaggtggaggttgcggtgagccgagatggtgccactgcattccagcctgggtgacagagtgagacactgtctcaaacacacacacacacacatacacacacacgcacacacacacacaccccaaaacacctgctaccctagccagccttcaagtaagagggtagggaacacatgaagggtgaggcggcgaggctggcaggtcccaggagtatctgcaaggttctcaaccatgagctcatcattttgagaaagggcaatttctgctttgctgaaggcatcacttaaaaaaaaattccaccaaatgttggcatggtggctcatgccagcaatcccagcactttgggaggtgggaggattgcttgacgctaggagttcgagaccagcctgggcaatataacaagaccctatctctaaaaaaattagaaaatcattagctgggcatggtggtgagtaactgtagtcccagctactcgggaggcagaggcgggagagttgcttcagcctagaagtcgcggctgcagtaagccgggatcatgccctgcactccaggctgggcaacagagcgagccccagtctctaaataaataaaacatcaaactttgcattggaatagaacataaacacagcattctaagcatgcagctcagtgaatttcacaaactgaacgcagtctagcactcgtgtctggaggtgggaatgacccccctcgcccagggtctccttgggcctcctgcggggccactgctccccattccccaccaataggaccatggcccacatttctacagcacagatctgctggaaggcttcttcttttcagctaaaaacaatctcagctccaaccctgtctgctcactttctatccacgccagctatcagaatttcctaaactgctgtggcccagacttaaaaaaaacaaaaacaccaccatctgctcttgccatccccaaggtcagcgtccaccacggagccagcccccggcagctgggggagccctccagtgacgcggacagagagccttttcttcatccagtgctgggacgaggaagagctcaacgcttaggtcacattgtctggctccaaagactccacattgcacacagacaacctttttgcatcgttgccaataacccttgtgatgccccgttttcccctcgtttggtgaatgcaatacctgtcaccttcatgttcatcctgtctctcgccctgatgagctcgttctctatctctggcccttgttatcacaaccagacacacacactcctaaataatgcgaacacacaccagctccaggaagccaacacaaatagaaagctccaaaataaaaactcacttcagagcccagggaacaagggtgcagagagggagttaacacggggcagctgctgggacaaggggaaaaggagaggtctggccacggggaggtgaaaacaactcttcatcccacccttgtccctggcccaggtggcctcatgaggatcatcacggagggtcctggccccatccaacctcccagtccccgcctcaccttggcggccacagcttcaatgttggcaggggcgatgcattcgaacgcgttggggttcttctctcgggagtagatgatggtctccgtcttctgccttctgaggaactcatctcttgtgacgatatctgcagagagaggggccagtcctgagggcagcacgaggtggccttgggttgaccatcccactcaggccctgcctgccaccttctgggctctacagaactcgatgtccgatccccttccagccatgtttaaatgaatctcgtctcccctcgactagactgtgaagctccttgagggcagggctaaggttaaccttctccatactccccatggcagcccatagagcaggtgcttggcacctcagcaatacctttcactggacaaagcagctcaggcaccgtggtgcaaggctgatcaccagtctaaataaatctcctgttccacccacccacccacctacccatccatccacccacccatctaccgacccctcacccacccacccatctgtccacctacctatccacccatccacccatccccttatccatccatccatccatccatccatccatccatccatccactcatccatccatccacccacctatccatccatccatccatccatccatccatccatccatccatccaccaatccatccacccactcacccatccacccacccatccttccatccatccatccacccacccatttatctatcaatctgtccacccacccagtcacccatcatccattcagccatccttccatccatccatccacctatccagggggaggaggggtgatggggaggaggaggagggaagaagagggaggagggaggggaggatgaggaagaagaaaaggaggggaggaaaggggaggagggaagtgaggagggggaggggaggagtgagaagttggaggagggagaagagaagagggagaagggaggaggaaggaaaggaaagagggaagaggaggaaagagggaagagaagaggggaggagggaagagaagaggggaggagggaagagaagaggggaagtcgtcctggttcatggctcccgcggggctccccaggtggccgtggctcgccgctcacctgacttgcagatggtgaactccatggcacctcccgagttgagcagcctctgcaccagcgtcttggccagcacggtgggtgtgaagagcacgggccggcggcgctcgcagtagaaggcgcgtaccaggctgtaggggatgaggctgaggttcttgcccagctcgctctcagggtccagctctggcaggggcaggagagggtggcggtcagacccctggggctccgaagaccttccacggaggacggggcccctgggctgggtcctggaagccaccgtcagtgtgaaggcctggctgctgccccgggcatccagtgtctgaggtcacctcgggctggcactgcttggggcttgtgtgccagggaggggaggtgtggtggggggcaggcagagtgtgtgacaaatgcaggaaccttggctgagctctggagggaaagtttgccttgtcagacgatcaaggagggcttcttggaggaagggtagggactgggtacagcccagcggaggggagggcgagggcaaggaaagcaagtgccggcaggcacccacgagacaccaggaccagcggccaaggccttgggtgtctcccaggagcactgggagggacgacttggcctcagttctgctttctcagtccctctgtggctggagtggcagagccacacagaagcccggggttctgatgaagccacccccaggcagcccgaggaaacagctcccagaaacgggcagcctgtcccttgtcccttgtgccttttcttgtaccctggcctggccactccaacgtccaaagggccagcccgggaagccgccccaaggcctcctttgagatccagccagggctgtgtggcttccctttccctgagcagggccagccagggccagcggggtgggggacggtggaccgggaggcccctcgccgggttgataaatggcaagtggcactcagtgggtagagaaatcaataaaacgaacacttcacagcaaacagccccaattaacacgggtacccgggagcgaagcaaccacacgagagcgtcgttattgggtgagcttggcgggatgtcaccccgaggcagcatggtcctcacagccaaggccaggctccctcaccgttttaatttctttttgtcttttatttttatttttagagctaggagtcttgctgtatggcccaggccagagtgactgcagtgatgttatcttggttcactgcagcctcaaactcctgctcaagtgatcctcccacctcagcctcccaagtggctgggaccataggcacgtgacaccatgcctagctatttacatattttaagatttatttttaatgctttatgtttttattttaatgtttttatatattttatagttatatatatatatatttatttatttattttattttatttttttttctgagacggagtctcgctctgtcacccaggctggagtgcagtggcgggatctcggctcactgcaagctccacctcccaggttcacgccattcttccgcctcagcctccagtgtagctgggactacaggcgcccgccaccgcgcccggctaactttttgtatttttagtagagacggggtttcaccattcacaggatggtctcgatctcctgaccttgtgatctgcccgcctcggcctcccaaagtgctgggattacaggcgtgagccactgcgcccggccatagttatatttttttgtagagatgggggtcttactatgttgcccaggctggtcttgaactcctggcctcaagcgatcctccagccttggcctcccaaaacactgggattgcaggcgtgagccacctgtgtccaccctcctctccctttggaggacttccaggccccctcacaaggaccgatgttcctccaggtgagggtgaggcatgtgtgactgtggctgggagtggtgggaggggccaggcggtccccatgtaccttcctgcttctcagtcaagagcttggtggcgtccagcgaggaccgggccaggctccctagcggactccccgagatgatgcggacccgctcgttgctgttcatccgcttatacttgttctcggacctgctgacgaactggaggagaagagggagggtcgggggaggactgttttgcttccacttctaaacagacagggtgctgccctcaacccggcaaagccagaccttgttcaaatccctgctctgcccctgggggttcctgggccagtcatttcccctataaaagcaggagactcccagcaggtggctcgagccctttagccactggagagatgttctcagtaggtaaatgagtgaatcggtgcccacgctgtcttccgcagccggatgagtctcgggtcaagctcatgtgcatccccgtgggaacctcaggtgcagctctgcaggcactgtgggacctgagccgccccagccatgaagacccctggctggaaacccctgtgggcagggactgtccccctgctgggcatgtgctggacaatgccacctccctctgacactgtgctcaccatgcctttctgcttcggtatccctaagtttaatgggggcacccacttttttctacaattcacagagttgagtcctggagggcagaaacggatgccctggcaatgggcccagaagcaggttcacaccatattctatgggctactttgagtctctccacactcttccttctgcaggaaggaaaacgcatggcatctggggtgtcagccggctctctgttaactggctacagggctctggatgagactcccaaggtttcacttttttttttttttgagatggagtgttgcactctcacccaggctggagtgcagtggtgcgatcttggctcactgcaacctctgcctcccgggttcaagtgattctcctgtttcagcctcctgagtagctgggatgacaggtatctgtcactgcacctagctactttttgtatttttagtagagacggggtttcaccacgttggccaggctggtctcgaactcctgacctcaagttatccacccgcctcagtctcccaaagtgttgggattacaggcgtgagccactgtgcctggccccaaggttccactcttgcatgtcatgcgggtgtaaaaatgcgtcatctcaaatggttctgcctttgtgaacccctcagactttgccaggtttcctttccacctgggtgtctctccgccacttgtttgtgtctacctggattttagggtcacactgctcacaatttccctgggtttccctgttccaaggttgagatggagcagcggaacataacactgtctccgttggggtctaatgagtgaggcagccacacaggaacacgctcatggggtcacattttcatattacccccttggcttttgtccacgggcgatacaagaaacgatcccaaagagtgtttctgcatttacgagaaaccatttctgaagataccacacacgatgctagtcaatgttctttgtataatgatccacgccagaaaaaaaaaaatcccttttagaattaagtagaagggaaaagtcctttctggtcttgattgctaaaatgtttcccaagacagataagattgaaagactctgctgggttcccttttttccttggctgccgggatgctcagataagttgaatgctcaattaatgaggacctgatctggcctagatatttaggatgtttgttttcatctcctgatacactgcttctgatctttctattagtatctgaacagctaacttcagtttcttttcaccataaggttcctcaatcttttatgaaagtgggatttgcttcccgcaggcacagagattgtctacccacctgtcactgagaggataaaacgggacaggagatgtgaggcactgtgaagagttgcaagtggtgtacaaacacaaagcatggttattttgattcgggtgtctcttctcagtggggagagggcagggccacagcagaatatgattgaaaaatcggtaggtgctccggagagccttacctgaaggagctggccaaaaaggaagcttgctcgcgagagacgggggctgacccgggggtcgcttgttgaaagcgcttcttctggctgcagggtgttctgaaatgaatttatcaatcagtcaggccctgctgggcttggcaggaggggagaacacaatgatgctggtgagaactggagacctgtcctcaagcccctccatgctaacgctttcttagggaaatcaaaaggctgcaggcaaggggcgggggcaggcaggggcaggcggggtaggggagaggagtcctggagacttgggagagaggtgatttgcttcaacagagaccagggatggtagagcaaaggcctgcagtccagctggagccagaaacctaggctcatcttctttttttttgagacagagtctcgctctgtcaccaggctgcagttcagtggcatgatctctgctcactgcaacttccacctcccaggttcaagcgattctcctgcctcagcctcccgagaagctgggactacaggcgcaccaccaaacccagctaatttttgtatttttagtagagatggggtttcaccatgttggccaggatggtctcgatctcttgacctcatgatcctcccgcctctgcctcccaaggtgctgggatgacaggcgtcagccactgtgcccagccttgttcttgttttgagacagggtcttgctctgccgcccaggctggagtgcagtggcacgatcttggctcactgcaacctctgcctcccaggttcaagtgattcttctgtctcagcctcctgagtagctgagattataggcgcccaccaccatgcctggctaatttttgtgtttttagtagagacaaggtttcaccatgttggccaggctggtcttgaactcctgacctcaagtgatctgcccaccttggtctcccaaagtgctgggattacaggcgtgagccactgtgcccggccagacaccaaccccttgtcctggaaagtcaggacctgtgggagggcatgagaggatggggctccttctatagggagcgtctcattcctaaggaaccaaggaaccaagttccctagaattcatcatcccaatacggatggattgcatttgttactgcctctaaaaaagacccgggagttaggtttgaagctggcgagatccctgcccctgctgcccccacagggtgcttggcagacctacccggagtgcccgcagggtgtggtgggtgccgtctacctcctcccggctgcctcggtgcatcaggcgctgcagtttcaccaggaggagctgctgggctctggggagcgaagagaggagcctcagaggctgaaattcaggggccaagcaccgggaagccagcggggccgcagcaccgcactggcatgggtggggcgcgtgtccgactctgcgtagggatggccctgtggctggtgtgcgctctgagcccagggggcgcccggggagaagatgtggctccttgtatctgtgtttggatcccacctccagcactggcttgctgtgaggctgcagcaaagtggccgaacccctctgagccacggtctcctcctctgtaaatctggtgtgatgatgcttgccttcgaggactggcctgaggtgtggtgttatggtctcatagatgctgtggtatggatgtgtagtgttacagtcttacagatgcttccagatgcctgctgtgtgcccgacacactacctgtgctcagtccttgggggctagtgctgttataatgacaacgtcgttgtcgggatgaggtctatggaaaagaaatgactagtgaacccagcaagacagcatagaattgagtggtctggtcactaccagatggaaaaggattctacaggattctagtgaaggttgagagaaacatctctgaggaggcaggaagggcttcctggaggaggagggcctgggggacctcactgtgaaacagggaaagcagtggccttctttggcctgggcttctctataagcccctctgctgatgttcgtggcatccgcagcctcctgcctggtcctccatagactcagggaaatggaggccccgccctgattctggcctcaccggctgtagctgggtatggtgcccatatccaggtcatggtctgtgaaagggtcgacccgcgcgcacagccactcgtgcctgtcctggtacatggtgtcacggacgtgcacaacatcgtcacacttcagggacatggtgcaggcgtccagctggctggagatgttcaggttcagccggatgtagaacgagtcccccgatgtgatcaggccgtcctccatgtccttcaccagcttccggtaccctgcggagggaaagatgctccagctgtctatcagtatggggtcccccgaccatcagagctgctcctacagcagctttcctcaccaccaacgtgcctgtgcaatatgctgctcttagagctcatagccaggggaaagttctacctccccagtgaaggtagccatgttgtttaccagtttccctttttgtcttggctgccaggaagctcaaagctgaaatttttgccaagttgcagtgatcacctttactagcattcccgctacactcttcatatttccccaccattatacagcacttgtttgttttttatttttttcactgatgcacaactcgcatacagtaaactgcataaattcttaagtactcagttcaatgaatttccacaaatgtatatgtgtgggcagcaacaaccagaaccctctctgtcagtacctttcctaaggggaaccaccttcctaaccgatgttgctataaataggctgaatctcacttcatgtaagtggaaccaaacagtatatgttctcttcacttccagcttccacttttcaacattacgcctgtgagatttgtctgtgatgctgcaatgtagctggagggcgctctttttcactggtgtatagtactccatggtatgtggatgtatccattctcccatgtgcaatttgcattgtttgcagttttgggctattgtgaacaactctgctatgagttattcacacacactgctgtctgtggatatacgtgctcatttctcttgggtatatatacagaagtggaattacttggtcatagaatatctatctattcatctatctattatctttctacctattatctgtctatctatggatatgtgtgcccatttctcttgggtacatacacagaagtggaattacttggtcatagaatatctatctatctatctatcatctatctacttatccatccatcatccatctacgtatccattatcatctatctatctatcgtctatctatctatctatctatctatctatctatctatctatctaatcatctatctacttatccatccatcatctatgtatccattatctatcatctatctatctatctatctatctatctatctatctatctatctatcttctacctatcttctatctctgtatcttctatctatttatctatcttctacttctatctatcttctatctatctatctatctatctatctatctatctatctatctatctgcctatctatcttctatctatctttagaagatactgccaaatggtttcccaaagagaccatggcacatgtcgttttaaccttatttaaatgtcatcaacctcccaagtaaagttttgcaaatactttgtgagggagcggggcataaaccatgaatgcaacaaatgcagcaagctctgctatgatatcaaaccataatataaacccccacatcagccccacctgctgagggctgtataatactgcggaagctaaaatggttctaataaccagagtagcctgtcgaatgtccacgcccacattccagggccgtgccagccagctggattatctgatgaatgttcccaccactgtgcatggagaaacaagggttccctgtcaggtccgtccgggggatcttggccttgtccagcacatctcagaattctgcccatccacctggccaggggccactgtgatcgctatctgagttctctgcctcctgtgaaaacggaacctgcacacaggaccctgccggaatgaactttctttccctggaattccagacttgcagggctgtgctgctgcgcagctccgggctttggaggtgctgcccacatcatattctgcaggcccacggattttctgctgggctggaagatcagggtgcaccatcggagagaagcctgtcctgcatgtagggacagagcatcactattgtctttgcacgggcagggcactgccgggaaggagctcaagcaggcggctctggggagtggatagagagaaactggctatttattctctactgaaacattcatgagccctggcggttaaaaataagatccagctgcagagataatcatgtagaaaaacccagaggtgagaacaagaactcagacttgttcagagcggaaaacaaagctcagagctcacagcccaggagtcttggccgagaaggaggagatcccattcaaaggatgctgggggccccgtgaaaagggagggtgaggcccgcctgccccggagctgggggatcacagagcaagaatcctggggcccaggatgtggttcagtggtcttggtcctgggtagagaaatctctgggccccctggccagcagtgccacagaatatgatgtgagcagcgccccccagggttgggaagcagcacagccctgcagtctggaattccagggaaagaaagttcactccaacagggtcctctttgtaggttctgttctcataggaggcagagagctcaggtagccattgctatggcccccggcctggtgggtgagcaggcttctgagatacgctgaacaaagccaggaatcccccagcaggacctgacagggaacctctgtttctccatgcccagtccgtgggcagactgaccctagagctgctgcctacggacatcaggaatgggaagcccgagagaggaggaaacttccacttaccagggagagggctgagctgggccagccggggctccaacaggtgtgcctgaggctggggatgccgtgtccactgtgacccggcgggcagcccgagacacctgggcaggtgagtgcagacgtggccaaagagccagtgcaagacagcaaagccccgctcacggctgttgccgtccctgtgtgctctcccagacctgcccctgcacctcgtgatgctgccaggaagtgcccatgccttccactgaacagacgagcaagcagaggctctaggcggcgaggtcacttgtccaggtcagagactcgcctccctggccaagggtcgctccagacggtggagggaggtctcaccttcgtggttgaccttgtagtgcagcgtgacggggccgctgcacctctggatggtccagtgggcttcctctttggtgcatgtgtccaacgggacactctgcctctcgcctcggatgcagccttctagctggagagcagagacagcgtttgtctcctggccccacaggcagcagagctgcgggagcgagaccgctctctgtacattgggaaaaaaaccatctctccctgaacaaagactagctcagtgccaacagggggaaaaagcatcttgttcaggggggtgcacctgcctcctgcctgcaccctgggagcttgcaggatgcagaagcatgggcggggagctggggagagaagggcccaacaatgccgacggtctgaccaccttccagctccctcctcctgcccggggatccatggctgaatgcaaggcttaggggctcctaaatgtcaccactgacactacagttgcagccacctcccttgccgccatcccctcaccagcagcagctggtggccctcacggaggccggctttctcggccagagagccaggcttgaccgagtgcacgaagctccctcgcgcgttgccccccagcagggtgagctgggaggtgaggctgtcgccattcagcgtcgtgtgctgcaccgagggccctgggccccgcacgtgccccacagaggtgaccgaaggccggaagggtctgcagcaggaaacagaatgtcagttaggcagctgggctgaaaagagaaaagccctactgggacacaccgggggttggtggtgggcgccaggaccccggtggcatggcctcctgtggtcatcaggcgcctgggtgtcctggctccgagaaggcccttaatggctaagggaagtgagagctcacaagtggctcctgctgcgagaaatgcagatgaggagaggagctgaggcaccctctgtggccgcagcggccgtgctgggactggcaagggccatgttaggagggtccccttgagcgcggcccaccgggctccactgtgtcatggatggggactgctgggtatctgggtcccacttctttgcctctgccatgctgcatggccttgggcaagccccttcctctgtgggcctcggtttctgcacctggacacttgggaggtcagaggaagtgatttcttttttttgagacagggtcttgctccgtcgcccaggttggagtacagtggtgcaatcatagctcactgcaggctcaacctcctgggctcaagtgatccgcctgcctcagcctcctgagtagctgagactacaggtgtgtgccaccatgcctggctaatgtttaaattattttgtagagatggggtcttgcgtgttgcccaggctggtctggagctcctgggctcaagcagtcctcccgccttggcctcccaaagtcctgggattataggtgtgagcaatgcgcccagccaggaagtgatttctgactcgggaatgctacaattctggttctggctctaggagaacaaagcccacatgaatggtcccctttgtaagagagcgagggggcaaggggtctttatcccatccccaccctcaaccccggcttccccttcactggggtacctttccagagagaacttcctgaacatgaggttgacctgctccaggtcgtaggcatccaggccctcggattggtgggaggaggaggaggagtggatggaggagggtccgaaggagtagcgttcgtgactgtcatctgcagagggacgagggcccatcagtaccaggggtggcggggagctctggagacagccctgggacctgctgggctggtcccggcactgggggcaggctcggagccctccttccctactcttcccgggcagcctcccaggagatgggtctctgaggttccctggcacagatggctgagtcctgcattgaatgtctccaacacagatgttctccagcctccaggagcttcctcttagtgggaagctttatcaggtatctggtttttaagattttttttttttgagagagggtcttgttctgttgcccaggctgcagtgtgatggtgtaatcatagctcactgcagcttcaacctcctgggctcaagtgatcctcctgcctcagcctctggagtagctgggactacaggtgtgcaccaccatgtctggataattaaaaaaaaatttttttttatagagacggggtctcactatgctgtccaggctggtttttaatttctgggctcaagccatcctcctctcttggctttccaaggagctgggactacaggcatatgccaccatgcctggctaattaattatttttttgtagagacagggtcttgctatgtcacccctcctggcctccagtgatccaccagccttggcctctcagaacgctggtattacaggcgtgaggcaccgcggctggcttcattctgttcttgaattgggcccccacattttcattttgggaccctaaggcctcaccatcatccatcagcttcccggcccgcaggggcctgaagcagggcaggaagaggagggtctggccccgataggagcccctccctatcttctcaccccaggtggacccagaacacctggaggaaagacacccactgcccagagctctgggtggctgggatggagagaactacaaatctgctcggggctgataacaaaggcttctctgcaaatggaatttttcccgacactgcaaaatactttggacggttgcccgggattctctcccctttccaaaactctttcaattcttctcattacccagcctcgattaggggctaacctctctttaacacttggtagcgctgatgcttccccattaaggaggaccactcatctttcgtttcatcggttggcagccttagctggcaaaggctgggggagccctggaagagagggggctggcagggcacacctggaggactctgagccacagtctcccctgctgccagctctgtcggggccaggggatgctgccaccctccctcggtgctgagacaggcttgaaggtggtgatcctgcaagcccgccttcaccctccctacttctccccatcctgccttgcccctccaatgtcgacctgttcccctggccttgcccttccaatgtcggcctctctccccacagccttgcacctccaaggtcggcctctctccctggccttgccttccaatgtcggcctctctccccacagccttgcacctccaatgttggcctctcccttcagacttgtacctccaaggtcggcctctcttcctggccttgcccttccaatgttggcctctctccccacagccttgtacctccaaggtcggcctctctccctggccttgcccttccaatgctggcctctccccacagccttgcacctccaatgttggcctctccccacagtcttgcacctccaatgttggcctctccccacagccttgcacctccaatgttggcctctccccacagccttgcacctccaatgttggcctctccccacagtcttgcacctccaatgttggcctctcccctcagccttgcacctccaatttcggcctctccccctggccttgcccctccaatgtcggcctctccatctgcattctgtattccttttgcagaggctggttaacagctcaacacatgaatttcgcatgagaactccctgctcccagcccactctctgccctcctgttctttcctgtctctgaggctcctgtctttatctataaaatgagggtaacaatagcatttctgagagcggctgttgagattaaactggatcaggtatgcaggtcgagcccctccatggtgcctggctagagtatgtgagagctacgctttttaaaagcccagacctagctcgcaccctctgcacagcagccggatgggcccccattacctacaagacaaagaacaagctcacagggcatctctcagccatgggcaagcccaatgggggacagaggcttatcttttgtgttcaagagcgactctgagtccattccacatagtaggtcttaaggacctgtgaccctccacctgtgaccctctgtgacccgtcctacccaggaccctcccggatctgagaggcacgtaccatccagatctaaggcgtcaaacccgccgctgtcattgtcttcttcgactgtgctgcaagacacaagggaggtgggggaaagcatgcatgtgagtgtgtgtgtgtgtgcacacgcaggcaagggagagagaagcttctggaaggttccaggcttccgagtggccttgcttctgagagggcagtgtgggtggaggaggttgggacaaggaagggtggagtaggcaggaggctccctggaagggtgggtggcctggaggtcttggagattgcctcctccagcaggggaggaggaaagccagggcaggtgaacagaggccctgccggccccacctgctgttcacgtctctctcactcttctccgacatggtacaggacagagatccatctgccctgtgtgatgggtttgggagctgagcgcccttcagccggagtggacacagcaagcttgctgtgctctggagttctcaattgtctgcatgtggtttttgcaatagtgcttcaaggtgcaggtgctttcatgcagacgccacatgtggcttctgaaagctgctttcaacacctgcccccggctggccagagggtgcccccgcaacacagctgctggtggaggggctggtgtgggtctgatttttttttttttttaatttttgagatggagttttgctcctgtcacccaggctgaagtgcaatggtgcgatcttggctcactgcaacctctgcctcccgggttcaagcgattctcctgcctcagcctccccagtagctaggattacaggtgcatgccaccatgcccagctatttttattttttatttttttaatttttagtagagatggggttttgccatgttggccagtctggtcttgaactcctgacctcaggtgatccacccgcctcagcctcccaaagtgttgggattacaggcgtaagccactgtgcccggcctagtgcaggtctttgctgctgatctctggagccagccagggaaggccatgctaagaggcccaaacccaggccccagtgggaccgggggtgtggatccagcctccaaggccactgcttgctctctgcccttctggaaaccgcccaacaacctctgactttgtaggtgacgtgccaaaccctggcaggctggaaacacccgttgcccaggcatacttctactgtggttctctttgtgaggacactaatggtttttaggaagtaaggaaggtgggagaggagattggagaagccattcatgagtttcttttttttttttttttgagatggagtctcgctctgtcacccaggctggagtgcaggggcatgatctcggctcactgcaacctccacctgccggattcaagcgattctcctgcctcagcctcccgagtagctgggattacaggcacatgccaccacacccagctaattttttgtaattttaccagagatggggtttcaccatattggtcaggctggtctcgaactcctgacctcaggtgatccacccgcctcggcctcccaaagtgctgggattacaggtgtgagccaccatgcccagctgtgagtttcttattctttggcagaaaaagccaagccctggggctgtggggcccgggaacctgatttctgggcagcatggagccacgggtcataggttttgtccttggacaggcagctgggtgaacccagggaggccgcttccctcctctgagcctcagcctcctcatctgtacaatgagcagtaccctgcctttcagggttgcttcgaggacagctgggtcagcaagcgtggactggcccagagacggggtaaggaggcttggcatggtggcacggggcaaaagcccagtcctccctcacctgccacccacctgcgatggggcgcgtcctccttgtagcgtctgacgatggagtcgtttcccgggggctcggcggtgattgacatgatgctgctgcggctccgggggggctgcttcagacacagacacacacacgttacgggtgcataaatattacacacgcagggactcaattcaatgcaaaatcgtgcccgcctcctactcaggcggcatggaggcagcgagccggctatcagcggcgaccttggctggaggaggcttgtgctgagcccggagcggccgcagccgccgagcttgaagcacatctgctcgcacatctgctcacagggaggacgcaggcgggagccggccggctgggggactggggcgctgcctcgccatggtgcacaggctgagctcaaggcccccgggctgcacctgctgtgggcacctgctctaaacatggtgaacagtgtgggcctggggcgtggggagggcagtggtgccccggacggcacagctgctggagggcaacctttgaaaccaggcctgctggctcctggccagagccgctcttaataagagcctgggattctgccacccagggcagccatcagacaggaatcattcattatcaaatatctgcctcccccagggcctgattttggaagctgagctgacaagcttcccagggcttccccttggggttagaatctctaatcttgggccttctgctgcctgtcagggggtgggcagtgctggatgcagtggctgggaccctgcccggctctgcccgggtaggggttctgggctggggatggggccccaagcctcagctctgcggcggctccagctgctcacagctccctgccctgcctgccgcccgttccccaggctgcgggagttgccaggggctgagaagttgcggcagaattttcacggcctgtgccatgcgcgacagcccctgggaggcccagctcctcctcccaccaagtgttaaattgggaaaggaggcggcaagaaggtgtaaatacattgcgaggctgtggaaacctctctaaataaacataagggaggctggggctgcagcccagagcaggcagcagcgctgctcagaggctgggtcttggggaggaaggcgaggtgggtcagggctggtggggtggatgaggctggggccccgggacggtgctctgcagcaggagagggtgttgggggatgagctggtgccccggatggcactctggagggagagagggtggtggggataagctgggtccctggatggcattctgcagggggagagggtggtggggatgagctctggagggagagtgggtggtgggcatgaactggggtcccagacactcttctgcagggggagacaatggaggggacctgcagatcgggcagaggctgcagctcaccatcttggtgaaggagttggtgatgggcagagatccgcaggagctagggctggcgtccgtgccttcttcctcgtgccccttggctgtcctcacgggagacgagatgggagagacagagaaaggagaagggggccggggagggtttgaggtggaagagagagaggggaggaagagaaaaggtggggaaagggaagtcagagcctcatggcccataggcacatggggctctctggcatcatccccaacctccttctaacgaggtgggtctggggcctcttctctcccttgagggctcactccactctctgtggcatctgctggagaaagagccctcaaaaacctcctcttgctttttatcaaattttttatagagatggtgtcttgctatgctgcccaggctggtcttgaactcccggcctcaagcaattctcctgccttggcctcccaaagcgctggtatcacaggcataaaaccatctcttcttttcctgtctccccccaccacagtaggctcctggcggggagggggtggtgggtctcatttgccaacatatcgcagctcccagcgagggtcaccccctgggcagcctgggtcaaagctggacaacgccatgtgtctctgaggactggtgtggggtccccggctggcattttctgtgaacaatggacaaccggggcatgagtcttcctgtccaattctctgccatcaacatggactctgcctctccccgacaagcagggctggctgatggggatgaggacaaactgggggccaagtccgtcacctcctcagtgaagcctcccttgatgtccctgccccaacccctggctctgtggtgggttgcctggggaccatgtgcacatcctctcagccctcctaagacggctttgctctctgtgtcccctccttgctcccacccttgctgtgtgtgcccgtgttgtgtgcacagagagatatacgtacatgcacccccatcagtggatgccttgtggggaggaaccatatgctgtccttccctgggcccccagcacctggcactgggcagcctattaaggtctgatgaggagccccatggccactgcatcctgtcccttccctgtgatgcaacccccttctctgcttcctgcaggccccaggccctttgcacctcccttctgatacagaaggccactgagacaccggatgtggccgtgagggagctggacggggccccccgccctggcctccctctgctgccctccgtgtccagagagaacggccttaagcacaggtctgcactcttcactctcctgcccaccccaaagccacctgggggaggcttcatccttgccatgcaggatgaagtccatatcttcagtgaggcgcccacagtctcagcccagtgctctcctgctttacgctctggggtggcagggcggcttctgcctgtgcacctcctggtctccacacctctgtttatgggcccctctctgagctgaggagtacttctggacactgtgtccctccaccaaaaggctcccttttccagccccagtttaaatgtccaccccgcccccacatttttctttctttcttttttttgagacagcgtctcactgtgtcacccaggctggagtgcagtggtgccatcttggctcactgcaacctctgcctcctgggctcaagtgattctcctgcctcagcctcccgggctcaagtgattctcctgcctcagcctcccaagtagctgggattacaggcatctgccaccacgcccggctaatttttgtatttttagtagagacagggtttcaccatgttgaccaggctggtctcaaactcctgacctcaggtgatctgcccgccttggcctcccagagtgctgggattataggtgtgagccaccccacccggccaaatgtgcccttcttgatggatccttctctgacctttgtccagccactctcaggacccatgcactttccacctcctggctgtggccctgcctgagtgtgtggggtctatggacatctacttgggccttccagcacctggcacatagtaggtgcttgatttgcttaggcaaacccttctagccgatctgtcactcccagagacatggtgaggacaaaagagaagattctgaaggcagtgtgtctcggagaaccagggactgacgaatgaaccagcctcctgtgaagtcctgtgggggaacacccggccaaaagtcttggaagagggtcaaagagtcctttcgctgagaagccacgggcaaaacgcacagttcagctaacgcaccagggattccggacagacccaccgggagaggcggggaagcgtggagggaaccacagaggggacctttcagcagttgggctcctgcctgctttgaatgacgatgaacattaattgctatttggatggacccccaccactccgagacccccgagaacccgccacgtttaccacgcaggattgttcgttacagtgggagaaacagatggaccgagagagacagagtgacagatgagacaggccaagagagatttgggcgtctcactaaccttgaaaatctgatgttcgcttcaggctgatgggggatttggctctctgcagctaaaagggaggggaggggaagaaacaagacacaagacacaaatcaaacagggacctagacacatgtcactggggcttagaaaaaaatagagagaggccagccatcgtgtccctcgtcatacggccaccaggttcagcccggaacgcacacggaccgatgctcatctcccgcggccgggacgacaagacacagcggctcccctgggcttgaatcaggcagctgctggtatagacaagctctcctcccagggcggccgtgtaatatggctcatggcagaagacaggacaggagccaagagcggcagaggggaccaagtgatgtgcggggagtgtgaagctgagcagagctgggtacatgacacagagcaggtttcagaagagggtgaggctgccaggcaggtgccctggccacccccggcccggagtgctaatggggtctcagtcagctcagatgtgctgcctcaggccttctggcttggcgtgtggaaggctgggagaggcagaggcattgtcaggccctgctgtggcatctcattcattcactcattccctccccatcgagagccagccgtgggcttcgggttgcccgagattctgaacacagtgacaggattactgctaactccagctcctgggatggtgcctgacatgtgacgggcatgtgattggcactcagtacatatactcaatacatatgtgatgaataaacaaatgaattggttttttttttttttttttttttttgagacagagtcttgctttattgcccaggctggagtgcagtggtgcgatctcggctgactgcaacctccgccctactgggttcaagtgattctcctgcctcagcctcctgagtagctgggactacaggtatccaccaacacgcccggctaatttttgtatttttagtagagatgggatttcgccatgttggccaggctgctcccgaactcctgacctcaggtgatccgtccacctcagcttcccaaagtgctgggattacaggcgtgagcgactgcaccaagactgaatttggaaatgatgctcatttcattctctttccctccttccatctttctttctttctttctttctttctttctttctttctttctttctttctttctttctttctttttctttcttccctccttccatctttctctttttctttctttctttcttttctttctttctctctctttctttccttccttccttctttctttcttttctttttcttttctttcctttctttctttctctttctttcgtttctgtttctttcctttctctctctctctcttattattgagacagggtcttgctctctcacccaggctggagtatagtagtgcgatcatagctcacagcagcctccaactcctgggctcaagtgatcctcctgcctcagcttcctgagtagctgggactacaggtatgtaccacaatgcctggctgttttttttcttttcttttcttttcttttttttgagacacttgatcttcctatgttgcccaggctggtctggaactcctgacctcaagtgatcctcccgcattggcctcccaaagtgctggggttacaggcgtgagctaccatgcccagcctgtctttctttctctctcttttaatgtctattacatttataagagtgaggaaatcagtaaaaatgtacaaatgagtaagaagcgagtcgcaggatttccagcttacagggttgaaatagggtgagtcacagtctgggcacccaagacccacccagaagcaggcgtggctgtgctgccccatcgccgcctgcaggggcccccggctcacagaccctctgccctgcacctgcgccccctccctccacacccatgcacctggatgcccttcaggttcatcctgcgctggggcggatggtagggcaggaagtacttgctgtcttcaggtgactcctccgaggtggaagaatcgtcagcttcttgaccattggtcctggggctggcatccccaaagtcctgagagatgatggttactggcaggttcctgggcagactctggggacagagaaaaagctggcgttagtggtggggcttggcgatgcgccaccagtgggcaagatggctgggctgatggcatcatcattccctcggccacccgaacatgaagctcactttggccattcttctttcctgaccccaaccgtaaccccagacactgagcccccatcagtccagcctaatgatgcatcctcctcccaggcttctggtccagtctcccaaacaagccccggtcttcttgtacaatggtaaaggcattgcctcctaactggcctcagccccttccatctcatctgccaccatgaaatttccaatttctagccctgtgcctgagctaaaaatataaaaaatattcagaatgactgaatgatgttaaaaaaaaaacacacacacacagtcctaggtactgtcttgtctggagcgcttcatagctgtcacctcattgaatccttcctgacaagtagaggttgttgttgataattgctttttacaaaataggaagcggagtgctgtagcatgaaggaactacgtggcccacaaagccacatggcacccgcatgctgcgctgcctccagactcaaagcgtcttgttccactccctgtgcaaaatcttccaggggctcaaaacagcagtagagctcctgggtgtgcacagcccaccttggcgtgccccgttaaccccctgctgctccttgactcccactctgcagacggatggaagcgccggtcatgccctgctgacagcacagtgggctaatgccaggcctgtgttcacgctgtaactgcagccgggagcacgggtcctcccaaagtgctgggattacaggcctgagccaccgcgcctggtcagggtcccttcctttgtaaatgaggacactgagcatgctttccatgcaggacagttccgtggggtaaatgaggtaatgcacagagggcacattgcgtggcacctgcacgtgacagcactcggtaaacccagagctataatagtggtaacatttaccctggaggaggcattccttcatttctcagtgcctggagccctgctgggaaatgcactctgcaattcacatagtccataaatgagggtttactcacaagcactaggaaccgtaacgaccacagggtgtcttaaacccagtgacggttcaggtgtgcgggggaaccccagtgggaggccagcagctggctgtggtcactgagagggcactgaggctcctaaggcagaggctgcccagcaaggaagtggccaggtcaagcttgccttttttttttttgagatggagtcttgctctgtcaccaggctggagtgcagtggcgtgatctcggctcactgcaacctccgcctcctgggctcaagcgattctcctgcctcagcctcccgagtagctgggactatgggcacgcaccaccacgcctggctaatttttttgtatttttagtagagacagggtttcaccatgctggtcaggctggtcttgaactcctgacctcgtgatccacctgcctcgacatcccaaagtgctgagattacaggcgtgaaccctcgcacctggcgccctgcatcttcttatttatgtttttaattttaattttttaaatttttaaaaattttcgctctgttgcccagactggtcttgaactcctgccctaaagcgatcctcccacctcagcctcccaaaatgctgagattacaggcatgagccactgtgcccagccctaccctgcatcttctaacttcaaaatgagtggcttccactcatcactaaacagacacaaacacaacagtaaaagatgtggattatgctgggcgtgggagggaacttccggcttcaaatatatgaagagccaaccgggcacagtggcaaacggctgtaattccagctctttgggaggctgaggcgggaggatcgcttgaggataggagtttaagaccagcctgggaaacagtgagacctcgtctgtacaaaaaaattacaaaattagtcaggaattgtggtgtgtgcctttagttccgctacccaggaggctgaagtgggaggactgcttgagcccaggagtttgaggctgcagtgagctgtgatagtgccactgcattccagcctgggcgacagagtgagaccctgtctcaaaagcaaaacaaaactaaacaaaggacaaggagccattcattgcacagggaagcggcgactggtcacagccctcagtgggtgccagggggcacctggcttctggtttggggccccacagggaggtggcgactggtcacagccctcagtgggtgccagggggcacctggcttcaggtgtgggtctccacggggaggtggggactggccacagccctcagtgggcaccagggcccacctggcttcaggcgtggggtcctgcccgtcccgccccacctggtccaggttgttgctgtccttggagaggcgccgcagcttgctctccaggttgacgatgcaggcctcccgccgcaccatctcgatcctcatctcgtcgttcttctcctccagctcgcggatctgcttcctgtacttgtccttttcgattaagcactgcgagtactgtgtctgagcttcatctcgggagtggaaggcctgccagggagaagcgggacgaaggctgctttgggggttgcaccccagccaaatccagctgggcccagggacaggcatcatcccaacccaggggccagccacatcgtctgtggctctcgtctgcagtctgacccctgggcgtgtcagtcactaccttcttcattaacgcgatcacagagccgatggtccgacccttgctagtggcaggctctgtgttgagagctttgatgcagtgtccctggaaggccacagcctgtccctatgaggcggtgctaccgtaattatccccattttacagatgagggcactgaggtcaggggtggcagcttgcctatgggcatacaccttatgaatgacagggctggatctgaacccatcctctcacccgagagaacacacaacatttaagaaccatgcttggtcgtgggagctgctggagcccagctcggatccccctgctacccaaacgcctgtgacttccaaaaaagccttttggaattcatcttttagaattcatctttggaacagaaatgggaaagatggattcaggagtgatccctgcattgtcagtgatgttgcactggacaaaacactctgaaggagccggtggtctggggtgcgggccccgctgtgcagcctcgccgccctgcacgctgcaggtggtgcctgtacctggtcccgctcccgctccacctcctccagctgcagcatgaccgtgttcatgcggtgcttgtacatttcacagtcctttcccagggtcgagcacttgagctccaggtcctccttctcctccaggtactgtgaaccacacagagaaatcaatatgcgcatcgagcaatcaataggtcaggactgaaagctgttctctgctcgtgccttcccgccagctggctggagctggcctgtccctccctaagctggcatggtcaggacatggcctgcccttctgggaaccgactatctgactgttggggctcaaggtaggagaccaatcaacccagcattgttgtgaacccactacagaccaggtaacataggggaggacaatgtgatctcagtcaggagggggacacaggtgctaagctggtgcaatagcttgtacatgcccaagggtggccggcacatctgggatcctgcaatccgcaaggtgtgggtgaggctctgagactcacaccttggcaggtatgtgggttcccccaatcccaagccctcaccctcccctctgcccacattgctcccacccccaggccctcatctggttgataaactgcagcttctgccaggggctgaatactgggaggtacaggggatttatgccaggggtctgatctagtccctggaaaggagtgtggggtcagggaggtcctgctgacacacaccactgccccctggtgtgaagggggccggccgagggcaccgctgggcgggcgatccccactcccaccttgtctcgcagctcctctgcctggcgggcctcctcctgcaggttgtagatcctgttgaccagctcctgcctgtcctccagggcctccttgcggtcgtgttccaagatgtccaggatggccttgtctgagtctggcaggctgcgcttcccggcctgggtgggagggaggaggtttcagagggtcagggtcggggtggggagccaggtggtcctggagggcaggggacagaagaaccagcaacagatacggacagagcagaaggttttgtgcctggaaggtagaggcaagaagagatgtatgtcccctggggtctctaagaagcttagcatttaagaagtttattgcctggaaagaagcagaaaactggcttttgcttgggcgtatcctgggccttttgttctccctggcgcttatcggagcgcagagaagcagttgctgcacccgaaacactttttagatgctgcccctgaaatatcaaggaatctgttctggagaagctgggttcatcctcggctctgaaacagagcctcatataccaggcagccactcctggggggactgttctggagggagcaggaggatgcatgttttttttcttgccctgtagatatgttttgggatgtcactcctcagcaacttcctcctctgtgcccacaagtgactcggcgatgacaagtgtggggaggcatttgaggttggaacaagaggcacggagcttacagttgagtttcttggaatctttaagggcacgtaggtttcctagatgtccttgtctcttcccacagtgcccagggcattgatttccacgtggttggtgattttcctggagtgcttcaaataagcacatgttttcccaagtatgatatcctatctctgacaaatgggtggtgggggtcaccgctttacagaggaggagacaaaggtgcccaaggatggcacgcatgcctgtgatcctgcagtcagcatgggtgaggcttggggactcacaccctggcaggttcatcgtttcccccaaccccaagccctcaccctcccactgcccgcgctggccccgcccccaggccctcacctggatgatggactgcagctcctggtttttggtcttcagcatttcattctcccgctccagttccagaacctgctccttcttgggccgattttcaatgtcattcttcagttttagagactgatttctctccagcttacattcctcctccatcttattcaaccggtgctttagctgatcgatctgaaataccccaagggtgcccaggggagaaggcaggtggcaagaaacactcagaaaaggcaacgcttcccccgatcccactgggctggcagcataacctgagttatgcccctctctccttcttccacgggcagagaagggctccaagaaaccttctccagtaaaacaaactgtcatcaccctgttgatggagagttcctgattagtctatttagaatagctccaaaggggctacaggcctcagagaaaattccctcaacctttgtcaggtgggacaggttatggattttgggataaaagagatccaagttggtgtttcccacttcaacgcccttctctgatgggtttcaaattctgatcctcggaactcaaggattcccctgaggaatccaggggttacccagggggaaggaggagatggttgacaagttggggttctgggcatccacactgacttcacatcccagaacagctctgcttgtgtggtttgttcttctgggtttcacacaagattttatttggataaatagcactgttgctaaaaaggaagaggaagaggaggaggaagaggaaaaagaagaaaaaacaggagaaggaggagaagaagaaaagtagaggaagaagaagaggaaggggaagaagagaaaagagaagaagaggaagagaaagaagaagaggaagaggaggaatgagaaggagaaggagaggaggaggaagaagaggaaaaagaggaagaagaggagggggagaagaaggaagaggaggaggagaggaggaggaggaaggaggagaggaagaggaagagaaaggggaagaaggagaaggagaagaagaaagaagaagaaggaagaggaggaggagaagaaagaagaataataggaagaaggaggagaagaaggaggaggaggagaggaagaggaggaggaggagaaggagaaggaaaaggagaaggagaagaagacagcctgaaattcactgaattgtaatttcacaggatctccaccctaaagaacctccctagacttagtggcagaaagagtagcttcctggaggaggcagctattgcatctggaaatgagacaagtggagatgtgctgattttcacactcaagagtttagtgtcaggaactgggaccagcagaagacttcttcaacctgtgagactaacctgtgttcctccccaaacacatcggctttgctaaagtatcccaaacaagaaggttgcattcgagggctataaagaaaggaggcaccaaaggggagagtgtcatttttcaaatctagtcttggaaggagaatcatctcaaggaatctggcaggtagagagcagtggctttagcaagaaaagaccagctcctgcaccccagtgattaacctgagacgatgaagaaaggggcgtgcaggaagcagcccgaggccaagaaaaccagccagggactctgctggccagatgttcttccaaattctacttacactttctcactattaatgtatctccagggaaacataacacaggaggaagttccgggagagaaacttgtaagtctctgccacagggtaacttccccaaatcctaggtaaaaacagcatagaaatctctcctgctcatgcaaaaaaaaaaaaaaaaaaaaaaagctcctcagcatcttcaaagcttaacccaagtgtcctgtggtaagtcccgggtcccacacgagcaggcatggggcgctagcattgtggggtgcttacagggtcagccgctccgccaaagacctacggttcagtatcccagcaatcctagggcacacgtattactttcattattgacatctgcaaatgaggaaactgaggccaatagctaagtaagtcgtaaagcataaagccagaatttgaactcaaagctacaggacttacaaagctcatgcttctaaccaaaacactattgcctgctatgccactgactcaattcacctgaattcccggtggattgtttacggatctgtctgcttcactaaattgtaagtgacctgagcacagctcacgttatttatccccatgtctcccacagtgcttagcacagtgcctcacacgtggcaggtgcttaataaatattctgtgagtctattttccatccagcagccagagtgatccttctcagacataaatcaattgtcactcttcagctctcaatccttcagagggttctcatcacaactagaataaatcccaaagttcttaccatgcccccatgatctggaccccgccatcccttccactcccttctgcaccatttgtttatttggctctggccccactgactctcctgccatttcttttctctttcatttgtttctcttccttccttccttcctccctccctcttcctccctccctccctccctcttccttcctccctcttccttccttcctccctccctccccttccttactccctccctcttccttccttcctccctcccttcctccctttccttccttcctcccttcctttcttccttccttccttccctccctcccttcctgtctttttccttcctttttctttctctttctctctctctcccttccttccttccttccttccttctagttctttcttttgacaggcatggctcactgcagcctcgacctcccaggctcaggtaatcgtcctgccttatcacccctagtagctgggactacaggtgcataccaccatgcctggcttatttttgtagagatggggttttgccatgttgcccatgctggtctcaaactcctggactgaagcaatcctcccgccttggcctccccaaatgctgggattacaggtgtgggccatcaagctcagccttcctgctgtttcttcaaaaacaaaaacaaaaacaaaaacaaaatgccccctacttatgggctttgcgagtgctttcccctgagacttgcatggttggctcctttcatcccttcagatctctcttcatgtgtctccttctcagagacctttcctggacaccctagttaaagtagcaatcctcatgttctgtcctcacgccctgtcttctcttcttgatagcactcatttctaccaagtatctatgcatttgttttctgattacaatgttagttccacgacagaagggttttagtcttcagctatgtatccctggaaaagagcctgggggccaggtgtggtggcttatacctgtaatcccagcactttgggaggccaagtgtgcagattgcccgagcccaggagttcaagaccagcctgggcaacatggtgaaaccctgtctttactaaaaatagaaaaaggggggtgggtaggataaaaatagaaaaaaattagctggcatagcatgtacctgtagtcccagctacttgggaggctaaggtgggaggatcacctgagcctgcaaggccaaagctacagtgagctgtgatcacaccactgcactccagcctgggtgacagagtgagactctgtccaaaaaactcctccaaaaaacccaaaaacaaaaagcctggtacccgatggaactcaataaacagaaagaatgaacgaggccgggtgcagtggctcatacctgtaatcccaccactttgtaaggccaagggaggcagatcacttgagcccaggagttgcagatcagcctgggcaaaatagcgagaccccttttctacaaaaaaattgaaagaatagcctggcgtgatggtgggcacctgtagtcccagctactttggaggctgagacaggaggatcacttgagtctaggaggtcaaggcttcagtgagccatgatcacaccactgcagcctgggcagtggaagaccctgtctcaaaaaaaaaaaaaaaaaaaaaaaaaaaaaagaaaagaaaaagaaagaaagaaaagaaggaaaggaaaataaaagaaaagaaaaaagaagatgtaaatctccttaattcatttgcggagtgagccattctgggtctgcatgcgcatgtgcaaggtggatctgggactgagccggtggtggaaagctgcgcactgggtcggtccttgtgcgcatgtctgcccatgcgcacaggggatgtaggccgcttacccggtagcgctaagcactatgggtacacgtgcaggtgcatagtggacctagaactcccagaggccctgtgtcctccattcccccacacctggctggcaggaagctccggcagaccacgtgcatgtgcctgcacctgctttatgggagaattgagccctggtgacatttgtttcccccgggtcaccctggcggagtagcccttgggcacccctcacctcgagttggaggtctcggctcctcatgaccgccatgttcttctcctcactgagctgtgcgtagcgcatggctaagttgtagttgtcgtccttcaccttgaccagctcgtcattgtagctgtcccgctcttccttcatcttgtagtaccgctcctggaaggttagcagctccacgcgcgtcagcgtcatctgcttcttctcatcctccagctgccgcaacctggccagcagctcgcagcgttgcaggtccttggccttcatctgctgctgcagcttgatgacctcgttcatcaggaagtgcgtgaggccctcgtggccttcctccactgtggagagggggcacccagtcaggcctgaggactgggaagtggaaaaaggaggttccagacgcagggcaggtgccattcattcactcactcaccaacgttgtgccaagctctttactcactctgcccacgaggcactggggattcagagtgagcgagactcacagccttggccccgggagagcttagggtgtaataagagaaacacatttaaaaaaatcaaatgataccacaaatagaattacagaccgtgaggatttcacaaagtaaaggtagatggggctatgagagtgtgtagcaggggcccagatccagccttgtgggcagagggggttggagaaggctcctgatggttgaggtaaaatgttaagttcgggtgggaaaaggcattctaggaaaggggaacaacattgccaaggccatatggggaggagggaggaacttggcatatttcaggaactgaacgaagaccaaagtggccgaaggagagagagagaagagaaaggcgaggctggtggtgtcagcagggactggatcatgaagggtccttgtgggctgcattaaagacctgggactttttttatattttaaaacagggtctcgctctattacccaggctggagtgcaggggcatgatcatagcttattgcagcctggaactcctgggctcaagcaattctatggctgcagcctccaaaagtgttggaatttcaggcatgagccactgtgcctggccaagacctgggtctttacaaagaagcaatgaaaaaccaccaaagggttttaaataggggaggaagaatggagaaagcactggaacagatcgggaatggatatggagagttaatggggttgtgggagtctggactgtgggaagtgttggggcgggcgagaagactgattcaagaatgtttagaaaggaagattaagaaggcaagatgctcaagggctctggcccatgagacactagaaagaatgcaggcaaggcaaggacaagatctacggggtagaatgaacttgtgttccacctggcgccattcatgggggatggtccgtgaacacccacttctcttggttcctgcttccctttgcccctgttaacctttcatcatcaagcaaaataagtggttgacagaccccagttctatatgtcatagattcacagcttaagaaccatgccactactgaggacacacacacacacacacacacacacagacacacacacacacacgcccctcctcttagagtccagatgttcccaatggcaaaagcacttacccacaatggtggagaatctccgagtgggctctttcccagtcaccagtttgtacagttctgggtaataaaattctaggctctccaagaagaccacatagcccctttgccccttggtatgtagaatgtccaacagccggcctaggggaaagaccagatcactctgtgagaatacatatctgatggaacgcaagtctctgtggctggtctcatcctggacttgtgtccttcaatcaactctaagaagacagtctccccacattctatcacttctgagttgtatcttggagcccagatgacgtaaatcaaggtgccaggccctccgcagggatttggtgagcgttagttttctgtttctaataaactggtagaaccaggataaatggaattgccgccccagttttgaagagtttcccaactgaccagggccaaaatgaaccacgtaggcaccaggtcttctatgactgaaggaggttggaagcacgataaaaattatggaataatatatggttctctgggattgagagcaggaagacaaatctttgggtgagaggctaggaaaaatcataggaagtagggatagttctaggtttttctttgggattattacacaacctggaaacaccttaaatgtaatttccccagcaggtcccagtttctatactattgattccacttattgcttacatttctgggcccttccttaaacattttattttcagatattcttctgagatatagaagaagaaaggtaggtcttaaaactcgaccttttccctaggacggacagaagaaataaatttgatggtatgtcaaccccgattgtttggtgaagccgcctgcagtactgtttcgagaaacattccaaagttacatccaagctcagtgggaaagcatgctgattactgatgtctgccatggatgccagagagtcgcagctgatgagccacttaccaccagccacgctgggggacagtgattatcaaaccttctaaactgatccatagaaagaaaaacatttaacattgtggtctagtgaccatagacaaagataactctacaagtacatgtgtatacacatgtacataatgtaaaattaaaacaagcttcacaaaccatatttattacctttactgaatatgataaaccccccctccagaagtcaggctagaaaagcttgtggaacccttctcggaatatttttaaacagataaagtacatcagattacaaaagaaaccaattataataaaatccagttatcaaatattaaataaatttgtgtttcagtaacatacttctttattaatgcattaaataacaagacctctcggcaggtctaataagtactgtaattttgaaagagagatgagtgtaagtggcattttgagagatttgcagtaactgtagtgataggaagagatctgtaattttcattgttgcctaagtcacaagaattactaatcactcctgtaatttgtggcttcctgacatttgcaattgagggcaatgctgaattgcagttgaggttggtaaaataaagatggcatttcttcccccctcccagtttatggatcctttgagttccatacacagacagcttgagttctatacacaaatgagtaggtgatggactgcggaccccagtttaaaaatccctgacctagagcaacttcattttggtacagctaccaaagggtatgtctggaagttgccgtgtgcggtagccctccctctcccgcaaagaggtcctaaggttacctgctcggttgatcttggatggcagcataggggcattaagcacttcatcttcatcctgctcatcaatgaccttacactgacgcaggtagggcgtgagcttggcagggttgatatagcggctgagcatgtgccggttacactccacattctcccacaaggcgtcctcttcatccttcagcgtctccatgtagtcatccatctctggccctcctccttttagacataaaccccaacaagcttaataaagcagtctcactggaacagctctatcaactcctctggagtgacctctagaatatattaagttaaaaaaaagtcctgtacactaaagtatatatagcattttaccttttgtctaagaaaggggttatgaatataaaaatatatatttccttatatgctaaacataaacaatggaagtttaagccatcaattttaaaaaagattatttatagggcagagagggaaaatcctgcggttgagtctaccctttccatccaagtttttatgtcttactaaaaatgtatagttccctaaacaatatatactattggcttttgttttaaaatttcacataaatggtgtcatactgtacgtttcctttttcagcatgtttttctccctctacatttttttttgagatttatctagatggatacatatagatctaagtcattcgtttttaaaaatagctttattgtgatgtaattcacatagcatacaagttacctttttaatatgttcaattcaatgattttagtatattcacagagctgtgcaaccaccaccacaatcaatttaaaatcatttccgtcatttcaaaaagaagctcctcaccctttattagccactctcaatttccctctaatccctgctcctccagccctgtgtaaccactcgttcaccttctgtctgtatagatttgtcttttccgtacattttatacaagtgaaatcctacaatttatggtctttcatgtctggcttctttcactcagcaacttttcaaggtttgttcctgttgtagcatgtatcaggacttcacttattttaaattgctcagtgattttttcattgcatggacatgccccattttgcttgtctgttcatccactaatggacatttgagttatttctaccttttgtctattatgaacaatgctgctatgaacattcatgtaaaagtttttgtgtgactgtatgtttttatttcccttgggtagatacgtaagagtggattgttaggccatatggcaactctatatttaacattttgaggaattgccaaattgttttccaaagcagctgcatcattttacattgccaccaacaagccatgagggttttaattcctccatattcttgctaacaacttgttattgtctgtcttttttattacagctctcctactgagtgtgaagtagcatctcattgtggttttgatttgcatttccctaatgactaacgatgttgagcatcttttcatgtgcatattggccatttgtgtgcattgagaaatgtctattcaaatcctttgcccattttaaaattgtgttgtttgtctttttattattgggttgtaggattttgttatgtattctggatgcaagccacttatcagatatatgacttgcaaatattttctcccactctgtcagttgtcttttcactttcttaaaagcattgtttgtagcacaaaagtttcaaattttgaggtagtccaatttatttattttttctttttttcacttgtgctcttggcatgtatccgaaacaccattgtctaactcaagatgatgaagacttactcctgttttttgcctttgaatattataccttagttcttacattgaggatgatccattttgagttaatttttgtgtatggtgtgaggtaggggtccagttgcattcttttatgtgtggatgtccagttgtccaagcacagtttgtttgaaaagactactctttccccattgaatgatcttgctacccttgttgacaatcaactgaccataaaagtaaacatttgtttttgcactattgattctattccattgatctatatgtgtatccttatgccagtactacattgtcttgattaccgaagatttgtagatttgtagtaggccttgaaattgggagtatgggtctcccaaccttgttctttttcaagattgttttggctattaggtgccttttacctaattttaggattaggatgtcaatttctgcaaaaaaggcagttggcattttggtagtgaatctgctgaatatgtagatcaatttggagagtactgctacctaacaatattaaatcttctgatctatgaacagggggatgtctttctttaaatcttctttaatttctttcagcaatgtttcatagttctcagtgtacaagtcttgcacttcttttgttaaatatattcctaagtatttcattaatttgatgacattataaatgggagtttttttcttaatttcatttgtgggatattcattgctggtctatagatatataatttatttttgtatattgaccttgtattctgcaaccttgtgaaatcatttattagttctgttagtttgttagagacatcttatgatagcctatatataagatcatgtcatttgcagataaaggtagttttacttctgtttttccaatctgggtgccttttatttctcttctttgcctaattgctctggctaaaatacctccagtacaatgttagatagaaatgttaacagcaggaatccttgctttgttactgatgttagcggacagcatccaatctttcactgtcaagtatgacattagctgtaggcttttgcttttgtttttaagatagatgtcctttatcaggttgaggaagttttcttaccttcttggtttattgaatgtttttatcctgaaagggttgtcgattttgtcagatgctttttctgcatttattgaggctgccatgtggtttttgttttttattgtattgatagggttacactacctgactttcagatgttaaaccaaccttgtattcctggcataaatcccacacagtcagggtgtataattctttttatatgttgctttttatatgttgctggatttaacttgttttttaaaataggatttttgcattcatattcataagagatattggtctgtagttttcttttcctgtgatgtcattgtctggttttgatattggcctcagaatgatttaggaagtgtttcttcctcttctgctttttggaagaggcttttaagaattgatattaatttttcttttgtttggtagaacttacaagtaaagacatctgggcatgggtttttctttgtggattatttttacaaattcagcctccttacttattacaggtctgttcatattttctgtttgtcttgagccagtttcagtagtttgtgtctttctaggaatttgtccattatatctaagttatctaatttattggcagcaattgctcacagttcccttcataattctttttatctctataagttcagttataatttcccccctttcatttctgattctagtaatttgcatcttctctcttattttgtcgatatatcaaagaaccaacttttggtttcattaattctctgtattccttttctattctcaggttcatttgcttctgccctagtcctgattatttcctttcttttccttgctttaggtttagttagctcttctttttctacttttgcaagggaggaggtaaaactgcctttgcaaaagttataacagaaaattctgacagtgaaagagatctgacctaaccaattccatcttgcttctaacctccaagcagtcctcgttcattcctgggcagaggccaaactaactttgggaggaacttagttcatagattaatgtattattctgctgctgtcagatggagtggactacagatgtctgttaggtctagttttttttttttttttttttttttttttttttttgataaagagcctccctctgtcaccaaggctggagtgcagtggtgcaatcttggcttactccaacttctgcttcctgggttccagccagcatgtctggctaatttttgtatttttagtagagacagggttttgccatgttggccaggctggtctcgaattcctgacctcaagtgatccacctgctttggcctcccaaaatgctgggattacaggtgtaagccaccacgcccagccaggtctggtttgtttatagtgttgtacaagtttcttatttgttgatcttctgcctagttgttctatccattattcaaagtaaagtaataacgtcttcaactcttttttttgagacagaatctcactctgttgcccaggctggagtgcaatggcgtgatctcagttcaccgcaacctctgcctgccgggttcaagtgattctcctgcctcagcctcctgagtagctgggattacaggcacctgtcaccatgcttggctaattttgtatttttagtagagacggggtttctccatgttggccaggctggtctcgaactcctgacctcaggtgatctgcctgcctcggcctcccaaagtgctgggactacaggcatgagccactgcgcctggccaacgtcttcaactcttattgttgaattgtgtatctctccctccagctctgtccatctttgcttcatgtatctggggctctgataggtgcatatgcttataactcttatagcttctcagtggattgaccattttatcattatgagatgttcttctttagccacagccaaattcctggacctggggatttcacagtggtgggatgggtgagtgtgctgggggcaattgagctagaaggtggcattggtgtagccatggaggttggagctcagccagggtgaggagacatgcaggcaggtcaaggctatgagggcagagaagaaaccagcaagcagaggaagctggtctaccgagtggtgccatggtgagcccatgaggttccatgagaagcggatggccggggtcatctctcttgctgcataactcagttcccaacctcatgagccttggccttctgtggtgtctggtccttgttgtaggctttcagtatccttccaccttccccgttaatttgagctattaaatttgttttaaaaattatcatttttagagacagggttttgctctgccacccaggctggaatgcagtggggcaatcctagctcatggcagcctcaaactcctgggctcaagcaatcctcccacctcagcctcctgagtggttaggactacaggtgtgtgcctccacccctggctgttttgaacattttttgtagagacagggtctcactacaggcatgcaccaccatgctgtagtttgcccaggctagtctcaaactcctggcctcaaatgaccctcctacctcagcctcccaaagtgctgggattacagtcatgagccaccactcttggccaatttgagatatttcaagtgggattttgttccctgcaaccaaagtgccttgagtaaaaatatctattttctgtcatgagcaaaagttggatttaaagtaattaaaaatgaggatttggtctccattgaatccaatgaactttgtatagatgacaacctccatagttcactgccttaagttctgacctctatgagccttttgctaacacatggcactggctacctgggtcaaagccagcaacaccatagacacgcctacaacaatggctcattctgacaacatgaccacgtgatcatttgcattcacaaaggaaaatgtacttgcttttattattttcaagaagtggacagcctaagaattttattcaacgaattatttattgactaggtggcaggcactgctggtgtctctccacacgacccccgacttcctgctaacagaatccttttttttttttccccaaaagccaggcagtctgatgcttcagggaggctgaatatcttttgagctgcaaagagtggcccttgtttggtctctaccagtagcgtagaaacaagcaggtgaagtgcttttggccatgcaacctgcaggaacatgcactgggagcggttctggaggttttccttgatctttaacagggacaccttgtccttgggcttttggctatgagtgtgtaaaggtgaatgtgatggtttgggtcactgcacctcagcctgtatccctcaggtgacatcaaggaccgagggtctttccagctctctgctctgccatcctgagcccctcccacctctggactcctgtaagatataaatgctctttgtcccaagccttgtgaagttgggtctactgtgatttgcagcccaaagcctcctaactaataaagacatctacttagtacaaagacttgctcagcaccatgaatgcacaagagagctgaaaggcaggtgttaagaagcttataccttttgcggggtcagaaggcacaggcctaggaattaaacagcagctcaaggcaagaagacaggcaggtctggatagaccaaccagcatttcttaccagctttcatgaacaaggaggttgtagttggcacatgccaaccacgtgttacaagagtgctcagtgacatagaaagccttcctcccgggaccccgggtgacccggtgcagccacctcagcggcctgtcagctaagcaggaaataactagggccaaatcttctttccagagcagagatgaaagggaccctcctacctcattgtagctctctgcagccttgagctcccaggctccagcaatcctcccacctcagcctcctaagtagctgggactataggcgcacaccaccatgcccggccaagggacccttctacctcagatgcagtgaaatcacagaccctggatctcgttgaaacctgtcccatcgttaatgcccctttgcagcacagttgcttagcaaccaggggtgaagttgaacttgggaaagtggaccagtttgtgagtgcctggactgaaagggcctcttcaacctcagccgacttgagtgagaactggctctgtgctgagcactgtgctgggaacagagggtgcaaagacgtttcgcacacagaccctgggttgcaagctgctcagaggttggtggtaagtgtcagccgcccacacaagccccggtgggaggaacagcatcctctggaaccctgcagagagggcagccacacgccctgctggcagaacaggaagtgcttccccactgggctgcccgcgtgccaggcaccgtgcctgaccctttatagaaattatctcatttggctgggcatggtgattacacctgtaatcccagcactttgggaggccgaggtgggcagatcacttgaggtcaggagttcgagaccaggctggctaacatagcgaaaccccgtctcttctaaaaatacaaaacatcagctgagcatggtggcaggtgcctgtagtcccagctactcaggaggcagaggcaagagaatcacttgaacccaggaggcagagtttgcagtgaacccagattgttccactgcactccagccctggcaacagagcaagactctgtctccaaaaaaaaaaaaaaagaaatcatctcatttaacgaccacagcggctctgagagatggatgtgctcacccttgttttgtagacaaggaaaccaagaaccagagagccctagcaacttgctgagggtcacatagcaaatctaactggggttccagcccacgcctccttcatgtgaagacctccctgaggttccccctccttagagagctgggagcattttgagtgggagtttgctaggcagagggacaggcaagataaagtagcctggtgaagggtgagttcatatcacaaacacccggagccatgatctgggggcatctgttctcactggagtgacagagtaaggacgctattgcacctctgctcccagcaggggctcacctgcagacatttgttactgtatgaaaaaaacctgcaagggctggaaaacaagttggtttcacctagtagggttgaacatgcagaacatacatgccaggagtcccttctagatatcatccctagagaaattctacccgtgtgcatccagagacctgtgcaagaatgttcaacagcagcaccgtgtatccaaaaccagaaaccacacacagacatcgtccaacagcgtggataaatacactgtgtattcaacgctggagcactccccagcagtgaacatggaaagaaatatgaccatgtgcataagcacaggtggacctcaggaacatgatgctgagtgaaaaagcaagccacagaagatgcatggtataaaactgtctataagtacttcaaaaacaggctgggcacagtggctcacgcctataatctcagcactttgggaggcccaggtgggaggattgcttgaggccagaagtttgagaccagcctggaaaacacagcgagacaccatctctacaaaaaataaaaacaaagtagctgggcatggtggtacacgcctgtagtcccagctgcttgggaggtgggaggatcacttgagcctaggagatcgaggctgcaatgaactacgatggcaccactacattccagcctgggaaaaagtgagaccctgtctctaaaaaattaaaaaaatatatacatatatataaaacaaggctgagtgagatggctcatgcctgaaatcccagcactttgggaggccgagacgggagactgggagtttgaggccagcctggacgatatagcaagaccccatctctacaaaaaaataaaaacttagctgggtgtggggttgcgtgcttgtagtcccagctacccagaaggctgagatggaaggattgcttaagccaggaggttgaggctgcagggagctatcatcataccactgtactccagcctgggagacagagcaaaatcctgtcttaaaaataattttttttttaaacatacaaaacaaaaccctactgttaaggatatacggcaaaactataccaagaaacaaggggactgataaaaatcagaatggtggcttcccatggggaggggcagccagacagatgtgacctcggaaggtcccctgaggacattggtgacacaaggaattatgttatgcttcaactggggacatgagtgtctgtttcattgttctctgcctcatagatacacattatatatacatatttatatgtatgaaatatttcatggaaaaaatctatggagagtgtagctagcctcaaaagaaaaaaaatgtctcagacgcaattcgaaatgtattttcccttctaacacttccctctaactcagcatgactcagcctcatcaccggggatgaacccagtgactctgtcaagctctgggcagtttctttgaaggcagttttctcagaaatgtgcccagaggccccgaggctctgaactttaacagcatggcaggttggatggcccgtccctacctaagtcttagctggagcttgtcgcaactcgcaactcaaacccaacctttggcagggtttgacttccagtgtgagacaggtcctaggccacaccaatctctttgcaaatggctgaaaagcaagtgccagacccccaggctaggctccacagaaagggctgtgttgctcaccttccctgggaagcaaaggaccaggaggtgacccacctgaggacgaattccatgagagttgctggcctcacgtcctgacttactcattcaagacctctactgtggcttcctcttgctgttatgataaagttccaatcttttttttttttttttcttgagatagggtcctgcgctgttgcccaggctggagtgccgtggcgtgatctcagctcacagcagcctctgcctcctgagctcaagcaatcctcctgcctccacctactgagtagctgggaccacaggcaaacaccaccgtggccagctaatattttaaaaattatttttgtagagatggggtcttgctatgttgcccaggctggtctcaaactcctgggctcgagtgatcttcccaccttggactcccaaagtgctgggattacaggcatgaccaccatgccaagccatgttcaacttttttttttttttttttttttgagatagagtcttgctctttcacccaggctggagtgcagtggcaccatctgggctcactgcagcctcggcctcctgggtccaaggattctcctgcctcagcctcctgagtagctggggttacagatgcccaccaccatgcctggctaatttttgtattttttgtagagacggggtttcaccatgttggccaggctggtctcgaactcttgacctcagatgatccacttgcctcggcctcccaaagtgctgggatttacaggtgtaagccactgtgcctggcccatgttcagcatcttgatcttgatcttcaggccctgcaaggtttgctttctgccagcccctcaatcttatcacaactacatccccggcctgccagccttttctctgatggtctcccaagctccggctggtgtcacagcctgatctctgcccctctctcccttcactactcccgcccctccgccaagtctcaggtcaccatcacttgcgttttttccaatataaaggaacggccaggcacagtgtctcctgcctgtaatcagtgctttgggaggcagagacagggagatcgcttgaggccaggagtttgagaccagtctgggcaacggagcaaggccctgtctctacaaaaaatttaaaaaattcaccagatttggttgtgtgtgcctgtggtcccagctacttgggaggctaaaatgggaggatcacttgagccaaggaggtggagggctgcagtatgttatgatcacatcactgcactccagccgcagtgatagaacaagaccctgtctctccataatatatagagaggtatagaggggataacagatgccgagtacctggcatggaggggtgctcacacacaggggctgctatcccgccattggggtgtgacttctacactttccggctggatcttgtcgtcccttgagccaggctcccgttgcatctggacttgcagtgcttgggatctgaaaaggaagagataatcagccttggagcaggaggcggaggatggagagaaagggaatcgttctgggatcaaagagatgttctgctttggaagaaaaggccaggaagtcctgaggggcgtgtcaccctcgatgacactggcagagtggaccacaccaggggctgcagggggagaggggcttctgttccaccctggggagtggacagcctgggaggccactgacacaggtcctgacacccctggagatggggaggagggaagatggcagccttgggcatgctcgtggccagtgtggaagatctttgatggaaaaggctttgatggaaacctctgcagactggagccgctctaatcagctgctaattcattaggtcaaaagcagcaaaccccgttcccaaaccccgaagagttcccgtcactgtgaattatgtctttagcctccagcctgccatgggtttgggcaggaacacgcggtagcccacacacgctgtaatttcccaagggcagtgttccttatggtgactgacgaggccaccgctaatgccccactcagccatccaggagcccagctgggggtttgggttttttggggaagggtcagttctccttctggagaaaggaggccaggatctcactctgttgcccaggctggagtgcagtgggacaatcatggtaagagggaaaggtggggttcaaacccttgtacggtggaaagagccttatgcctgtccccaaagctgcttggaacctggtggggggcaggctttaggcagctgctctaggacagttccattcaggagtgacagggaccctcggccgctgatgtttaatcaaggacttccttggttttggctttgaagactaaccacaggtgacatgagatctcccggggctgacagaagctgttcctgtcgggcaacggctgggcttggagtgaactgtcagaggccctcagccccggggaggtggtggcgacaggcatcgctgcaggacaccatctccctggtctcctcacggcctccctgctctgtggctgggacagggccaggggttggggctgggtggggaagggaatgagagaaccaagggcctctgcaaaggcagcaaagcagtccacaggccagtcagcaaacacaaagggaaatgacactgtctgcatttcttaaaaaagagaatgtgtttatcatcagaaaaaaaaaggctttaaaaaattgtaaggaaggctttaattgtggccaggcatggtggcttatgcctgtaatcccagcactttgaaaagctgaagtgggaggattgcttgaggtcaggggttcaagaccagcttgggggaacatagcgagaccctatctctacaaaaaaaaaaaaattatctggcctgtacacctacagtctcagctactcaagaggctgaggtgggaagatcgcttgagcccaggaggttgaggctgcagtgagccatgattgcgccactgtactccagctggggtgacagagcaagaccctgtctcaaagagaaaaaaaagaaaggttttaattacaagaaaggagaaacaaggctgggtgctgtggctcacgcctgtaatcccagcagtttgggaggccgaggtgggcagatcagctgaggtcgggagtttgagaccagcctgaccaacatggcgaagctccgtctctactaaaaatacagaaattagctgggtgtggcgcatgcctgttgtcccagctactggggaggttaaggcaggagaatcgcttgagctgggggcagaggttgcagtgagccgagatcgcacagtcgcactccagcctgggctgcaagagtgaaactctgtctcaaaaaaaaaaaaaaaaaaaaaaaggagaaacaggcttgaacaactacccttgctgttctacccctaccccctacccactatgtcaacgtaggttgggaaaactgaggcacaagaaaaccagtactgaggctgggctgtttctgactttagaattttgatgacagcatttgggaacttggtcctcaggtcagggaagatttctaggattaaaagtcaatctcttgaccacttgcaagactggctcataggtgtaacatgcaactgaccaaacaccatccctcgtgcttacagactatccggtgtgtgccagacactttgttaggcgtcactgatgaacctccagaacactttgaggtaggtggtatcatcatcaccaccaccaccaccaccttacaaccaagaacacaaaagcttagagagggctgggcatggtggctcacgcctataatcccagcactttgggaggctgacgcgggtggatcatgaggtcaggagatcgagaccaacctatcctggctaacatggtgaaaccccgtctctactaaaagtgcaaaaaaattagccgggtatggtggtgggcgcctgtaatcccagcactttgggaagccgaggcgggaggatcacaaggtcaggatatagagacagtcctggctaatatggtgaaagcctgtctctactaaaaatacgaaaaattagccaggcatggtggtgggtgcccgtagtcccagctactcgagtggctgaggcaggagaatggtgggaaaccgggaggcggagctttcagtgagtcgaaatcgcgccactgcactccagcctgggcaacagagcaagactccgtctcaaaacaaacaaacaaacaactattgcttctcaaaagaggaatcaattgcttaatgcactgtagattcctcatggtggtgttttccaagtacaatcaatgcccattcaccccactatgaagcctgctagttgacaaacgaaatgttagtttttcttttttttccttttttttgagatggagtgttgctctcgttgcccaggctggagtgcagtggtgtgatctctgctcactgcaacctctgcctcctgggttcaagtgattctcctgcctcagcctcctgagtaactgggattacaggcatgcgccaccatgcccggctaatttttgtatttttagtagagatggggttttaccatgttggccaggctggtctcgaactcctgacctcaggtgatccaacagccttggcctcccaaaatgctgggattacaggtgtgagccaccgtgcctggctgggaaatgctggggtttttgtggcctctcacttaagaataaatagaggcaaggatcacttgatggttgaggaaagtctccacatgaaaggcagagatcaaaagggtcacacagacacaaggaacctgctaggagcagacaatgcacagaataagagaaaattttaaaaaaacataacctggccggtgcagtggctcacacctctaatcccagtactttgggaagctgaggtgggaggattgcttgagcccagggattcgaggccagtttgaacaatatagcgagacactgtctccacaaaaaatcaaaaaattagctgggcatggttatatgtacctgtagtcttggctacacaggagggtgagtcaggaggattgctcgaccccaggagattgaggctgcagtgagccatgtttgcaccactgcattccagcctgagcaacacagcgataccctgtctcaaaagaaacccccaaaacataacctgataattaagaatcatttagagatgagatgaagcactgcatccataaagcaatggtagggtgctaagaagaggaacaatcaaagaacaagaagttcttggcaattaaaaataaggcagcagaaatttaaaatcaatagaaggcttggaagataaagttgaggaaatttcctgaaaagttaaataaaaaattaaagagaaggaagataagaggggagggaatgagatcaatttaggaggtctaatatccaataaatagaaatcctaaaaagagatgacaaagactgtgtcttcttgttatatatcttctggggatagactataaatcaagggatgaaattatcagagaaataaagttagagaattctctgagtgtaaaaacatgagacttcagacttaataggctctttgaatattagtacaatcagttgaaaagaaccttctcagtgcacattgttgcaaaaattctggccaccagggaataagaaacgaccctagaagtttccagagagaaaacctcaggtcacatgaagaagaatggaagcaaatataccatcaaactcctcaatacaaatactggaagctcggagaaaatgaggcaatgccttcacatttttgatggaaaattcttttttacctgggatcctatatccacccaaactattatgtgtgaaaatagaataaaaattattttcagaaaagcaggaactccaaatatttgctcctgggcaccttttcattggaagctactagaggatatgatgcagcaaaatgaggaagtaaacaataaagaggaaggtgtggagctcacaaagcaaggaatctacttggggaagcatcaaggaaagtcccagggtgaaagtaaagcggccaggagcaattggccaagattgcaacaggatcatggagtgtccacaagggagaggttgccaggggaaaaacagaatgattttctgatatatttgataattcaggaaatcatattgttaggcgaatgacagatctgagagtcagatggggaaacaatgaagaataagtatatttaaaagaaaccctgcgcaaaagcaaaggaaaaaaaaaagaggcaatattaactccaggaaaaaaacaaaagtgcagacaagaaagaaaatcagagcacacaacttgccttaacatgaacaatatttacctagttataataatataaccaccacagatgaatcaacacaacagattgtggcctaatataatgagaaaatggaggaaggggaagtgctttgaatgggttattagtaaaagagagctaaattctcatctatctaacaatatgtcagttgataatgtcttaaaactaacatatcaacaaatagcaaggcaaacattatttagacctagtgaaaaagaacagaagaaataacagaagaaaacaaagtgaaaaagaggtttttttgttttgttttttgtttttaggtggagtcgcactctgtcacccaggatggagtgcagtggcacgattttggctcactgcaacctccacctcccaggttcatgcgattctcctgcctcagcctcccaagtagctgggattacaggtatgctctatgtctggctaatttttgtatatttagtagagacggggtttcaccatgttggccaggctggtctcaaactcctgatcttaagtgatccacctgcctgggcctcccaaagtgctgggattataggcatgagccactgtgcttggcctgaagaagagtttgaggtgattgcctctggggatcaggactaggggatgatgatggctgggttggggagtgatgtttttcttacatgcctattttactttcttattttcaattttttaattaaaaatataatagagatggggttttgtcatattgcccaggctggtcttgaattcctggactcaagtgatccacccgccttggcctcccaaagtgctggaattacggacgtagccaccatgcctggtgtattttgctcctttgcatgactcatgtatgacttcgataaaaaataaaactaacttaaaaaaacacatgtcagtcattggaaatatggataatgcatttaagtatgaagaacaaaatagttatcttcagtctttgcacacacaccacgttccatcttttgcaatgcttgtgagtcagctcaccccttcctaaactgaaactgctgactgtgtacctggctcttcatggctatcaccttgattaatcttcacagaagctcaattaggtggttttattactcccattttatggatgagaaggtaggatctgagagttcaataacagagtgagatctcacagctaataagtggaagagcagagattcctactgagcctccctgaactccacatcatctgagcttaattaaactagcaatcatcccagctaatgtttatttagcatagcatctaatcgaaccaattatattcttttcttcctgagctccaaatcttcctctttattactgtgtgtgtgtgtgtctgtgtgtagagacagggcctcactatgctctggaattataggtgtgagccaccgtgcccagcctctttattaatttaagccctcattttgctggaatgtatactcgaatagctgcctctgaaaaggcatatggagttgctatttgccagatatcatgctaaatgctctatgtcgattatctcatttaatacacaaaacaaccctatgaggtagatactcctacgctccttattttatagaagaggaaactgaggcactcaaagagagttccagcaatttgccacatgtctgtctcatctctgtatccccaggagaaattagcatggagctatattcttagtaggtgttcaatatatatatttgttgagtggataaatacaaataaatatcaaatcttgaataaaataaacattaagtttcccattgcttcaaacccagggagccctctggaaatgagctgtcttgggggggcagacacctcttttttccaagagctgccccagtgcaaaagctctggaaacaggaggagataaacagttagttagatgaatgcatctctggttaattgatttgcctgcatgattggagtgaatggcttaatatgcagggtttaattattccaatgaaacctccacttaattgaaagggcttctagcaaaaaaagggaaagagattatttaaaaggatgatctactgcccatgagaaaggattgaagagacatggatacatgcccggactccagctatactcagtgtttacagccttgaaatgaaagcttgatggaaaagagccagaatcatcccttcatgtaccacctgccccatccccttcattcctacaaagagggcacttgcagaagcagctagaaaattccccctgcaagactattccctggtatcccagttaactttttaacctctgtctatctcagctcattcaaccaaaatcctgagatgataatatttcccatcaattaacatgcgttgagcaatcagcagagcttcactgatacatattttgaaagtagcaattatcattttaaatttgcagtggtgtggcagacattgccagctgctggcccaatagccattctctcttacttattaagagatcaccagttttgtttgggaacattactgtgcccaaccaaaaacctgttatttccagcatcccttgcagctaggtggctatttgacacgactctggccagtgagatgtaggtggaagtttctggatgagtcatatgggaaggctctttaaaaggaggcagatttcagatgagaagagccctttacttgtccttctcttcctacctggaatgtgggtgtgatgcctggaggcatagcagctattttgtgacagtgaagactaggccaggctctaaggatgtctgactaggatgctataagaacctcaggtcattgatgacaaccctggacagctaacctttgaattcttggtccatgagaagagtaaaacccctagtaggcagaaaatctgattctgtttctattatttgcagctgcaaacagtcctaacagatacaagtgccacatacaacgcacactttctaagttatattggtcctggccacagacccctgatccctgaaatcagagcaacccgcttatcgatctattccttcccattcttttttcctagagacaaaaccaaagttggcaagtggtcaataagaactaagtatttaatactatccgtgtctaaagtgctgcggcggacagaaacaaatggtgcagctctgaggggtgagcagtaccatgaggagataaggatcgcccaggaaattgtaactcacggacgacaccctcagccattggtttaaccactcccagctttcagtgtgtaggcaggatgatttatctcacccgccttctgtggccctgctttgtatccccagcatgcccctcactgtgcagtcaatgctgtcacttctccagcctctgccttatcccctgggctgcatctccccttgcatcagctctcactcttccataggcaccctacctcctccccatgtcacattacagccgagcttcccggccaccatccccggcaaggcctagtcccttggtccagagcactgcccgccaccccaagcatcccctcaggcaccagactgcctctaatattcatacctgaagctccccaagaggccacatcatttttagctgactcaggcaaagggccaatggctcctgaagataaaaatgtctcatcttgattcctttttagggaaggcgagagcatcagtaggaagttaggaggggctggtgtgccctgaacccagagaccaagggcaccaccacatatcatcccccagccccccggaatatatccacacttattctgcagtggcttcagatttgtaccaagacgatgaagtgtggaagggcacgcacccctagtattcccaaaggaccctgcttcctgggtctccttttttctaacgccaccgcagaaaagcttttgatagaagcccaattaggagtgacagatttaaattgttctgaaatgcacatcaattcatcacgtccactttttatgagcattggccccacctggatttcaggtccgtgcacagggctgattgacagctctgatggcgaccaggagccatgatgggaccactcagccagacccaaatcccagagtgaggtcaccctctcggactcctgtcaagtcagacttgctacaggactggctagggggaaaccctggccttgataacgaaatactcttctctcctgctgttgcctctgaagcctggtcagcaaatccgccttccccacaggagactgataagcagttgcgaccaccagctgattccaattcaagacctctctgtgctttcaaagatgggctcttggcttcacctgtgcactggatggaatttgtttcattgctgtgttcttcagtgtcctggctggcattttattgcctgggttggaagcaacttggggagcccattgtccctctttgagttctctatgtcagtgtcgtgatttgcttgggccacgctatccggtatggagtgggtttttaataaatatttgccgaattgagtgctctgatgttttatgataaaaacattctgttgtcacagaattacattcagtgtcagtccaccaaggagaatgcagtgagcttaagtgctgtgacgggcccgggacggctactctgcagttttgtctgactgctccagtggagtgaggacccttccttcatgccacctgtgcactgggcacagaacaaatttttgtaccacttcttttttaaattaaaaattttatttttacagatggggtcttgctctgtcatccaggctggagtgcagtggcatgatcatagctcactgcagcctccaactcctgggctcaagtgatcctcccatcacagcctcccagagcactggtattacaggggcacaccaccacccctggataactttgttttttaagagatgggggggcggggggttcttgctatgttgcccagtctggtcttgaactcttggcttcaagggatcctcttgccttggcctcccaaagtgctgggatttcaggcatgaggcagcctgctgggcccagtttctgcttcttaccctcttttgccattgctggttcatacacctgtcgtgaattccttggaggaggcctcacgtgcacccatcggtgcctttccagcacagcacctggccctcctttgtagcgtgacggaataaacaagtctcctgtagcgtttagcctggagacttgacacgaaagcaacagcaaggtgggatacagagcctgtgtttttgtgcatacattaaattcgggaggaggagaggtgggaggaaattgtgttactctttggttttgggaagttgagagacagtgtggaaggtgcaaaatcagacatgggacaggcactgccagagacttgggcattagaaagcaaaatcctgcccctgggagcccttggggctggcatgtgaatgtgtggggtgggctcagcagccccgagaatcttctcagtgaaagagttgggcccttgagttttgtagaaaaggtgaccagtatcatcaaatgagtcccactcggagagtggccaagaaccagaggtggaagagtctgtgggagccacagtcagaccttaaatcttcctcattatcttcttctcatcttactcggctgccactagaacccccaaggagcccgcgacagggttaggccaggccaggccagatgcctttggagtcaactccgggaaagtgtgcaaagcgtggtaatgaggatattccagacagactgcggggacgggggtcccactcactcacttgcacattcactcactcgcgcattcactcccactcactcattcactcattcattcactcattcatttactcactcatccactcattcactcatttactcactcatccactcactcattcatttactcactcatccactcgctcactctcccatgcactcactcatttactcactcatccactcattcactcactcactcattcactcactcatccactcattcactcactcatccactcattcactcactcatttactcgctcatctactcattcattcactcacacatccattcactcattcatccattcactgactgactcactcatccattcactcactcattcactcactcatccattcactcattcactcattcattcactcactcactcatccactcactcactcattcatttactcactcatccactcgctcactctcccatgcactcactcattcacccactcattcatccacccacacatccactcgctcgcacattcactcactcattcactcactcatttactcactcatccactcattcactcactcattcactcactcactcattcactcatttactcactcatttactcgctcacccactcattcattcactcacacatccattcactcattcatccattcactcactcactcattcaatcactcttccattcactcactcactcttccactcactcacacatctactcacttatccactgactcactcatgcattcactcacttattcactcactcatccattaactcattcactcactcatccactcatccattcactcactcatccactcactcagccattcactcattcactcactcacacatccactcactcatccactcattcatctattcactcattcattcactcactcatccacttattcactcatgcattcactcatccattcactcattcactcactcatccattcactcattcactcactcatccactcactcatccactcactcatccattcactcattcactcatccactcactcacgcatctactcacttatccactgactcactcatgcaatcactcacttattcactcactcatccattaactcattcactcactcatccactcatccattcattcactcatccattcactcactcactcggccacttacccagccattcactcattcactcactcacacatccactcactcatccactcattcatccactcactcactcatccactcactcatgcattcactcatccattcactcgttcattcactcattcactcactctcactcaatcactcattcactcactcatccactcattcattcactcactcatccattcactgattcactcactcatgcactcactcactcatgcattcactcatccattcactcactcattcacccctcagtcactcattcactcactcactcacggattcacgtgttcgttctctcactcacacattcactcattcatttattcactcaatcatttactcactaatgcacacattcattcactcaatcactcatccactcattcactcactcatctgctcattaattaattcatttactcattcattcatgtgctcactcactcactgactcactcattagattcaaaaagcattcctagatgcagaagtcaaaaaaatcgaagaaactttgactatgagaagactcagggaatgaaaaataagtaagaatatgccacacatgacaaatatgggaggttcagagccgagaaaaagaggcagggaaagagaaactcagaggaaagatggtcaaaagggcccccagactcattggaagaagaaagaagtggcaagaaagatcggggctgaggagcagtgagaaggagattggagggaagaaagaaacctggatcccagcccagtctggcccgtattttaaagtcaagcattagctcagagaatgcaaatcagagctacagcagagtgatttaccaagggaacgcagcgtgatcactcgggtcactacctgcagctcaaatgaagttatctccagggcccagagctggccccgaccgcatcacaaccttcctttgaggagtcagcaggcagcgggacacacaccaggcacccgtcgctgccttctgcatttataagacacgctggaaatacacttagaatagacgcagcgatcaatttaaaatgcatttctagttgtggggccatctattttatgaaataccctgcaaatggataaatgcagcagtgcttcgaaacacattcccaggtgtttgaaagtaactttgccaactttttccattggctagaaggtcagtatttttttttgaaatgcagatttcaggttttcttccatggtgacagggatgtggtggtggaggcttctgcctctagctttctaatcctcccattcttgtcccaggatccaccaagaggtgcagtcagggcaagtcgcctcaaccacagcagaagagcccaaggaggggtctgtgtgtctttccctggagcttcacagggctcccagctcttccttctagaaaggccttcaggtctggtcaacccaaggttcaggaagcagctttttttttttggccaggcatggtggctcatgcctgtaatcccagcactctgggaggccgaggcgagtggatcacttgaggtcaggagttcacgaccagcctggctaacacggtgaaaccccgtttctactaaaaatacgaaatattagctgggtgtggtggtgggtgcctgtaatcccagctacgagggaggctgaggcaggagaatcgcttgaacctggcaggtggaggttgcagtgagccgagattgcaccattgcactccagcttgggcgacaagagcaaaactccttttcaaagaaaaaaagacactttaaattttgtgtgtgtgtgacaaggtcttactctgccactcaggctggagtgcaggggtgcaatcagagcccactgcagccttgacttcctgggccccagtgatcctcccacctcaagcctccccaggagctgggaccgcagatgtacaccaccacacccagctactttttaaatgtttctattttaaagatgggggtcttactacattgtcgaggttggtgttgaactcctggcctcaagcctcagcttccccagatgctgggattgcaggcatgagccaccatgccctgccagatctgggttttatttaggtcttggacttccttattttaacccaaggtgttcaaggcttgaggtcaacactgcattttctcatctatcaggctcagtgggcagatttccaggcagcagaagaaaaagaagtagggtggtttttgagggctaggcttgagtgactttaacctcctgcactcaggaggttaaaatattgtaagttgtacttgctgctgtgaagtgacatcgttccctccaaaaagggcaggggttgtaggggaaaggattgcaggaattctaattaaacaaaaagaaagtcaaaccaaaaaaaaaaaaaaaaaacctttgcatgaagagataaaaacggcagttcccctctgtgttcttagtgggaaggatgtggtcctgcagtcagagagtcctgggtttaaacttcagttgtgccatttgttgctgtgtggccttgggcatgttgcttaccctctctgagcccccttttattggctgagtagcactaacatcgttttttgttgttgttgttgttgtttttttgaggtggagtctgcttctgttgcccaggctggaatgcagtggccctatcttgactcactgcaacctccgcctcctgagctcaagcgatcctcccacttcagcctccggagtagctgggatgacaggcatgtgccactgcgcttgcttatttatttatttatttatttgtatttttagtagagatggggttttgccatgatggccaggctggtcttgaactcctggccgcaagtgatccactggcctcggcctcctaaagtgctgggattccaggcgtgagccaccgctcctggccacgagtagcactaacatcttaaggctactgtggcacgtacagtgggcaatgctacttagctactcagcccacccccgtcggaagctagcagcaaactcaggacagaaacaagaagtcactacctactcgtcctgtgtaattacctccattccaagcagaatttagagaaaaactttaaacatttaccctcaaaccttctgtctgagcttccgattggaaactcacccagccggtggtgttggcatctttctgtgtcttccacgttcctctgggcagggacacacttcatatttccttgtgtaccctggcttagcaagtgtgttccataaatcggcatttcatatttatcaagtgagtggtgtccagtggctaaacgctggctttctttcgctcattacagcttcttcccttcagccgatcagacctctacctccccatgtgtggggagagctttcactgtgactgctttccggtgcctgctgttcccacctagatggttccactgtgcctgcagtttggaggtatgcaccaatccatcttgtactctcaatcactcacgggttagaagcctagaatagatggccctctgatttctgacctgcagggcgcaaactgtctttacctggtgaaatgcagacaggccagctggtcctatgtcccaccaggagagctcttcatttgccagtgtccccaaacatcagtgttacggaaacaacaaacatatctgccacctgctcccaccctgggcaatttccagaatctgaagggccttcttcactatcaaagccagtctattctgctgggcaccatggctcatgcttgtaatcccagcactttggggaggctgaggcaggaggattgcttgagcccaggaattcgagaccagcttgggcaacatagtgagactccgtctctataaaactataaaaaaattagctgggtgtggtggcatgtgcctgtagttgtagctatttgggaggctaaggcagggggatcacttgagactgggagtttgagaccagcctgggcaacatagtgagaccttgtctctacaaaaaaattaaaaaagtaggcaggcatggcggtgtgtgcctgtggtctcagctactcaggaggctgaggtgggaggatcacttgggcccaggaggtagaggctgcagtgagccatgattgcatcactagacttcagcctgggtgacagagcgagatcctatctcaaaaacaagaaagtccattctgtccactgggctgtttctggagttcagttatgtttgtgggatattgataaccccatatcagccatcattttttggattatactcgtccctctctcattgtttaagggaatgaggggtgtatgggaacttctttaccagttgaccttcagaggacatattcccagacaaccagggcacaatgtctctgtgcggtgggtgtctgcacacagtgggcattcagtcaacctcagagcaggacgacagaatgtctcagttaccaaacccacatgacagacgcgcaggcggacgctgacagcctctaaggggagactgctgtggtgtaggagacctgggaagcccccatcccgtgttctggacgttcatgcttgggctgtctgtaacctcaccaggattactgtaggctgtggctgggcttccgggaaggaaaatgaataattaagacgctggagatggaaaacttcaggacacaatagagatttttagtcttaactagacaggaaaataagtgtctcaggccaggcacagtggctcacacctataatcccagcactttgggaggccaaggtgggtggatagcttgagtccaggagtttgagaccagcctgagcaacatagggagaccccgtctctaccaaaaatacaaaaacaagccgggtgtggtggtgcacacctgtagtcccagctacttgaggaggcggaggcgcgaggatcgcctgagcccaggaggttaaagctgcagtgagccgtgattgcgccactgcactccagcctgggtgacagagcaagagcttgtctcaataaaatacaataaaaataaaataaaataaagcagcatctcaatatttaagcacatttgaccattcaggaaagggctctcaagagacctccaaagagtaacctcaccacctcttaatccccaggaactgacgacccagtggggcaggttccagattcctcatttgtctgattttgctttctactatgtgttttttgtttttgtttttgtttttttgttgagatggagttcacccaggctggagtgcagtggtgccatctcggctcactgcaacctctgcctcctgggttcaagcgattctcctgcctcagcctccctagtagctgggattacagacgcccaccaccacacctggctaattttcgtatttttagtagagacagggtttccccatgttggccaggctgttcttgaactcctgacctcaagtgacccacctgcctcagcctcccaaagttctgggactacaggcgtgagccagcacgcctggcctctgctgtgtgtcttacagtaacatcaccatttacaggaggcatttctagaagaataaagcatgaaacctacatccggtgctcttattatcacaattattataacaatgagtgtctccatctgaggttaggtgggcacagaaacggaattcaaaccagtcggattttctgtctcggagaattctgccaacaagatgccaggggagctcgtgcgttgaaatgcattaattgagtaccactattttgggagcaaaataggtttgtgcatccaattaaatgtggggcatctgagagggagaaagacggagagagagcggggattcagaaagggtctctttacttataattaactacaaaataaacagctctttcatggaatggggccctctctgttcccgccacccctgcagcccacgtttcaattagctctgtgttattcgggtcccctattactccagataacccaggactggctgtaattaattgttataatacactcaggagcagagccaagctgcagctcgggaaggctggttgaaactgctctgttcctctaaccggcctcctggaagggctggcttggagctccaccttcaccaataagtcagagctcctccatgggatgacgagggagaggggctgagatacttggagtctgctttgtttgctgcatttggtgctgagcaaggtgctggcccttttctctctgccccgctcccttcacagtccctgaagccctgaacccttcactccagcgacatttaaaataaagacatcaggccaggcacggtggctcacgcctgtaatcccagaactttgggaggtggaggtgggcctatcacttaaggtcaggagtttgagaccagcctggccaacacggtgaaaccccgtctctattaaaaatacaaaaattagccggtcgtggtggcatgtgtctgtaatcccagttactctggaggccgaggcaggagaattgcttgaacccgggaggcagaggttgcagtgagccgagatggcgccactgcactccagcctgggcgacaagagcaaagctccgtctcaaacaaacaaacaaacaaacaatcacaaaaatcagccgggcgtggtggcaggcccctgtaatcccagttacttgggaggctgaggcaggaaaatcacttgaatccgggaggcggaggttgtagtgagctgagattgcactactgcactccagtctgggcgacagagtaaaactgtcaaaaaaaaaaaaaaaaaaaaaaagacatcttatccatagaatggaatattattcatccatacaaaggcacgaagaagcattgctgcttgctgtggcacagatgagccttgcagacactaagctcagtgaaagaagccagacacaaaaggccacacatcataagatgccatttagatgaaacgcccagaataggcaaatccatagattcagaaggcaggttcgtgggtaccagggactggggggaggcagggatggaggagggggtgggtattaatggggatgaggtttccttttggggtgatgaaactgtcctggggctggatagaggtggttgttacatagcactatgaatgtactagacgccaccaggttattgattttaaaatggtgacttttatgttatatgaatcttacctcaataaataaatagcaacaggctgggtgcagtggctcacacctgtagtcccagcactttgggaggctgaggcaggaggattacttgagcccaggagtctgagaccagtctgggcaacatagcaagaccccatctgggcaaaaaaataaaaagattaggcaggcgtggtggggtatgtctgtagtctcagctactcaggagactgaggcaggaggattgcttgacccaggagtttgaggctgcagtgagctatgatcacaccattgcactctagcctgggtgacagaggaagaccctgtctcaaaaataaactaaactaaaataaaaacagctacaattttttgagccgaggtgagcaggggctaggccccaaaccctcagtgactccaagccccagacagcctgggcaggaagctctgatcatctctggtgaagacctgagacttcccagtcttggggaggggacaccaagggatgagacaggttgtggggaagctgggacttgagcgctgtagggaggccgtgtgcttgtcatgggaggcaacagtccacgtgggaattgcaggaatgccttttttttttttgagatggatctcactctgttgccaggctggagtgcaatggcgtgatcttggctcactgcaacctctgcctcccgggttcaagcgattctctcgcctcagcctcccaagtagctgggattacaggcgtgcaccaccatgcctggctaatttttttgtatttttagtagagacggagtttcaccgtgttagccaggatggtctcaatctcctgatctcgcgatccacctgcctcggcctcccaaagtggtgggattacaggcgtaagccaccgtgcctggccttttttttttttttctgagacagagtctcactctgtcgccaggctggagtgcagtggcgcgatcttggctcactaaaacctctgcctcctgggctcaagcgattctgctgcctcagcctcctgagtagctgagattacaggcacccgccaccgtgccctaatttttgtatttttagtagagacggggtttcaccgtgttggccaggatggtctccatctcctgacattgtgatctgcacttacaggaggcagggtcaaggaaaggacaagatagaagcagaggtggagaaagagggtgaggtgagtgggagaagaggggacggcgggacagaggccttgtgacagaaaagggaacaagaactcagggttttacgttgtacccacaggtgcagagctgagaaaaggaaagagaaatgaagaacggcaactcggagggaggagacggtgggggtggcgcgggcaccgggtgcaggctgagaaagcgagagggcggtccggccagggggtgggggtgctgcaaccagctctggtcacgccccttctcctgagagctcccaggactgcaggcaacttgctgaagaacttgggtaatttcccggaggccggctcacctgtttccagcccatcagtgatcttgaaacttacaaatactcagactcacactttccgcctatccgtgcaaggtaagaggagccaaacacatctcgaaatgcaccgatttttcttcttctaagggggcagactctcgtggtgtgcccccaccctctctgttaatgcctctattgtgtaaaaacgtctttagataaatttgtcgggcttggagcctggggtggccatttctttgcactttatctactacaatccaagaccagcaaacatgaggccacgtttttccagtggtttctgcctcccccaccacagtggtgacggaaatacgctccccagcaacagtgagaagaccctgggattctgcaggctcagagatcatctgtaccctcccgccgtgtaactgcaagacgacaaatgagatgcaaacagggaagtctttcttacgtttgtgccaaatgatacaatcaccaataatgaaataaggcacctgtgaaaactgcacccagaaacggtcgatcagtatggacatgaggttgttaagaatgcgtttccttagcatcgaagagggggtaactggctgctctctgatcatctgtctcttcttccctgtgtgcagggagctatgaaggagcccacttaggaagccaggatttaaggtgacaggagcatattgcaggtggggctccacctgccgggcagtgacggctgggggtcaccccgaaatctctgcactcagggctgtcagacggacgttacgcggtatgtgaactagagacactaagagcctattattctgttttgcattttaaaggaggtctctgaggaccagctgatgctttcaaaccacttaagtcagcgaagccccaaaaaggctgtagtctcttgcaagcaaaagttaccaaggggctgccgagggtcttcaagcccgcaggacttaagaaattcccgagtgtttcaccaggaattgaggaatctactcggatccctttcagggatcccggggggaggggaacttcccctttggggtccccagtcctactgtctctttgggaagctccttgtcccacagtcgcctggtttgtcctccggtgtttgtgggcaggggctgggcctttggtgccccggtggacaccagcgagccacagcctcatttcttagcatttgcaatctcaagagatcccagaggaaccgtctggaaggtgcttgcggggttgaggggtggggaacacgaacccttcccagacctggggagggccaggctgcaaggccccacgttttggaaacagaccctgtacacacttcctctccacccagctgggggccacgggcaactcaggccttgagacacactctgcgcactgagccccactccccggcccctggcactgtcccagtcagaagaaaataagacccagtgccacatgacaacgggagcatcctggcctgtgtgggtcaccgggcatgtatggagagcgtctacgggctggatccatggagctctgtgcaatccaagccacggcatgagacagtcgccccagcacctgctgctgagactccacatctggtttaggaaattaggagatgcaaagaggtgtgcatgaagccatgaaaacacatgggcacggacaggacaagggggccaggtgctggggagagggggtcccatggcagccccccagggacagggcttcaccagcgctgcacccgcgggcctcagtcacgggaccggccagttgggaaacgtactcacgcggttgtgagccagctgggtcctgggggttcctcgtgttcctctcaaattctctctcctcctgttgattccccagaaaacaccaaggctgtgggagagcagccacctcccccggaagcctacaccgacgccccactcagatgctgcctctatttttagcgggggcagaagtggggactgggggtgggctgccttacttccctctttttttttttttgttccgagcagaatctgtgggtgactttccattcatgggagtggggaggctcggagagcagaaagggacccaggccgtgcagggcaggcagaaactgcagggaacagggtgcgtctgtcatcagggccaggagggcggtggggcagggaggcaagggcaggaacccggcgtcgtcagtcactgttcgcacctctgctctgctctcaccgctgggccccgggccacgccagacctcacccaggggacctctctggcctcctctgcctctgaattccacagaggaggaagactggccagcagaagtgcggggccttggacattccagggaacactcttctatgagcgtgcatcccatgatgcatacccttttcccctctgtctctttgaagtttgttagtgggtgtggagcccaaagtactttggactggaacatcatggctggaacatcgtgtctttaccagagaatggagggcaaccagagttgtgggaatgaatggaggcaatgcatgaacaccgcccaccccagcgacctgtggatgcaggcgatcaattccttccccaaagctgtcaacgtcccctccgctcctatacaagcaaacaccagtttctcggccattgcttcctggccctggccctgtgtgcaacagcacccaagtctactatcttagcaggcttcctccctatttcccagcctataccaatcacaagaatactcgctgtttcccttcttttcttccaaaaagttgaggtgtaatcagtgagctgcatgggtcttcagtacacagttcgatgagttaggaagatgcccacgcaaccaagatctcagtcgtgatacagagcatggtgacccccactaagaagttctccagggccctttccatccccctgtggcccccaaaggcaaccgctcctgtgatttccatcagctttgcctttgcttgaaccttaggagagtagaataatgtgttgttctactcagacgtcccctccttgggtctccaggaagctctgggcaccgcagctgtgtactccatgcaatggttaattttctgtgtcaacttgactgggctaagggatgcccagatagctggtaaaacatttctgggtgtgttgttgaggttgtttctcagcattggaatcagaggactgggtcaataagacccgtcctcctcattgtggaagggtgccatccaatctgccgaggacccctgatagaacagaaagtcggaggagggaagaatttgccattttgagctagggcatccatcttctttagggtctggctgctttcacgcagcgtgtgaggctggtgtcagtcacgcattcctgtttgtcactgggcagtattccatcgaaaatgtcccacattttcctgacttgtgtatctttcgctggacatgtgggttgtttcctgtttgcctgggaccttcctgtacagatcttcatgtggacgtgctgtcatttcttttgagtaaacgccctggagtaggactgtctgggggaggaagacacggtgcccccagccagggccgccatggagaattgggggagcagcagggactgaccatgatctcctcacacctccgctctctgatcattccagcgctagcactttctgggaaggctgggaagctcactgattacacctcaagtttttggaagaaacgaaggggaacagcaagtattcttgtgatcgatgtaggctgggaaatagggaggaagccggctacgatagtagatttgggtgctgttgcacagggaaaggaagcaacggctgagaaactagtgttcacttgcataggagcggagtggacgttgacctcatccttcccggcttaggcgggagagacagtgatgatgatatcgggaggcctgaaacccaccaaaaagagtcagaaggaagctgattcaatatgggactggcaatttcagggggaaaagatgtcaacaccttcaaaggtggggccagaccccctggaggtaaaagtcccttccaattggattcttaaacacaccccatcggagagaccaaaacatggctggtggaattcaggcttgattcccatttccccgggagagggtgaaaaggttcctactgggctgctccagggagcacgccaaggatcaccagcgccatggggcagaagaagctgagtccccccatgagcagcacggaaaagagggggtcacctgaggccacagaggagagggactccttggaggaggcagcagtaactaagtcacacacataaaggaagtggcatctgagagcttccggcacgcacgcccagggaggtgggagcctaagcttgtgggtgaggagtgatttttctagtatgacaagaaacataaaatacaaaacaggtggttctgccaataagtcagccccagaggagcctggtgaccctggaaatggggccgacctgatgtggacttaggggctttggggtttgagccccagcctggactcctgagcttcaacaagggggctgggaggcagccctctttccctttttttttttttgagacggaatcttactgtgttgtccaggctagagtgcagtggtacaatctcggctcactgcaacctctgcctcttgggttcaagcaatttctcccacctcagcctcctgagtagctgagatgacaggcgtgcaccaccacgctcagctaatttttgtatttttagtagagacggggtttcaccatgttggccaggctggtctcgaactcccaacctcaggtgatccacccgtctcggcctcccaaagtgctgggataacaggcgtgagccaccgcacctggccaggaggcttctttcctgatgctgctcctccagtggagccaggtctgtccttctgaggcccccaaagcagttcaggcctaggcctgtgcaagcactcaggatcccacctcctccctggcactatttgttttctttatctccgccttgaagctgtagttccaaacaggcaggcccttgactgctgattcagctgccggagccaaaactcataaaatcctatttcaaaaaggtccaatgattttcttttctgatcataaatatgaaatttaattagcagcctgctgctaatgaagtcaccgtggaagccagcctggagaggcggagggaacgtgaacacctgcaggcaacagaacctactgcctgattaacccttcctctcctgctgcccctcactgggccctttctagggccccatgggccccgctgcagaggggcagcctctggcctggaaggacaaggagggactgctcgttcaggcagagttggaggtggctcagatgtcgcttccttgggtctccaggaagctctgggcacagcagcggggtactcgatgtgctggttaattttatgtgtccacctgattgggctaagggatgtccagatagctggtaaaacatctgggtgtgtcagtgaggatgtttgtggaggagctcagcatttgaatcagtagactgagttaagaagatccgccctccccaacgtggttgggtgccatcccatctgtccagggcccctgatagaacaaacagtcagaggaaggaaaaattctcgtttgagctgggacatctgtcttctcctgtcctctgacactggagctcttggttctgggccttcaaactctgggactgacaccatggactcccttgttttcggaccttcaaactgggactgaattatatactagctttctttctttttctctctccgtttttctttctctttccttctttctttctctctccctccctccctccctccctccctccctccctcccttccctccctcccttccttcctttcttcttttctgagacagggtcttgctctgttgccaaggctggagtgcagtgtcatgatcatggcccactgcagccttgaactcctggactcaagttattcatctgcctcagcctcccgagtagctgggactacaggtgtgcatcaccatgcttggctaagtttttaaattttttttagagatggggactccctatgttgctcaggctggtcttgaattcctaggctcaagtgatcctcctgccttggcctctggaagtgttggaactataggtgggagccaccacgcccggccgtggcttctgtgattctccagcttgcatagagcatgtcatggggcttcttggcctccatagtcatgtaatccaattcccataattaaatccccttttatatatgtctctatgtatcctactgtttccatgtctctgactaatacactgtgctgcagatcagagacccagcttctgtcttctctttaaaaccctctggtaggctgggcccggtagctgacacctgtagtctcagcaatttgggaggctgaggtaggaggatcacttgagcccgagagttcgagaccagcctgggatagtcagacctctctacaaaagattttataacattagccaggcatggtggtgtgcccctgtggtcccagctactcgggaggctaaggtgggaggatcacttgagcccaggagttcaagaagcggtgagccataatcgtgtcactgcactccagcctgggtgacagagcgagaccctgtctttaataataataataataaaaccctctgatggaacattgtccacagcaaaagggaggcactgggaataatacacagctcggcataggagcttaagggaaggccaccggagctcagaaagtgcccagggcctctgctcaatgctgtgcgtgagctgggggcacacagcatagtccattctgccttacaacggactggatggtgcggagtccttctcgccaccagccagccttcctggtagtgacttccagataccttctgcccacaacccaaaaagatcagaggaaccctatagttcctccttcatactccacagaacacatgaaacccaggaccaccctattcctcccactactcctggcttcattttctcctcctataatgcaggaataataatgcccatagtttgcaggattttagggatgattcaacaaatgtctaaagaacatgcctggcatacaggaggagctccataaatgggagactttataatcatcatcttgcatgagtttatgagttaaatccccaatccagaactcactactatctgaagtcctacggaggagacacggactatttcaaacatgattcaggaagctgaagtgagaatgtgaccattaatttcccaaacatgttcggaaaaacccaatccatctggtcggtgccgacatcacgctaatatctactcaagcgtgtccgtgtgtggaacacagggtctgcagtcccagcgtgtgtggatcgtgtggggatgtgtcatttccctgcacacaggtcacgcctgtgcagacagcctgcatgggcactgcacacaggacctggtacacagacccctccctgcaaaatgcaaatactcatcagaagtgagaaggagccgtgctccccccgatagagcctgcaacgtaaaactttagatttagtctgtggtcaaggcacacaggattatattctagtaaaaagtttatgacagaaggtaatagagtttttgagggattttttttctcgccggattttttttttttaaacagaagcgtattgcaattctgcaggtatttgggtcccagctcctgaacgagtaggaacagctcaggttttgctccctgcacctctgcagggaaccctcctagggtcatggctgaggttgttgggatgctggagccggaacccctcaggtatcacggtcagcaccaacaggtgcagctggcttccaggattaaatgttaccggtaagctgagtttgtgtaaatcaaactctcttctccccattgactggatttagagctgactcctcacctatgcaactgccctccacagcccctgctcacagcctcaaattcctcactcaaagtgtcgcccatcggccgcagcgtcagcaggtgcttcacctgccgcattttgagcctcacctcagcccttcggaacggagcctgcggtttaacaggctccccaggtgacgctcacacacactgataaacgccgctccaactcacccctccctgtgcgcagagacgtgggtccccgactcttggttcactccctgcctgacccctccccgtgcgcagagatgtgggtcaccgactgccggttcactccctgcctgagtctttcaggactttggtttgaagcactatagaattcgtccatgtaactaaaaaccactagtaccccaaaagtgatagaaaattttaaaaaatctgttaaaaaaaccccaaacaagttaaatatttaaaaatcagataatatttcatataagttttttcagtgcacttgaagtcttctttggggacagggtgcctagtgaatccgaccctccacaaatcccacctcatggccaaccttggtccactgcaacctccgcctcccaggttcacatgattctcgtgcctcagccgcctgagcagctgggattacaggcacccaccaccatgcctggctattttttaaagaactgagcacttcaatgaaaaggcagaggtgatcggggtggattaaagaggattcaattctatgccgtcgataacaggcacacttgaaacataaagatgtagagaaggtaacagtaaaaagatggaaacgctattcataaaaactgaaatggcaatattaatatcagaagagtagacttcaggaagaggtgtattaccagggataaagagggacatttcataatgaaaacagagtcaattcatcaagaagatacaatcttaaatgtgtatgcaccagttctaaagcttcaaaacacgtgaggccaaaagaaagaaaactgaaaggagaattggacaaaatctacaatgatggttgttgatttcaacagtctttttcactaattgttcgagccaatagataaaaatgaaggctatagaagatttgaataatagtatcaaccaacttgacctaattaatgtttaaaacactacaattaacagctgcagaatacatactcttttttttttttgggactgagtgtcacactgtcgctcgggctggagtgcagtggcaccatcttggctcactgcaacctccgcctcccaggttcaagcgattctcctgcctcagcctcctgagtagctgggattacaggtgcccgccaccacacccagctaattttttgtatttttagtagagacagggtttcaccatcttggccagactggtctcgaactcctgacctcgtgatttgcccgcctcggcctcccaaagtgctgggattacaggtgcgagctactgcacccagccatacatactcttttcaagtgtacgtggaacattcaccaagatcttttgttggtctataaaacaagtctcaactttaaaaggactaaaattatatagagtatgttctctgacacaatgaaactaaagtagaaacttatgataaaaaggaacctagaagttttctagatgtttggaaatgaaatgacacagtcctaaataactcattggttaaataagaaaccaaaagaaacttttgaagatgttttgaactgaatggaaataaaaacaaaacatcaaaatgtgtggaatgctgctaaagcaatgcttagggaggactttataactttaaatgatcatatcagaaaagaagaataatttaaaattaatggtctaagtttctgcattaagaagccaggctgggagtggtggttcacgcctgtaatctcagcaccttgggaggctgaggcaggaggatcacttgatgccaggagtttaagaccagcctgggcagcttagtgagacctcattgctataaaaataaaaataaaaggtggtgtgcacctgtggtctcaggtacttgagagaattaggcaggatgatcacttgagcccaggagcttgaggctgcagtgagctatgattgcaccaatgcaatccagcctgggtgacagtgagaccctgtctcaaaacaaaacaaaacaacaacaacaacaacaacaacaaaacccccagaaaaaaaacaaaagaaagaaagaagaggaaagaagataatgaaaataaagataagagtgaaaaacagtaagttagaaagcttaaaaacagtttagaaaaccaaaagctgggtctttaaaaagagcaacaaaatggataaacctctagctatacactaagaaaaaaagagaaaaaacaggcctggtgcggtggctcacacctgtaatcccagcactttgggaggctgaggtgggtggatcacgaggtcaggggttcgggaccagcctgaccaacatggtgaaaccctgtctctactaaaaatataaaaattagttgagcgtggtggcacatgcctgtaatcccagctactcaggaggctgaggcaggagaattgcttgaacctgggaggcagaggttgcagtgagccgagatcgcgccactgcactccagcctgggcgacagagcgagactctgtctcaaaaaaaaaaaaaaaaaaaaaagagaaaaaacaaaatgaccaatatcaggaatgaaagaggagctatcactaccagtgcaacagacattaagaatatattaggaatattgttttaaaaacattatgcccacaattctataatatgaatgataagaacagaaattactcaaaagatatacattcccaaaattgacttaagaagaaatagacagtctgaattagccctatatctatttgaaaagttgaagtcattatcagaaactctcccacaaagaaaattccagactcatacagcttcactggtgaattctgtcaaacatttaaggaagaaataacacaaatcttacataaatactttcagaaaacagaggaaaaagcaacacttcccacccattttatgtggccaatattatgctgattccagaatcaaccaaaaaacattacaggaatagaaaactaggaaccagcatacttcatgaacatagatacgaaaatccttaatgggattagcaataacttcaaaaatatatagagaggataacacatcatgagcaagtgagatttattccagaaatgctagtccattcaacattaaaaaatctaccaatgtggccaggcacagtggctcatgcctgcaatcccagcactttgggaggcagacgcaggcagatcatgaggtcaggagttcgagaccagcctgaccaacacggtgaaaccccctgcatctactaaaagtacaaaaattagccaggcgtggtggcgggcccctgtaatcccagctactcaggaggctgaggcaggagaattgcttgaacctgggaggcagtggttgcagtgagccaagatcatgccactgcactccagcctaggcaacagagcgagactccatctcaaagaaaaaaaaataaatcaaccaatgtgcatcaccatattaagagaataaagaacggaaaaatcatctgattacttcaatctatgcagaaaagtcattgggcaaatttcagcatccattcatattaaaaacttccacaaattagaatagaagggactgttccccaaagactgggaccaaggcaaggatattcacactgaccacttctattcaacattgtgttgaagtttctagttaatccaataagacagaaaataaaaaggacgaagactggaaaggaagaggtaacctgccattatttgcagaaaacatgattgtctaaaagaaatccaaagtaatctacagaaaaatctgctagaattaataatattcaattaacaatgattaataattatttgctaaattagcaaagccacagaaggtcaatatacaaaagccaaaaaccctaatatccagaaacataacacacgtaggatttaagataaggaaagctttgtaaagtgtctgcaccaagaactacaaagcattgctaagaaaaattaaggaagccctaagtcaaacagagagatatatcatgttcattgattggaagattccttaatattggtttttggtgttttttttcttttgttgttgtttgtttgtttttttgtttttatttatttattttttttgaggcagggttgtgctgtgttgtccaggctggagtgcagtggtgcaatcatagttcactgcagcctcagactcttggttcaagcgatcttcctgcctcagcctcccaagtagctggaattacaggcacacatcaccacacccagctaatttttgtattttttgtagagacagggtttcaccatgttggcccaggctgagctcaggcaatcctcccacctcggcctctcagacagtgctgggattacaggcataagccaccatgcctggcctggaactctcatacatagctggtgagggtgtaaaataggacaaccactttagaaaacggtttggtaaattaaatatatacctattctgatgacttagcaaatacctagggttctaggacccaggacccctatgtatttactcaaggaaaatgaaaatatgtccacacaaagacttgtgtgtggttaaactgataacaacttcattcataatagcctcaagctggaaaccaccccagttacccaacaggaggaaggataaacaaattgtggtaataaaaataaacaggaaagagacatgcaacaacgtggaagaatccgaaaacatgcagagtgaaagaaaccagacacgaaaaggtacacactgtgtgattccaggtatgtgaagcccccggacagacaaagctacccaacgtgaaagaaatcagaacagtgattgtcccaacagcttctggtgggaaggatggaaactgagcaggaggggcatgaggaaactcttgagagcactgaagatgttctgtatcttgatggattatgggttacgttcgtcaaaaacggttgaactatctaccgtgcacttaagatctgtgcatttcacggtgtacaaattatatctcaatttagaaaaaagaaatgagaatggatctgaagtgatccctccaatacaatactgtgctttcacacctctgaaatcttttatttgatttttaattttcattttttatgtccataggtttttgggggtacaggtggtattgggttacatgagtaagttcttcagtggtgatttgtgagattttggtgaacccatcacccaagcagtatacactgaacccaatatgtaatcctttatccctctccccatcccaccctttccccactaagttccccaaatccactgtgtcattcttatgcctttgcatcctcttagcttaactcccacttatgagccagaacatacgatgtttggttttccattcctgagttacttcacttagaataatagtctccaatctcatccagggccctgcaaatgccactaattcatgcctttttatgactaagtagtattccatcgtatagatataccacagtttctttatccacttgttgactgatgggcatttgggctggttccatatttttgcaattttgaattgtgctgctatacacaagcgtacacccttgaaatctgaaatgatagctcagtgggcctggggagaggggtagaattccagcagatactccaggaataaaccagatcccaatgggcccttggtgttgtttgcacctgtgatccccatgcacacaggtgatgggggatggctaagttagacgacatctgtgtttcctagagctgcagtaaaaaattatcacaaatttagcagcttaaaacaatggaaatgtattctctcccagttctggaggccagaagtccaaaatcagggtgtcggccagaggggctccttctggaagctcagagggagagttttttccaagcctctttcccagattctagtgatttctgatgatctctggcatttcttgacttgtagatacctcactccaatctctgcctccgtcatcacacggctttccctgtgcatctctgcacagcctctcttctttttatttctttttaaaaaatatttatttattcagagacagggtctcactctgttgtccagctggagtgcaatggcacaaacacgggtcactgcagccttgacctcccaggctcaagtgatcctctcacctcagcctcctaagaagctgagactacaggtgcatgccaccatgcccagctaattaaaaacttttgtgtggggggtagagatggggtcttgctgtgtttctcaggctgatcttgaactcctgggctcaagtgaccctcccatgttggcctcccaaagtgttttgattacaggtgtcagccaccaggcctggccagtctgtctgtctctctcctctcgttctcctttttgtaaggaggccagtcattagattcagcccccacctccttatccagtataatctgtttttaacttaactaaccccatgtgcagagaccccatttccaagttaggccacactctgaggttccaggtgggcaggaaatctgggagacattatttcctccactgcagtccatgctctggccaaagtacaggcaagtttcaatgaaggtgaaaatacagcacagggcctgggtcttcataggggccttcaacaacccatgtgtgggtttgggacatggaagcccaggccatggaaagcagatcatgaattagaatttgaaagagcacgatgtgtgggtgtgcggggccatgatcgcaccagaggagggatggagaaggcatttctgggggttcttgggaagaaagtgcatttctagtgaccccaccctggcatctgatccacccagaggcattgctaaaatttgaaggccccgaaaagctttgagaacacacccgtgacacgtgcgaagtctacgggaaagagaggcggcggactcgccaggggaaagctcatatccagggacgcagcagaaggtgggccccgtgatccgggtcggagctgcttttaattgcctttgcttttcctgcacaaaggagtctgggccatttggctttctctgcagaagaattaacctttagcaggatggataattgatcctcagcaggggaaacgtcccgtgggttttgacgcagaaccggctctcggtaaacctgtccctgccacaccctgcaaagctcccgcccctgcctcctcttgtctggagctgtctcccttctagctcgccaaatgctcagggttcctatattttaaaaaatcttgtcccatcaaactctgctttcaggaatggcacgaagagccgacacgcacggtgagcagctgccttctgcagatggaacgcctcacctgggacgcctcacctgggacgcctcacctgggacgcaggcgttcctgttcctagtcacgccctgagccctggattcctgcccaagctcacatagcagggactggcccagccccattcactcatgcatgtctgaccccaaggcagggctggtggcctctaaatcctcccgctagggtttcagcgcctggctgcgttgaaggtatcaccttttctacgaacacctgttctgaacagtgaaaatagctattcctaacagaggagttgcaagctccagggatctgtgtgtgcgttggggagagtggagtacatcatttctggaaaacggggcctcaaaacgtagcgccgtttacagatgagaaaagatgcatttagaggcttgaactggaatgggctgtacacaggactgccttgccagacagcggctcagaagtcttcaaaaacgtttgaagatgccccgttaaaagcgtttggttatctgttggtaacagtgctggtctgctcagcctgccttaacagaataccacagactgggtggcctaagcaagagaaattcactttctcacagtgctggacactggaagtctgagatcaaggtgccagcagggttggtttctggtgaggctcttctaccttccttgcaggtggccacctcctggctgtgtcctcaaatggcctttacttccatgcacgtgaacctggtgtctcttcctcttcttacaaggacaccagtgctgtgggatcaggtccccaccctcatggtcttatttaaaattgcctccttaagattcctcaaataaataaaaattgagctaccatttgacccagcaatcccactacttggtgtctacacaaaggaaaacgaatcattgtactaaaaagatacccacgcccttatgttcatggcagcgctagtcacaaagcgaagatggaatcaatctaggtgcccatcaacggtggattggataaagaaaatgtggcatatatacaccatggaataccacacagccataaaaaggaacaaaatcgtgtcctttgcagcaacatggatacagctggaggccataatcctaagtgaattaacagatgaacagaaaaccaaatactgcatgttctcacttaaaagtgggagctgaatgaggagaacacatggacataaagatgggaacaacacacactgaggtctgcaagatcagggagtgaaggaagtgggcaagggttgaaaaactactgattgatatggtttgcctctgtgtccccacccaaatctcaccttgaattgtaataatccccttgtgtcaagggcgggaccaggtggtggtaattgaattacagggctagtttccaccatgctgttctcctgacagtgagtgagttctcacgagatctgatggtttataagcatctggcatttcccctgcttgcactcattctctctcctgccgccatgtgaagaggtgccttctgccatgactgtaagtttcctgaggcctctccagccatgtagatctgtgagtcaattaaacgtcctttctttataaattacccagtcttgggtatttctgcttagcagcatgagaacagactaatacaaccacctatttgatgttcactatttgggtgatgggttcagtagaattccaaacctgagcattatgcaatgtccctatgtcacacacaaacctgcacatgtacccccggaatctaaaatttccaaaaagagaaacaataactaaaaagaaaaaccaatcactccctgcttaaaggccccatctccaaatacaatcacattgggagtttgggcttcaacatgtgaatttgggggacaccattcggtccatcacagtaaccaagcctgctatccctccccgtcctgatgggatgtgtgaacgaaagtggacttttttaagaaaggaggcttgacttgacaacacccaaacgaacagtcctttaagacagtgtttccggcaatttcccaattgctccacatgttttctggaatttcttcctctgaactgctgcaattctaaagcttgagaaacagttgcagagggtgagaatctgcattcttccctgtgcagtgacaccatcgctgggataggcacagagaccaaacagcggccacatcgaatgacctcacatttcccagcctctgtgcacacgcccatgctgttccatgcaccgggaacacccttcccatcatgtccatgtacaaggcacaccccttagggctcagggccactgttgcctgaactccatggcagttccatgcctgcttcctccaccgctcccaagctgcaactttcagactcacacttgtcacatgggattgtgctttttggcctccttcacttggcaatttgccctggaaaccagcagacctgtcttgtcaccaggagggcctcagtcatcaaggcactctgcagatgtctgtctaatcttgtggaggtgacgtcctagccagctccccccaaccccacccacaccaaaagctgccactgcctggttttgtcacaaagaaaaacagggaataaagtgacaccagcagacctactgccactattcccagctctgtgcctgaggcctttctttcaactgttttttttttgaggcagagtcttgctctgttgccccgtctggagtgcagtggcacaatctcagctcactgcaacctctacctcctgggttcaagcaattctcttgcctcagcctcccaagtagctgagattacaggcgtgcactaccatgcccggctaatttttatatttttagtagcaacagggtttccctgtattggccaggctggtcttgaactcctgacctcaagtgatctgcccacctcagcctcccaagcgctgggattacaggcatgagccaccgcacctgtccttccgggactatcttagaccaccaagcccagagtgtaacaattaagggtgtttgggttgaataaccccccaggtacctcagtctcaggaggaatccctgggcgtgagttctgcccatctgcccagcctccccatgggatggagtccctgtcattcaccgtagtgacaggctccataacattccctttatcagctgcccctcgacgctgtaccacttccccaccccaagatcctcatccccggcaactcccagatgaactagttgcattcaaaccctcatctcagagactgctttgcgggggcacgcaaatgatgatgcagtccgggatggcagatgttgctctggacaggtggcatggagctcagatcccagctccgataaaggctcgttggagctggccagattcaaagcaaacaacaagcaaaaatgcctgccctcccctacccaccccaacaaatctcagatgagaacctcagatggtgcagatggacagggcaccatttttcaggagagggaaagccggggtcatcctgaaactcccttcagctcagcccacaggggaggcagggcgaggatggaggctgatggttgtgggtgagtggccctaggcatggctcagttctgagtcttcttgtgggcctgacttagctgagaggcagtcctgagatgctcaggcccacagcagggacagcagcggctgctaccacctccgtgctgagaaaaaaacaacaagctgcccagaactgagacaccccacccagcagcaaccaggggctccggggacaggatggtggtctgggccctgggctctcagctcacattctacagtgaaaagatggacgtctttttatttttatgcagaatcaagctgacagggtctaattctttcccccaaggaaagattaagtggggaggttgaacttgggatggtagaacgagctctgtgctggaaaatctacgtttagatcccatttctcttaaagtctatctgtggcaattttaaaacctgacccccaaattctctgccactcttcccattgttagatggggcttgtgtccccaccccttgaacccgagctctgtaactgcttgacctacagaaaaagctggaagtgatactgtaccagtgtctggactgaggctctaagaaactgcagcttcctggtcgggcgtggtggctcacatctataatcccagcactttgggaggccaaggtgggcggatcacctgaggtcaagagttcgagacaagcctggccaacatggtgaaaccccatctctactaaaaatacaaaaattagcagggtgtggtggctcatgcctgtaatcccagctactctggaggctgaggcaggagaattacttgaacccaggaggcggaggttgcagtgagccaagatcacaccaccacactccagtctgggtgacagagtgagactctgtctcaaaaaaaaaaaaaaaaaaaaagaaaaagaaatatatacatagctttcattgtctgtgtcctgggacactcactcttaaagcccagacatgcctgggcatggtggctcgtgcctgtaatcccagcactttgggaggccgaggtgggaggatcacttgaactcaggagttgcctgggcaacatagcaagacccaatctgtaaaaacaaaacaaaacaaaacaaaattatctgggtatggtgatacacacctgtagtcccagctacttaggaggctgaggcaggggatcacttgagcctgggaggttgaggctgcagtgagccgtgattgcaccactgcactccagcctgggcaacagagcaagaccctgtctcttaaaaaaaaagaagcccagacagcaagcagcccatgcagagtccacgtggacaaggatcaaggttcccagccctccctggctgagatcccagccaatagccggcagcactttgcagccacatgagagcactgtctgggaagtggatcctgcggccccagctgagctgcccgagttgaccccgcgtggagcagagacaagctttctctcccaggctctgcccgaactacagaatccatgagctcaagaaattgttgttgtttgaagtcattaagttttggggtggcttttacacaacacacaaccagaataacgtctctgtggcctggggcaaatgcttaacctctcccgacctcggtttcctcgtctgtaaagggaataggattcaaagccttccaaagtgcatttcaggatgtgagggtaatctggctgcaacagctgtcacccccattgatcaccagagttgatttggctgatctggttggctaggcgggtgtccccttcctccctcaccgctccacatgtgtccctcctgaggctgcatacttggtcaaagaggatgaccatccccgagagaggaagaccggtcttccatcaagggtacagaagtagccgcgctcccctgctagaacctccaaacaaactctcaaggtgcaaagtgcatttcagctcaaatagtcaatgcactctttcaacaatagtgaatcagtttcctggttttatcataacacgtaacgccctttctccagtttatcaaaaaattccctaaaaggaccagaatgctttgtcagtccttcttaaacatcaatgtctacatgactcagctggagatcctgttcaatgcaggaggtcacagatggggcctagaaatctgcattttaatgtgatttttcttttttctttgactcaggacagagtctcactttgttgcccaggctggagtgctgtagtggtgccatcatagctcactgcagcctcagcctccctgggttcaagtgaccctcccacctcagccacccaagtagctgggactacaggtgcacacctaccatacctagctaattcaaaaaaaattatttgtagaaacgaggtctcactatgctactgaggctgttcttgaattcctgggctcaagcagtcttcttgcctcagcctcccaaagttctgcgattacaggtgtgtgccaccagcccagattttttgcttttttttttttttaacaagatgggatctcacttgcttgtccaggctggagtgcagtggtgcaatcatatctcaccacagccttgaacacctgagcttgtgatcttcctgtctcagcctcctaagtagctaggactacaggtgtgctccaccacaaccagctaagtttttttgtatgaagaaatgaggtctcactgttgcccaggctggtcctgaactggcctcaagcaatccttctgcttggcctctcaaagcgctgggatcccagacatgagccactgcacccagccactgattgcttttttcttttttcctgagacagagtctcacactgtcacccaggctggagtgcagtggtatgatctcagctcactgcaacctctgcctccagggttcgagcaattctcctgcctcagcctcctgagtagcactgatagcattttgagtagcaagggcccctttgtttgtctgttaccagcaaccacccttacccacaggattaaacatggaaaggcagtatcttttttttttttttttaagacagggtctcactctgtcacccaggctggagtgcagtggtgtgatcatggctcactgcagcctcaacctcctgggttcaagcgatcctcccgcctcggcctcctgagtagctgggactacagtcatgtaccaccaggcctagctaattttttgtatttttagtcgagatgggatttcaccatgttgcccaggctgatctcgaactcctgggcttgctcaagtgatctgcccgccttggcctcccaaggtgctgggactacaagtgtgagccactgcgcctggccggcagtatctcatttaatcctagaacaactcccaaggaaggctctagaatcacgtgcactttacagattggagacacagcatctggagaggtctggggatgtgcccacggccacagctggtgagtggtaatggccaggacttgcactgaagtcagctcctccatgctcaatcccctgccgccctcttctgagcaccaggtgatgtgagatcaaccatgtttttaaaaatctcaccccttcatgcctgcagcaaggcagctggggatgaagatctatcacagaaggacagaaatggggactcagttacactcaggaataacaaaacagagttaataaagatagaggtgactttttcaggttccccagctccagccgtgattaatttacagctttttacatgctaatgttttcctgccttctgctcataataaataaccaatatgctttaatacctagttattattcatccctttcagatacttggattttgattctttgctgcagctcaatcacattgaatttctttaaccaggacagctccattaagagtcccttgcaaggacaccctggcggggcggtgacagtaacaggtaacgggtgacgagagagtgaggagctgccacacgaaatattggcagccatggggaaagaaaggggaggccgtaataaaaaacaccaccaaactacatttaagtaacgcggaggtgataacacagaccaataaaaccagggaacgcacagtgaaggttgacacgccatccttaacgcgcctccccggcttgtttctgcaatagaaactcacatccatttaatcacctttctgacatggagcgttcccttatattgggataagaatggctcgtcatccctcccaccccctccacctgccgggctgtgtatttcagaaagttccttggaactttctccatcttctctccctcccagtggttttcaagcagagaaggccagctcatcaagagacatgcatgcgagttaatagaattgcttccttctaacgaagctgttccttctcctgcaatccaagagctctctggcaatcctgttccccatttgacacacggcgactcacgttcctccaggcccactgaggactgaacgtggcaatcctcatcctgctctgcggctgccccaagaacagcagcctcactcctggggcttctgggcagccactttccttggccacctggaccctcgtaggtcagtcctctgcctcccatgctgggccactccttccactgtaggaaccacccaaggtgtttccaatacaggaagccctttctcagggacagcactttgtatctttcttgaactcatctgggactacttcccgtataatgtggtgtttttttgtttttaagagatggggtcttgctatgttgcccaggctgaagtacactggccattcacaggcgtgatcacagcacactacagtctgaaactcctaggctcaagcaatccacctgcctcagcctcctgaatagctggaacaatgggtgtgtgccactgtgcccagctcagaataatgtttttaaatacatagaataacatataggccgcgtacagtggctcatgcctgtaatcccagcactttgggaggccgaggcgggtggatcacttgaggtcaagagttcgagaccagccgggccaacatggtgaaaccctgtctactaaaaatacaaaaattagccgggcgtggtggtgcgggcctgtagtaccagctactcaggagactgacggaggagaatcgcttgaacccaggaggtggaggttgcagtgagctgagatcgtgacattgcactccagacagtaaacaaatgaaactgcatctcaaaaacaaacaaacaaacaaaaagcttctgcggaggcctcaggagacttataatcatggtggaagggcaaaggggaagccagcacatttatgtcaggagcgggaggaagagagagagaagggaaaggtgccacatccttttaaacaaccagatctggtgagagctcactcactgtcaggaaaacagcaagggggatgtccatccctccccatgatccagtcgcctcccaccaggaccctcctccaacactcagtcacaactggacatgagatttgggtggggacacagagtcaaaccgtatcactcggcctcccaaaatgcgaggatttacagatgtgagccaccacacctggcaaattgggtcattcttatcacacccacctaaaacagagttgggaggggtggaggtaaaaagcacccgggacacataacatggctccagaaatgaaattctctgcaagcccgggctgcggacactgccagccgtaacctgaaaccagttttctctaacagctactgaaacaatctgctatgactgtaaggttagttttacccaccgctgtcactcaccaatcggggcttgccagctccccaaaacttcactggtgacggtcaacttaaagaacaatacgtaacacttctgttttaaaaataaaacctcaaacctttgttctttggacataacgaagaccacccaggtctgtgtgtacgtcaaaaattgtaattctttgttttttttgaggggtcttgttctgttgcccaggctctagtgcagtggccccatcatagctcactgcagccttgacctcccaggctcaagagagcctcccacctcagcctcctgagtaactaggacgacaggcgtgtgccaccactcgcggctaatttaattttttttttttttttttgtagagatagggtttcacaatgttgcccaggctggtctcaaattcctgggcccaagcaatcctcccccctcggcctcacaaagtgctgggattacaggtgtgagccaccgtgcccagcccaaattgctgttcttacttctcaagtaaaacttctgaattgcagagattcgtctctacagtttatttgatgtcaacaactcctatatatccagtgcctggcccagagctcaataacaaccaccaactgtgtggaagagtccgatctgattctaactctacagtaaaggacgccccacagtcattgagaggccacgaacactgcagcagatggcacaaggtggtctgctagtctcctgcctaactcatcatcacagcctggcctattaagaacaattccttgccagaagggcctctctctagccttaccccattgcagcatcagcttactggtgggttttggcaagaacccgaagttaagacgggcacgggaatgatgcctccacgtccgatcagcgccagaaggtgctgctgcgacctcttcttccccgctccccccagtcatttcttccctgcctggactcactctgtgggaagtgatggtatctgaggactgcaatatgctccacgccaggcccccatccatcaccagcttcctgctggttaccatggagacggaatgtggggtccccactgggatggcacattcagagtccctgggcgagggagtatttgtgggcaaagggacactgtgagatccaggaccacccagagtggggccacgcagaggtccacgcaggcaagagaggccaagggggaaggaggcagctgagaaaaactgctggatgtgcacagaactaagggcagcatccatgaacgtctggaagaccagaccaaccgcacgtggaactctggtgagctgaagaaaccagaccctgactatggcacagaggtctgggcgagctaagaggtcagcagcttcttaagtccacagcccaccgtgaagataccacgtgccttcccaggtagggaaacactggataatctcaatagtcacttctgcagctatctaagacacgccttcatatatatatatatgtgtgtgtgtgtgtatacacatatacacacacacacacatatataggagcaaatgatagcatccataggaaagcttagttcacagcctgccacatagaaactcaatatatatctctctcatatattatatatgtaacaatatatattattgatatatgatagatatataattatatgtaatatcatataaatatacattattgtatataatatacaattatatattatatatttatatgaaatatgttatatatgatatataattaagtatatatttgcatttttaatttattatattttattatatattatacataatgtatatcatatatatttataattttaaattaaaatatatatttcaataaatatatatttaaatatataatatataaaaataaatataaatttaacatatattttactatatatttataattataaatatttatatataatatatataatttatatataatataatataaatttatttataaatataaatatataatatataatataataaaaatttatatacaatataaatttatgaatatttataatttattgtaattattgttttttatgagacggtctcgctgtgttgcccaggctggtcttaaaccccggggctcaagcgatccttctgcctcagcctcccaaatagctggagttacaggaaggcacccctgcccctggcttagcgcaggcctctaatgagcctagcagcatgctggatttcttttgacaacggaggctggccataggaaggtaaggagagagtctaggaagagaccaggaacctggctacaccttagtggggtcaccctacactcaggatatggggctccgttttgtaagctcaaggaatttactatttcctccttcattctggtcactgaatgcttaagaggctgactcataaaccataatgcttatttatttgggacagggtcttgctctgtcacccaagctggagtgcagtggcacaatcacagctcactgcagccttgacctgggctccagcaatcctcccacctcagcctcctgagtagctactactacaggagcttgccaccatgcctggctaattaaagaaaaattattattattatttttttttgtagagatagggtctcgttatgttgcctaggctggccttgaacacctgggctcaaatgatcctcttgccttggtctcccaaagctctgggattacaggcgggagccactgcacctggccctaatttacctttttattataagtggccattttcttctggggaagcatgataaagtggactttggagggaggcaggcctgggtttgaacctggctctaccacttactggctgagtgaggagggaaagtggcttgaactctccaagcctcgaatgctttacctgtcgaatgggagtgatgacaatatataaatttcacagggttgctttaaggagcaaatgaaatcatacaaaagaaagcttagttcagggcctgccacatagaaactcaataaatatttcctgttaactacacagaactgtgtccctaggagacagtgtgtttagtcaaaaaaaaaaaaaaaaaaccaaaaaacagtgaggagtggggtgtgtgatgtgaccaaatggattggtaagcctggtatcacaggacttctcagatcctttgcacatgaatcttgctaaggaaggtgcagcacgcagcatttcccagcttatctgaccatggcacccttggttcatggagcaactcacgaactagtgttctgtgtggcatacactttgagaaacatcatcacaggccatgtgtccatcaacctggagaagctgatgaactcacgtgcactctggggatgcatctgttcagagaatgtggactggtcggtagcatcaggccattccctccccaggaaagtggaggggaaaagcacatgcacaagtcttactcttggacaagaacaccgtcttcagtcatggcaccaatatccatgatggataagctcagtgaatgagatcactttgcattcatttacattctggcttggagtctactgatgaggtgtgggaaggacccagtcactgcggaaactcggctcaattcatcttttagggcaagtgatccctgctgggaatcgctcattcatttctcttcaattcctatcaggtggaatttcagggcatggcattttctgagcctgctcccaaattctggaaagagggagggagtgggtggaagtgcagagggcttgggacaagatagtcaaacaagctctactgcaaccagcagggtggcctggcccagagcacgataaaccatcaagatacttccctgcctatgaaatcaaaaccataacagctcctccaactgtgggtggtgagttaatatttatacactctatagatttattctagaagaggaaactgaggaactctcctagaatccagcagaaaaaggtggtggtgggtggagctggacaggataaaagaaaagctaagtggaagacagattgagaagttgcaacggttgtcttacaggtgatacagatggagaaaattaaaagaatggagaggaagagaaattcaaagaaactctagaaaaaaaatcccagaattgaaaaaatataggaatcctaagctcaaataatgcaatggtttccatgccagtgagtgcatgtgcacagctgtacggtaagtcctcagtcggcattgcccactcgttcttagaaactgcaattttaagcaaaatgacctgtaaggcaatgaattttaccataggctaatgattacaaacaggaattaagtttctactcacaaaaacatcaccaaacaacagcaacaactactactacaacttcttctttttcctcctcctcttcctcctcttcctcctcctcctcctcctcctcctcttcttcttcttctttcttctttcttcttctgtctcactctgttacccaggctggaatgcggtgctggaatcatggcatactcactgtagctttgacctcccaggctcaagtgatcctcctgccttagcctcaaaaagtgctgggatttcaggcatcagccattgtacctggcctaccaaacttctcaagaccaaaacacttctagtattaaacatggaaataaatgtgcactatacatagaataaatatgagcttaagaaagattcattaagaacagcaaataattatttacccatttattgcagttaagggtcttgggtggtcagagcccatcccagcagctcaggacacaagatgggcaccagcccaggataggacaccatcgcggggcatctctcacaccccacactcactcagactgcagccatgtagacgcaccaatgaacctaatatgcacacctttgggatacgagaggaaaccgcaatacccagagaaaacccacacagacgtagggagactcacagactccacacaggcagtggtcccagccaggaatcaactttttttcccattgacattataatgaaacaacattgaatgaaatgacatcaataccctcctctgaaaaactcagacttcagcttggaagacaaaccaatacaccagagaatcagaaaacaagaagacaattgtacatcttgattttagcttctgaccaattttctatgataaccttgagaacaagatgatagaattgggactgactggttttcctcataggtgaacgcacaggtggttgaacagcattacctaaatagtattgataatagtgttttctttgtgctgaatacattttagaccttggagaatgtctaaggggttagacgaaagagctcatttctggaccctgttttgttcaacacctttggcaatgatgtgtgtgatgacatacaggagaaccttatcagatttgcaggtcacataaagttgggaaaaatggttaatatgataaatgcactcatcaatattcaaaaagacttgacaggcaagaagatagggcccaaaccacaagatggaattcaacagaaattaacgtaaagtgctgaattttgccttaaaattttgcccaagggcaggatgggggagaattggcttggcagaggcttaggaaggaaggaaggaaggaaggaaggagggagggagggagggagggaaggaaggaaggaaggaaagaaggacggaaggaaggaaggaaggaaggaaggaaggactgactttatcagattttagctggtcacacaaagttgggaaagatggttaatataacaaaggaggaaggaaaacaggaaggaaaaaaaaagaaagaaaaaggaaggaaagaaggaaagggaagaaaaacactgtgggcttttaattaactaaatgttcaatgtgacccggtaatgtaataagtgacacttaaaccataagggcagattatacgaagaaggcaaactgtagatgctgtaatttctcccttctctcccactcccaacccagtggatacaaaattatgagaaatcattttatcgctagcagacaggatcgagctgaaagagaaaacccaagtccggaggctgcaggaaagaccaactccaagaccgcagacaccagatacaaaggatagctctagggtgacaagttagagctctgcctgagacagggacagctgcccgggttgaacctcctgcaaactcccctcaccccattccatggccaggcagcaccccagggagatgtcttccctcctgcaggcagactgcgggcctggcggtcagagaggcacgacggtgcttgcggggagggttgggctgtgcaggtgagacccaggaggaacaggaagcctcagattctagaaaaggagtccctacaacgcagcagggatcatctcgtgctcaccaaaaggccgcaggcacagatacagtcagagctgaccatttggagaggatgcccaatgtgaacgtggtcctctccccaggaaacactagacactggaggaaagccaacgccgtaagagaaacaaccaagcacggtcaaggaaagcgttcacagggccagcagaacaagccattagattgtgcgtgcttcatgtcctcagaaagacgcaagagagcattggctccacaaatagaaattaaaacaaaacatcaccgctgggtgcggtggctcacgcctgtaatcccgtcactttgggaggccgaggcgggcggatcacgaggtcaggagatcgagatcatcctggccaacatagtgaaaccccatctctactaaaaatacaaaaaattagctgggcgtggtggcaggtgcctgtagtcccagctactcgggaggctgaggcaggagaatggcgtgaacctgggaggcggagcttgcagtgatctgagatcgtgccactgcactccagcctgggtgatagagtgagactccgtctcaaaaaaaaaaaacccagaaaacccccccaaaacatcaccaaaacaacaacaacaacaaaaccaaacagtagatggactgaatttacagaatggacacagctcatgaccaaatcactgacttagcagatggaattgaggaattctcccacaatccagagaaaaaaggcattgggggtggcctggataggataaaagaaaagttaaagagatgtgggagatagatccggaagttcccacgtttgtcttacaggtgacctagcaggagaaaatgaaaagaacagagaggaagataaactcaacaaaactctagaagaaaagctcccagaattgaaaaaagatatgaatcctgagctcagaaagatgcacaaagtgcccggaagaacgaaggggaaaaaaaaaaaaccacagcaattcacgtgatgctgaagtctcagatgccaggcttgcgagaaaaagtcttgaaagcttgcagggatctgttacctgcaaagctatagaatcagatggatcaattggcaatacctggtccaagaagacagtatctttaacattctaaggaaaaacaattttgaaactagaattctatatttagctcgacaatgatttcaagtataaacatagaaaaaaaaatttcacacatgcaaggactgaaaaagtttcccatccatagacgttcaatgaaaccatcaccaaaagcagtacatcggcaaggaggaagaaagactccaaggggaagaaataggatataaggaacaatggtagttgcctgttatggactgcacagcatccccccgaaggcataagttgaagtcctaaccttccgtagctcagaatgtgactgtatttggagataagttctttaaagaggtaactaagctgaaatgagagttaagtggagccctaatccaatctgcctgctgtccttatatgagaatacgttaggttcgtgcaaaagtaattccaatccttgccattatataatggtaagaaccacaattacttttgcaccaacctaatataatttgaggaaaaaagcatgaaaagtaactaggaagatttttatgctatttttgagacagggtcttgctctgttgcccaggctggagtgcagtggggccagcagagctcactgcagccttgatctcccaggctcaagtgatcctcctgcctcagctcctgagtagctgagactacaagtgtgcaccaccatgcccagctaattttttaatcttttgtagagacagggtcttactatgttgcccaggctggtctcaaactcctgggcttaagagatcctcctgcctcagcttcccaaagtgctgggattacagatgtgagccactgtgcctggccacttttcatgctattaagcatgaatgcttgcatgcctcacaatctggcttcacagcacataaagcaaaactgatagaaatacaggaagaaatcggtaaagacattgccacagtaaagagacttcctgcagtcctctgagacggggacggcaagtacagggagagatgattcaaatagttagcatgtttgctctaatagagctacagaactctgtacccaacaaatagaagaaaaaaaactcttttcaattacacatggaaattctacaaaaattcaacacagattagccacaaaggaaatttcaagtaataatgaaacgcagaaatagcatatggcatatttgctgacaaagacataataaaatttttaaaatgacaaaagaataccccctctaatctataaaccagaatatttacaattatttaaaaatgaaccataacgagagcagaaactgctagaatcaatatgagagtgcaataaggtggctaaatccaaagtcaacttgcatctctccagatattaaaacatattataagactacaggccacagtggcacagaaacagataattagatgaatgaacaaaagtctagcagacagccagtgtaggtgtaaaaatttagtgtatgattagggtgacatttcaaaccaaggtagaaattcaagtgctgatggataattggctaacgattcagaaaaaattacgttcctacctgcccctttgcataatttgcagatagatgaatgatttataaatgaaataataaattccaaagtattagaagaaaaaaaactgttaaatacgccgataaccttcatataggaaaggccttcctaaagaaggcatggtatgctaatgtcatttaggaaaagattgatgccttcgcgtacattgtaatttataacttctatgtggtgagaaacagcacgacgaagttaaagtgtaagttatggtccaggaaaacatctgtaatatatgaaatagagattaatgtgcagactgtcaataagaaagagacaaggcacgtggtgggaaagaaaaggaggaaactgagcaggaattcacagaactttacacaaccaatgaacatggcagtggtaattaggctcactaacaaagaaaaaaattggaacattgagattccattctgcgcttgagctggagctgcaaaagaggagtgagaaaagagctcacctccaccaggcactgtggctcatgcctgtaatcccagcactttgggaggccgaggcagaggatcgcttgagcccaggagctcaagaccagcctgggcaacatagtgggacccccccatctctacaaaaaagagtcaaaaaatgagatgagaagatggtttgagactgggaggttgaggctgcaatgagcagtgatatccattcacttaatcccacaacaaccctgtgaagtgattttttttatttttaattttgagatgggtctcactccgatcacccaggcaggctggagtgcaatggtgcaatcactgctcgttggtactagcagtttctgctctcattatggtacagtacctgggacaggatcggcggccagtaagcataggcagttgctatcattatcatcagcatgtttccaccatctgagtggctaacattttcaagctggataatacacagttttggcaagggtgcagggaaaaaaaaggactctcccgctgtcttgaggggaatctaaatgggtccggccagtttttgagggcaatttggcaatatccatgaacacatgccaccacacatctgacactgggtgctgctgtgtgattgtgtctccctgaaatcctatgttgagatcctaatcccaaggagatggtattaggagatgagggagagtacctcacccttgggagtcggttaggtcagggggtgctgaatccttggggatgggattaggacacttataagagagtccccagagaaatatcctagagagaccccttgcccgtttcaccatgggaggacatggccagaaggcaccgtctatgacgaagcaggccctcaccagacactaaatgccttgttcttggacttctcatcctccagaaccataagaaataaatgtttgttgtttgtaagctgcccagtctataatattctgttatagcagcctgaatgaactaagatgcccaggaattcctatttggcgcccaacctagagaaatattcaaccctctgcacatccatggacacacaaaggacagcaaaaggttggaagccatcttaaatgcccattagagaaaccacacttttttgttttttttgagacggagtcttgctctgtcacctaggctggagtgcagttgtgcgatcttggctcaccgcaacctccgcctcctgggttccagcgattctcctgcctcagcctcttgagtagttgggactacaggtgcccaccaccacacctggctaatttttgtatttttagtacagatggggtttcaccatgttggccaggctgttctcgaactcctgacctcaggtgatgcacccacctcggcctcccaaagtgctgggattacaggtctgagcctctgtgcccagcctcatatggtaattttgtgtttaacttttgccaaaactgcccagctgttttccatggcagctgcaccatattacattcacaccatgatttcttctttaatcacaaaatgcaagagaaattctgggaagggagtgggaatgccagagggagcagctaggaaaggaaaggtttgttgggcatcagtgagtgtgcaggagggtagaatctgcccaggccaagaggaaggcaggcaggcaggccagtgttcagacaggagcagagccaggcagggcctggagagggagtgggctgggcctatgtctgggcaaagagctgggcttgagtgcataaagtcacggggaagtctatttaacagcagtggccgggaaggggtgttgaagtcttttatgcagaggccggcctcaagcacgggcccagcccaccatctggtcacctgcagaaggacccctttgccccttcccttttaggtgcatcctggaatctactggaagacgcaggagggtgagagggcagtggcaggctggataatgaggtcgctggtcctcctgaccctgcggtgcaaaggcagggcgcccggaactgtcatcatctgcttccaactgtcataaaagagatgtggcgagtggggaggacatcaaactaagtttaacatgcaattgaaccagggactgagctggctcctgcgtcttctctctctgactttaaaatgaactcccggaagctccagcggtggagctcagcaccgtgcccacagaggagctcaataataggggggatgacagcggcggtggtgagggcacaggacggaacggcaggcccttcagtgctgccctggagacccgcgggctgcacacacatcagaaacatctctgtggagcccccgaggcctgcattgccgcaagcgggaaaatggattgttgcaccagcatttctggtggccagcgacagggtctgcctcccatcctgtggacggaagcccaggagttcaaggctccagacttggaggcaggagtcactccagagcagggagggaccagcaagcctctgtatgagtttcctgggattcatgtgttaagaataaactgccatagacagggcggcttcaacaacagacatttagcatctcagggtcctggaggctgctgtccgagatcaaggtgacagcagggtaggcgtctcctgaggcctctctcccgggcctgtagacggcatcttctccctatgacctcacaaggttgtcgttctgtgagcatctctctctgatctctctctctcttttttttttttcttgagatggagtctcactttgttgcccagtctagagtgcaatggcgtgatcttggctcactgcggcctctgcctccctggttccagtgattctcctgcttcagcctcctgagtagctgggactataggcatgcaccaccctgcctggctaatttttgtatttttagtagagacagggtttcactatattggccaggctggttttgaactcctgacctcaggtgatctgcccgcctccgcctctcaaagtgctgagataataggcgtgagccaccaggccagacctcatttcctcttcttataaggacaccagtcacatgggattagggctcacccccatgacctcatttaacttaatcacctctttaaagaccccatctccaaatacagtcacattgtgaggtcctggaggttaggcctgcaacatatggatgtggggggacacaacagcccatgatcccccagcaacatatggatctggggggagacagcagcccatgatcccccacgggggctttggcactggagtggccccaggcctgccttctcctcacctggctgcatcaggtaactctggctggcaacacttccagactctcattccagaaccaccccagggaaataacagaatgtgttgagactcttactgttgatagcagccggctgggtatggtggcccacacctgtgaactttgggaggctgaggaaggaggatcgcttaggccaggagttcgagaccagcttgggcaacaaagtgagacctcatctctaccaaatattttaaaattagccggggatggtggcacacatctgtagtcccagctactcaggaggctgatgtgggaggatcgcttgaacccaggagttcaaggctgcagtaggctgtgatcaagccactgcactctagcctgggtgacagagcaagaccctgtctctaataaaagaaaagatagcagtattagccacttgacccttcccgtggggctgtgtccaggaatcgcaaactctcagaggcatttgaacaagagcaattccatcttgaataggagctgggtaaaataaggctgaaaactactgggctgcattcccagatggtcaggcattctaagtcacaggatgagatgggaggttggcataaagaccttgctgataaaacaggttgcagtaaagaagccggctaaaacccaccaaaaccaacatggcgacgagagtgacctgtggtcatcctcattgctatactcccaccagtgccatgacactttacaaatgctacggcaacgtcaagaagtatggtctaaaaaggggaggcatgaataatccaccccttgtttagcatatcatcaagaaataatcataaaaatgggcaaccagcagccctcagggctgctttgtctatggactagccattcttttattcctctaccttttttttttttttgagatggagtttcactcttattgcccaggctggagtgcaatggtgtgatctcagctcactgcaacctctgcctcctggattcaagcgattctccaacttcagcttcctgagtattacaggagcccaccatcacacccagctaattttttgtatttctagtagagaaagggtttcaccatgttgtccaggctggtctcgaactcctgacctcaagcaatccacccaccttggcctcccaaagtgctgggattacaggtgtgagccactgcacccgtctggtctattcctctattttcttaataaacttgctttaactttattctatggactcaccctgaattccttcttgcatgagattcaagaaccctctcttggggtctggatccgggtccctttccagtaacaaaatcaccctcaccgcaccctccatgaaatctcacagcatctcagtggaaatttaggtgagcatccaattggcaggtaagaaacggtcctggagaaccagactcagagcatcctccatcttccacgtgtttattggacaccacaaggttcatagaaaaaggtagaaattggatgcacagccagcaggatgggcatggcggccagtggggtcctgctttacctccaagggggatgggctgcccagctcaggctgcccaggagggagagtgtggacaacctggaccctgtagatcaaacaggacgctggaggtgccaagccatgagtgcctgcgagaaacatcaggaggaaacagggcttttgtatttctttccacatcagtcctgggtcccactaaggctactggaatgattgatttttggtttggcagtactgttgtctgaggcgttcaaaccacagcgactccatcctgagtgaggctgaggaaaataaggctgggacttggtgggctgcattcccagaaagttaggcactcctggcctctagatgttaacggttaagagaacagactgataacgtttaccaaacagacccagacttgtgagtgtcctgatattctgacatcttttttttttttttgagacagactcttgctctgccgcccaggctggaatgcagtggagcaatctcagctccctgcaacctccacctcccggattcaagtgattctcctgcctcaacctcctgagtagctgggactacagcatatgccaccatgcctggctaatctttatgtttttagtagagacggggtttcatcatgttggccaggctggtctcgatctcctgggctcaggtgatcctcctgccttggcctcccaaagtactgggattacaggcttgagccaccccacccggccccgatatcttgagaacaaaagcattcctaatttgctttaaagatagtaatatcaattcttgcaaaatatagtaattaagaaaattaatcctccatcacaaatccttgtagcaaagtatatttccccatgattttctttttttctttatcctatatataaacaagtattgtacctaggtagacgcgtccctcctcttactttcaggaccaccctactctgtctatagaggtaactgttctttcaccctttttttttttttgagacggagtcttgctctgtcaccaggctagagtgcagtagcgcaatctcggctcactgcaacctccgccttctgggttcaaatgattttcctgcctcagcctcccaagtagctggaaccacaggcacacgccaccatgcccagctaatttttgcatttttagtagagacgggatttcaccacgttggtcagcctggtctcgaactcctgacctcaggtgatccacccgcctcggcctcccaaagtgctgggattgcaggcatgggccaccgtgcctgacccacctcactttcttaataaaccggattttactttgcactgtggactcgccctgaattctttcttgcacaagatccaagaaccatcttttgcaacatagtcaccctgcaacatcgtcaccctgggcctgagcttgccagcaaagatggcggcgtgggaggaaatggacgttgtgaccagtgcgggctcctggctgagaacacagcccggccttcctcagacactgtgactcaggtgcacactaaacacagggggagaactggtgtggggcacagcggagacccttcctctctgagcaccatgaaatcatgtcaaacctggaaacttctggcaacccatcagatgacgcaaaacattgagagcttcaactgaatccaaggtcccaggaaaacaaggttctgggacattaaccagaagtccaagtatttgaatgcaaaataattctgtgcagccagacatggtggctcatgcctgtaatcccagcactttgagaggccaaagcgggtggatcacctgaggtcaggagttcaagaccagccgggccaacatggtgaaaccctgtctctactaaaaatacaaaaattagccaggtgtggtggtgggcgcctgtaattccagccagcctgggcaacaagagcgaaactccatctcaaaaaaaaaaaaaaaaatctgtgctcttggaactacatgtcatttacgttacatgtgcagaaatctactcattgccctgaagggctgtttcctaatctccagaatgttctcccacgttcaggctgggaactttttaagggcagggcctgttttgtgctgtctttgcatctctttggcatgtgttaggatcacttgtggagtttttaaaaatccattaccccaaataatgaagcaattagttgtggtagggcctaggcaatggcaattttaaaagaggattctgaccggcagccagggctgggaaccattgcaccagagcccctggctttaacaaggacccacatgaagtgtgagaggagaggcagcagaggagaaagggggcccaggtgaagcttgtggactgagcagagcttctccaggtttactgtgtgtaggaaccctctgggctcttgttgaagtcattcacaaggtctgcggtggggcctgagagtctgcatttccaacacaggcccaagagacgtcagtgctgctgctctgaggaccacactttgaggagtaagagaaaggggcaccaggagaaaatgcttccagctggatttccagtgaaatgcatatacatttctctctgctccctcctgaaaatggagcaattcacctgttaagaaatgaaatgtgtgtgtgttttcatatgaacataaagaacagagaagatgacagtagatgagagatgctgagaaaattttggaagatggaaagcagatagagactaccatttctggggagactactgctatggtctcaatgtgtgtgtcttcccccaaattcataggcttgaattcctctcccgtaaggcgatggtgttaggtggtgaggcctttgagaggtgattacgtcatgagggtggggcccttgcaatgagattagtgcctttatagaaggtattccagagagttctttcaccccttccaccatgtgaggacacggctctgaaacacaggcccattaaaacaattaaatgtaatcagagattatagaacatttcccctcccccacacttcaccactacactgacagggctccagtgtaatcacagtggattagagctgaaagagctgcaaatcacagacttgctctaaggaggaatatacagggaatccccaagtcaagagactagacaaaagcaaggacatttgaggagtctgaagctcctagtaccttgaaatacaacaaacattaaacagaacctgaatcttagcaagattcacagaatcttcacactaacggctcatttttctcagttcctattacctaatacagcatgtatggctgtcaacaaaaaagtacaaggtataccaaaaggcaagagaaaacactctgaaaagacaaattgatgatcagaaccagactcagataggacatagacagggaatttaaagaagaagacattgatgcagccaagaaacaggaaacaaagctcaacatcactgatcattagagaaatgcaaatcaaaaccaccgtgagataccatgtgttgagggcccaaatggaaaaaaaatagacagtatgtaagaacagatggataaagtaagcagacaaatggaaactgtatgaaggaatcagaaggacatgctagaaataaaaatcacagagtagaaaggaagaatgccttcaatgagttcatcagtagactgcacatggccaaggagagaatcagtgagcttgaatacagatgaatataatgtcccaaactgaaatgtaaagagaaaaaggaattaaaaaaaatctgaatccagaatctacagtgaactcaaacaaattcacaacaagaaaaaatcaaacaaccccattaaaaggtaggcaaagaacatgaacagacacttctccaaagaagacatttatgtggccaacaaacatgaaacaaagctcaacatcactgactattagagaaatgcaaatcaaaaccacagtgagataccatctcataccagtcagaatggccattattgaaaagtcaagaaacaacagatgctggtgaggttgtggagaaataggaacgcttttacactgttggtgggaatgtaaattagttcacccattgtggagatggtgtgacgattcctcagagacatagaaccggaataccatttgacccagcaatcccattaccgggtatatacccaaagtaacataaatcatgctattacaaagatacatgcatgtgtatgttcattgcagcactgttcacaatagcaaagacacagaatcaacctaaatgcccatcaatgatagaccggataaagaaaatgtggtacatatatacaccatggaatactatgcagccataaaaaggaacgagatcatatcctttacaggaacatcgacgaagatggaggggaagttgaacaatgaaaacgcatggacacagggaggggaacaacacacagtggggcctgctgggtggtggggttgggggagggagagcattagaacaaatagctaatgcatgctaggcttaatacctaggtgatgggtggatagggcagcaaaccaccatggtacatgtttacctatgtaacaaacctgcacatcctgcacatgtaccccagaactaaaaataaaaattaaaaaaaaaaatcagggcagaacatccaagaagtatcgaataatatcaaaagtgtgtaaggcatacttggataagcagagggagacgaaaagagaaggaagcaaaagaaatatttcaagtggtaacgaccaagaattttgcaaaatgaatgacacaaatccaggaagttcagagaacactaagcaggacaaataacaaaacaccccaaggcatatcctgtccagctgcagaaaaccaaagataaggagaaaaatctcaaaaggaataaaagagggaaaaaaaccctaccttatctgtaagtgaacaatgataagaattactgcagacatctcatcagaaaccaagtgagcaagaagaaaatggagtaaaatagtgacagaaagaaaccactgacttagaatagaattctgtgaagtagtcctcaaacgtgaaggagaaataaagactttcttaaataagcaaaaacagagagaattcatagcagacttgctctgcaagaaatgttaaaagaaggtcttcagaagaagaaaaatgatacagaggaagaacaatggagaagaaataactaaaagtaaaataagatctttttaaaaactcttaattgatctaaaagataactgtttttaaagaataacagtaattatgtatcaggtaattctagcaaatggatcagtgaagtgattgacagccatctcacggagtcaggaagaaggaattgggaattctgttacaaggtatcttcactgcatatgaaacagtacagtgttatttgaaggtgaatttggattagctaaaaatgcattttctaaattctaggacaaccactaaaaatatttaaaaagaaatgtggttgatatgctaagacagaacataaaatgctcaattaaaacctgagaagttggccgggcacagtagctcacatctgtaatcccaatgttttagaaggctgaggcgggaggattgcttgaggccaggagtttgagaccagcctgggtaatatactgagactgtgtctctacaaacaaatacaaaaattaggtgggtgtggtgttgtgtgcctgtagtcccagttatttgggaggttaaggtggtaggatggcttgagtccgggaggttgaggctacagtgagctgtgatggcaccactgcacttcagcctgggtgacagagtgagaccctgcctcaaaaaaaaaaaaaaaaatttatatatatatatatatatatatatatgaaaaaacaacaagaagacacctgagaagtcagaaaaggaggccgggggaagagagcttggtatttattcagagaaggacaagtagatctaagaaacaaaacagagtttgggttcagatttgaagccatgattatttgaaaattttgatatatcagaagcttagcattgcaaatcagtggggaaaagatgctgcaaaaacaaatggatatttctttggaaataaatttaactggatttctcccataagccatccacataaataaataccatgtactttagtgtgaaatcttattgctagcatttcttatgatatattgatctatacagatcatccccgatttacgatggctcgacttacaattttttgactttacaatggtgcaaaagtgataggcatttagtaaaaactctatctcaggcacccaaacaaccattttgtttttcacttttcgtatggtattcaataaatgccatgagatattcaacacttttttagaaaataggctttgtgtgagaggattttgcccaattgtaggctaatgtaagtgttttgaccatatttaaggtatcccagcctatgctaggatgttcagcaggtttgcactaaacgtaatttcttttttttttttttttgagttggagctttgctcttgtcacccatgctggagtgcagtggcgcgatcttggctcactgcaacctctgcctcccgcgttcaacaattctcctgtctcagcctcctgagtagctgggattacaggtgcccgccaccatgcccggctaatttttgtatttttcagtagagacggggtttcaccatgttggccaggctagtcctgaactcctgacctcaggtgatccacctgcctcggtctcccaaagtgctgggattacaggttttaggcaccatgcccagcctactaaatgcatttttgactcacatattttcaacttatgatgggttcatcgggatgtagccttatcataagccaaggagtatctgtatatccttttgtctgaaattttcaagaaatctaacttataatttcaaaacgtttacagactttacattagagaaggatgaaacccgagttcctaatggtggaagagctggcgaggagagagacagttttctctgcagagccccagaagagctcagaaaatggaagcaccttgtactgcaagaggtggtgtgcagggcagggctggggccagcagatgagtggaggaaatgtaaaaagagcaggtgagcccccagattccctccccaactgataggagaaggtaggtttactcgctggaaaattatggggacaacaggtgtggggataaggtgccatctggaagggtagatgattaaaatgttggaagaatgggattcagaagtggggaggggcaggctacaggactgctattttttattttaagtcatgtgatagtatttgatgttttatttctatttctagttttagacaaggtctcactctgttgcttgggctagagtaaagtggcatgatcatggctcactgcagcctcgacttcctgggctcaggctatcctctcacctcagcctcccgagtaactgggactacaggtgcgtgccaccatgcctggataattttttatttttatttttggtagaaacagggttttgccatgttgcccacgctggtctcaaactcctgggctcaggcgatccgcctgccttggcctcccaaagtgctgggattacaggcaggagccaccacacctggctgtgtttgacttttgtaaaccaagtacacatattgtttagataaaaatagaaagcaagcttaaaaacaaagaaaacaaccgcaacctaaaattaaggtctcttctggatgtggtcattggaatggctttctccactgtggtacagaatgaagaccaggaagcagctacccagggaacgcatagtctcaccagtggaaaatcctgcccctcaaatctgcaggtgtcatgccctgccataatgtcagtggggccaggcctcagggagaataggtgtttggtccaggaaaataaagggtgttcttgtaatgacttcacaatttcttcccaacttggttcttctctcatttttccccctaaactcaatcatccatcatttacctcggacttgcttcaggccacactatttataacaatagaagcagcatttttggcttgtcacctttctccaatggagcccagattgtctctaaacctttaatgggcatacagagtacctgggaaccttgttaaaatgcagtaggtctggggtggggcctgggagtctgcctcatgggagcagccccaaggggaggctaacgctggtccctggaacacactctgagtagcaaaaggacttgaggcaactttttgggggtgatggaaatgctctaaatcttgattgtggttacatggagtatatacattgatcaaaatgcactgagtttattgtatgtaaattatacctcaataaagttgattttaaaggaaaaaacccattctagatgaattacagatataaatgtgaaagatgaaacaataaggcttttagaaggaaacataaactttaggataggtgaatgcttcttaaacaggactcaaaacaaattaactataagaaaaaaatacacacatgaattggactgcattaaaactaaaaacttctgttcatcagcagactattgagagtaaaaagctgagctgtaaactgaaaaaaaatccacaatacatatatctgacaaagaactcacgtctatcatatataaagaactactacaattcaataagtaaaagacaactcaatagaaaaatgggcaaaacactttaacaggcactttgcaaaggaggctatctgaaacggacaataaacacatgaaaatgtatgctaattagtcataagcaaaatgcaaattaaagatacgaaattatttattttgcctaaacacccacaagaatggctataatgaagacacagacaattccatgtgtgagtaagagtgtggagcaactggaactctcatacactactaatgggagtgcagactgaaatgacatccttaaaaactatttggtagtatttattagagcagaacaaaaacatagtctaagatccagcaaatccactcttgagtggccaaacacatgtttccaaaaacacataagaatgaatgcctggctgggcatggtggctcatacctttaatctcagcactttgggagtccaaggcaggaggatcacctgagcccaggaagtcgagaccagcctgggcaacaaagtgagaccacccaattctaccaaaaaagaacgcttgtagcagcattattcaatgcagccaaaaattggaaacaactcaaatatccatcagcagtagtataaataaaacgttatactactcattggcaataaaaaatgaattattggcaataaaaaatgaatgagcgaccgccgcaagcaacaacatggattaagctaaggttgccagataaaatagaggacattcaattacatttaaattttgaattaaaaacaaatgattttttttttttgagacggaatctcactctgttgcccaggtcaggctggagtgcaagtggcatgatctcggctcacttcaacctccgcctcccgggttcaagcgattctcctgcctcagcctcctgagtagctgggattacaagcacccaccaccacacctggctaatttttgtattttcagtagagacggggtttcaccatgttggccaggctggtctcagacacccaacctcaggtgatctgcccgccttggcctcccaaagccctgggattacaggtgtgagccattgcgcccagcccaaatgatttttatttttatttttttttagcataagaatgtcctatgcagtatttgggacatacttacactacaaaattcttattctattaaatgttattatattacaatattattttttagctggtcatgttctgtttcttgatctgggtgtcactgggcgacctgggtgtgttcactttgtgaaaatccgctgagttacacacttaggatgagtgcaggtctctggtgtgcatttgctacttcaatacaaagtttatctgaaatcacaataaaacgatccctggcccgtggcccattaaatgagggcctgcctcttgccttgagggacccatctgttgtcgtctctgctgtctgtgatctctgtaacccgtgcatccatcctggcttgtagccgctgctcagaacgccccggtgacgcacccttgcccacaggacagcatctgccctccttggcacagcaccccagggctcctgtggcctcccctgccccatttccacgtcctcacatcttttttccagcgctgacactaaccacaccaccacggctctgtgcctgccgcttcgcctgctgctctgccaggcaaaaacctatttattttcccagtctcatttcagcttctgtcggctctgggaggtctttcctgactccttcaggcagacctgtctgttcctgtccccaaggtctgtcttcatttcaagcatccattagagcaactccattacttcgcaactgactgtttatatatctgtctcctccccggacaacaggcttgctggggcagggactctgtctttttgtctttttatccctagcaactcacagagtgtctgtgcgtgttaggctctgcgtatgtgttaagtgggtcatgacagtaatgggtgttaatgaatggggaccagcagagagatcgaagggctctgtaaagcgttcacacttaattttagaattagagatggcaaaaccctgtctctacaaaacaaaacaaaaaccaaaaattagctgggcatggtggtgcatgcctgtagtcccagctactcaggaggctgtgttgggaggatcacttgagcctgggaggtggaggctgtagtgagccatgatcctatcactgcactccagcctggaagacagagcgagaccctgtctcaaaaaaaaaaaaaaaaaaaaaaaaaagagaaagaattggaaaatgatgctgtaagtcactctgctaatgagtggccagtgtctcatttaacttcccaggagaagggtgctggtcttgtctcccatgtcacagataggaagaaaagtgctgagcagttcaatggtttgcccaaggtcacatggccggtagggagcagaccacacactcatggcactggctgttccgtgaatcacagcagacgctgaatcactaaaatgtccttctgggacaggcaagtcaacagaggaagtgcccagtctgccccgggccaccttttgactcaagcaagctttctggcacctctcaaatcagtccctgtgggtggccaccccctctcccatggaatggctcgccgggaacgggttaacacctcaaacacctaaacacagcgttcagctctgtccagacactctcgactcctgcctgagattttcaggttttaaacaaaacaaaaatctgattcactgtttccagtcctacaggaaactcaggtcctttatttatctgccactaaaaaaaaaaaaaaaaaaaagaagaagaagaaggaaaaaaaaatcaaaccagaaaaaaagccctttatgtcttaaaagggttttgaatgcatctcgtttcatacagcaccaaacatcgttcatgacgggggctccaggatgaagcccagactaaaagacagaaggaaatgaaacgcattgcaataaaacacacatgctaataaataagggcctgggcaatgaatccagctcggaatataccactggcaagaagaaatgccccaaagctttacttaaaccaaataatagaagaacagatggctcccctgggtctctgggaaaagttaatagatccaggaggctgcagatagaggctttgtttgggatttgggcagaaaacacaaggcattcacaagattcaaggtgaaagaaagagggcttgtagatttagggacagggacattttcatcagataacgaaaatagatatgtctggatatctctgctgggtttccacaggctgcagggcacgtgccctctccagaaattaaccagggctgcgctcggcagcatgctagggagaccgactgcttctagctgcccaactggagaattaatttaactccagagatttggataataagaaagaacccttaaaggagataaaaatttactttgggaagatttttgtccccacccattgtacagcagcatccttaagtggtgggaacagtgggtgggaactggaagctctgggttctatgatgcaagacccccctggtcactgattagctgagtgaccctgaagaaaaccttcaggctgccacctgcccagcggctgttaagaatgctgagatccgtggacacagggaggggaacatcacacacccggccctgtcgggggttggggggaaggggcgggagagcattaggacaaatagctaatgcatgcggggcttaaaacctagatgacgggttgatgggtgcagcaaaccaccatggcacatgtatacctatgtaacgaacctgcacgtcctgcaaatgtaccccagaacttagagtgaaaaaaaaaaaaaaagaaagaaagaaaaaaaaaagaatgctgagatccggttgggcgcggtggctcaggcctgtaatcccagcactttgggggcggaggtgggcggatcatgaggtcggaagatctagaccatcctggccaacacggtgaaactccgtctctactaaaaaaaaaaaaatacaaaaaattcgcctggcgtggtggcgggtgcctgtagtcccagctactcgggaggctgaggcaggagaatggagtgaacccaggaggcagagcttgcagtgagcgagatggcgccactgcactccagcctgggagacacagcgagactccgtctcaaaaaaaaaaaaaaaaaaagaagaatgctgagatctgtggacacagggaggggaatattacacagtgggccctgtcgggggttggggggcaaggggagggagagcattaggacaaatacctaatgcatgtggggcttaaaacctagatgacaggttgatgggtgcagcaaaccaccatggcgcatgtatacctgtgtaacaaacctgcatgctctgcacatgtatcccagaacttagagtttttaaaaaaaaaagagagagagaaaaaagaatgctgagatcttctaagcacggaaggatcacacccgcatccaacccccatattaatcccctttctcctccgcaccagggaaatccaaatgaccttgtcttcccagagtggggggcagcaaactgaatccattaacagggaaagaaagggctttcaacccaaccggtgagatggttcagaggagtgcgtgaccgacaggaatccacaactggagaggtcaattaataaaaaataaaacttcccctttataccacggtgcataaaaacctccagcaccatttttcatctacttacattgtcttgagagcaattttgtgtagtggcaaggcaggaattatttatctccatcttattcatgaagaaataaaatcttgggacagtgaagcgatttgttcaaggtcacgaggtcatcacggatttttttttttttagcttttattttaggctctggggtatacctgcaggtttgctatataggtaaactagtgtcatggggatttggtgtatagattatttcatcacccagatactaagcccagtacccagtagttccttttttttttttttctcccgagatggagtcttgctctgtcacccaggctggagtgcagtggcacaatctcggctcactgcaacctcgacctcccgggttcaagtgattctcctgcctcagcctcctgagtagctgggattacaggcgcctgcaaccacacctggctaatttttgtatttttagtagagacgggtttttgccatgttggccaggctggtcttgaactcctgacctcaagtgatctgcctgccttggccacccaaagtgctggcattacaggtgtaagtcaccgtgcccagcccccatagttactttttttcagatcctcttcctcttcccaccctccaccctcagggaggccccactgtgtgttgttcctgtctttgtgtccatgtgctctcatcatttagctcccacttataagtgagaacatgaggtatttggttttctatacctgcattaattcacttaggataatggcctccagctgtatccatgttcctgcagaagacatgatctcattcttttttaaagctgcatagtattccatggtgtgtatgtaccaactttctgtatccaatctgtcattgatgggcatttaggttgatttcatgtctttgctactgtgaatagtgctgcagtgaacattcacaggcatgtgtctttatatcgtggattttcaaggctggaagggctctgggtcatgcagggcaagtgcagatgacggatggggcagcccagcttccacgttcagattcacacccatgggcaaacgtcagtgattgatcactgagcttgggtcctcaatgcggtgctccagcaagccattactagttgattggaattggcttgctagatgcaacccatttactgccccaagtcctgtacagtcttctcatttgacttacgaggaaactgagccccagaggtgaaagggaacttggcccagaccatccaatgggtcagtgtctgaaaaccaaatccctctttctgagcccagtggcctctccagtgcactgtgcggtgccctatctactgcagaaagaattcccccatcaaggtggggcaagatggctcatgcctataataccagcactttgggaggccaaggggggcagatcacttgaatccaggagttcgagaccagcctgggtgacatggaaaaaccctgtctctacaaaaaataccaaaattagctgggcatggtggtgcatgcctatagtctcagctacttggggaggcggaggcaggaggatcgcttgagcccaggaggcagaagttgcagtgagccgagatcatgctactgcattccagcctgggtgagagtgagacgtgtctcaaaaaaaaaaaaaaaaaaaaaaaaagatttccctatcaaaagacgcatgagaatgacattcttcatgacctagcctgagcaaattttcttttctgtgcccagcaagcggacaaactaccaacagagaagtgaaggactgttccaaggatcttaagtccgagtcccaggcaggatgggatggaagagagagtttggaaaatcacaagtttgattttggattcactccatgtccaggcagacgtgtgaagacagttggatattaaagtctaaagttcaagaggagaccctgggcggaagatataaacttgggagtcattggcctatagatgacttttaaagcaagaggtgggaggagaccacccaggggaagaggcccacggactgagctccgggcagtttgacctcagaggtgagggagacagaagagtcagaaaagaggccaggagggagtagccagtaaagagggaaagaaacaagatggagaggccccaaagccaaaggaacctgtgtttcaaagaggagagaagaatgggcttcagatgctgctgaggtcaagatctataaggacagagaatgagccatcagataagggcattggtgactttgtgtttttgttttttgagacagggtcttactctgtcatgcaggctggaatgcagtggtgtgatcatagctcgctacagcgtcgacctcctgggctcaagtgatcctcccacttcagcctgccaagtagctgggaccacaggtgcacaccacaatacatggctttttttttttttttttccaatagagacggggtctcctatgttgcccagactggtctcaaattcatagcctcaagtgatcctcctgccttggcctcccaaagtgctgagattacaggcgtgagcccacacctgaccacatgggtggctttggctagagctgtttaaattgagtactggggcaaaagcctgaagaaagtgggctcaagatggaaggggaggagaagaattaggacagggagtacagacaacactttgctataaaggtgttacgggctgaatcctgtccctccaaattcctattatggacatcctaacccccaggacctcagaatgggactgtatttgaagacggggtctttaaagaggtgctgaaattaaagtggaactattggagtgggccctaatccaatctgacctgtgtctttataccaagaggaaactggaggcacagagacccaggggacacacactcaagagaaaaggccaggcgaggacacagggagaagacggcacctgggagccgcagagagaggcctcagaaggaaccagcccgcccggcaccttgatccaggacttccagcctccagaaatgccaggcaataaatgtctattgctgcagctgcccagtctgtgggattttgttatgacagccccagcaaattaatacaaagggggtgcagagaaatgcggcaaaggctggaggggaatgtaaaatcaagacaggtttgtcatttgtttgttttaaagtgggtgaaattgcagtagatcagtcgcacttggataggaacggtccccgtagagagggaatacagaatggaagatgcagcagagagagaagacagttgctcgagaagcgtctttgattggagagaggtgggctctggtgcctgtgcagagtgggccttggcaggtggcaggatcatcatctcaggcacagggcagggcgaagtgccaggcgcagaggcaggaggccctaggcaggcggaagggggaagtagggccaccagtgcagtgggaggagggcctccgaggcccattagtctgactgccacaagacataaggttgatctttaaaatatattttaaaattacagctgggcacggtggctcatgcctgtcatcctagcactttgggaggctgaggcgggcggatcccctgaggtcaggggttcgagaccagcctggccaacatggtgaaaccctatctctactaaaaatacaaaattagctgggcatggtggcacacacctgttattccagctactcagcaggctgaggcaggagaattgcctgaacccgcgaggtggaggttgcagcgagttgagatcacactactgcactccagcctgggcaacaagagtgagactctgtgtcaaagaaaatagaactgtatatatataattactaaattatatatataaattatataaatagatattatacaaatataattatacatattatatacaattatatataaatatataattatacatataattacatatataattttttaaaaataatatgtatatatgtacaaattacttaagaaagatacagggctgggcacggtggctcacatctgtaatcccagaactttgggaggctgaggctggaggatagtttgagtctaggagttcgagaccagcctgggcaacatagcaagaccctcatctctacaaaaaataaaaaaattagccggtcatggtgtcacatgcctgtagtcgcagctacttgggaggctgaggtgacaggattgcttgaacccaggaggctgaggctgcagtgagctatgatggcaccattgcactccagcctgggcaacagagcaagacaaaattacagcaaacttccacataaaatgagtgaggagacacggtgacccgtccccggcgcacagacggccttctgcttgtaccggagctgggtcctttccccactaggtcatgctcttcgccagtctaagacctccccgggctcagaacactcggaacagggcccggtaaaaggccgtcctttaagaaggaggagaaacatttttcaaagatcgagaactctcctacgaagagccaagagcctctgcgtgcctcagggactcaaacggggatcacggtgcctgttcactggcaaacagggacccccatgtcagctcgcagaggctctccgcagggtatcaagctgcttcttgaaacgcgtctgagaattgaagtcaggagtcttggaaggcggtgtgaggtatcgttattattctgctgaacgtttcccccggaaccaacgatacctgaatccctttaaaaataggccatttcttcttagaagatttccacgaatcacataatccttacgcagaggcaggcaacgaagcactaatgtcaataacgttacagttttacttcacagcagcatttatccactgacatagcaatttactaaaccgcagaaaacgccggcacagggcctctgcttgcccttggatttttttttttttttttttttttttttgagatggagtctcactctgtcacccaggctggagtgcagcggcgcgatctcggctcactgcagcctccgcctcccgggttcacgccactctcctgcctcagcctcccgagtagctgggactacaggtgcccaccaccacgcctggctaatttttttgtatttttagtagagagagggtttcaccgtgttagccaggatggtctcgatctcctgacctcttgatccgcctgcctcggcctcccaaagtggtgggattacaggcgtgagccaccgcgcccagccctccttggattttttaaatttcagagacaaggtctccttctgtcgcccaggctggagtgcagtggtgcaatcacagctcactgcagcctctacctcctgagctcaagtgatcctcccacctcagcctcctgaggagctaggcccacaggcatgaccactacaccagctaacttttacattttttgtagagatggggtcttactatgttgcccaggctggtctcaaacaactaggctcaagccatcctcctgcctcagcctcccaaagtgctgggatgatagacatgagccactgtgcccaggctgcttccagatttttttttttaaagggccatcaccaccaagacacgtataagaatgttcacagtggtttcatcataacagccccaaactgcaagcaacagaaacatttatcaacggtcaggtggataagtaaattgtggtaatttttttttttttttttttgagacaggtctcactctgtcacccaggctggagtgcagtggtgcgatcttggctcactgcaacctctgctttcttgggctcaagcaattctccagcctcagcctcccgagtagctgggattataggcgcaagccaccaatgcttggctaatttttgaatttttgtagagacggttacatcctgttgcccaggctggtcttgaactcctgagctcaaagcaatctgcctgccttggcctcccaaagtgctgggattacaggcatgagacacagcgcctgcccctattgcggtaaatttatgccatgaaatactgtgtagcaatgaaaaagaaacattgaatgtgactccgtccacgtcaagttcaaggacagggatggtgatagaggttggaagggtcctcccttaggggacaggggaggggtaacgactgggaggggatatggcacttccccagaacctagaaaggacccaaatcttgatctgggtgattggctccagaagggcatgtgaaggcccgtcaagctgtttgtacgcttaagactgtactgtgtgtgtgttataccttaatttttaaaaattattattattattattactgatgggcaatcagttttacctttcttttttattttatttttagagatggggtcttgttctactgcccaggctggagtacagtagtgcaatcctagctcactgcagcctcaaactcctgggctcaagtgatcctcccatctcagcctctggaggagctgggactactacaggtgtgtgtcaccatgcctggctaattttttaaagtttttttgtagaggtgggatctcactatgttgcccaggctggtctcgaactcctaggctgaagtgatccttccacctgggcttcccaaagtgttgggatcacaggtgagaggtgccacgcctggcctatcaaactttttgatgtttgccagtctgacaggtggaaaacgctatgtccctgttgtattacttcacatggatttaattacaaacgaagcatgctgactgacctgctcatattccgtgtgtttgtaccctttcaccattttttccattggttgaattctctaattttggggtctggacactcccactgagggtccagtcctgtgccatccactgtgccgaaggtggccatactcactcccaactgcagccgcctccaccccgcaaggacagagttgctagcttcgacagagaccctctggctcacaaggcctaaaatatttactatttggagctttcgagaaaaagtgtgccagttcccatgtctcattggtttacaagagttcttagtaaattaaggaaatagctctttgccacatatactctgttttgcatttagctcatctctctctgttctccctcctggcctctgaataagcaagtcagaagtaaaacttaaaagcagaagcctgcagaaccccttgacacatttggtgcgtttggaaacactttggtctatgctaatctaggggtggtatcattattattattaatttgtgatagagtcttgctctgttggccaggctggagtacagtggcacaatcgtggctcactgcaacctctacttcccgggttcaagtgattctcccgcctcagcttcccgagtagctgggattacaggtgctcacccccatgcctggctaatttttgtacttttagtagagacggggttttgccatatctcaaactcctgacctcagatgatctgcccgcctcggcctcccaaagtgctgggattacaggtgtgacccactgtgcccagctaggggtggtaattttatacccattttacacgtgcagcaattgaggctcaaaatcatcatgtgactttgttggggtcaccgagattgcaggcagtggagccggaatgggcaccttgtctgtcaggctctaagtctgtagatctctccagaaagcaggtttgcctttttttttttttttttttgagacaggttcttactctgctgcccatgctggagtgcagtggtgcaatcacggctccctgcagcctcaacttcctgggctctagcaatcctcccacctcagcctcctgagtagctggaaccacaggcgcatacctccatacctgcctcatttttaaattttttgtagagatggggtctcgctatgttgcccaggctggtctcgaactcctgagttcaagcaatcctccgctttggcctcccaaagtgctggagtgctgggattataggcatgagccctcgtgcctggctttttatttttttttaatcttgcctcttaaggaatgaggccagtcccaggggacggcagaaatcataaccagcattgtcctggcaggtgttgcctttgataccaccatgaccgaggacatggcatggggcagcccccattctgctgctgtgatacttgggtataaagacagcaaattcctcagttgcagaggggcaggaaggaagatgacatgctagacacagaaaccacacaaaggaggatggagccctgtttgtgagcatggatactacacatgcccctctctggctctcacacttgcaagaataatgcccactaaggaatggccccggctgggccaggaggaacccagcactttggaggaatgactgtgcttggagtagcaggacaggggaagaagaagtgacagccacacagatgggactggaaggacttttatcaccctctggctctcggccaccaacacctattacagaaatgtgacagcaaccattataatctctgagcccttgaacaaatcacaacccaaaaggttaccctcccgaaaataatcaccccattaaaaccactgacccagagagcggcagtccctcaaggagagaacgcagacaaggcatggggcgtgttctttgtatggagcgtgcagtgccctggccgtgattttcttatgtggcctgccacaggaagaggctggcatctggaatctgtgccttctaatttttattcttttctttttttttttttttttgagtcggagtctcgctctgttgcccaggctggagtgcagtggcacgatctcggctcgctgcaaactccgcctccgtggttcaagcaatacccctgcctcagcctcccgaatagctaggattacaggcgcccgccaccaccctggcataattttttttgtatttttagtagagacagagtttcaccatgttggccaggctggtctcgaactcctgaacacaggcaatctgcccacctcggcctcccaaagtgctgggattacaggcgtgagccaccacgcccagctgccttctaatttttctttggcagaagagcatgtttaaggggctccctcgaaggttctcttttccttctctttttgtttctgtatttcaatcaatcgatcaaaatatttcctttctttttttcgtttttttttgtttgagacagggtctcgctctgtcgcccaagttggagcgcagtggtgtgatctcggctcactgcaacttctgcatcccagacccaaatgatcctcctgcctcagcttcccaagtaaggagagacccctatgcctggctaattttttagtattttttttgtagagacatggtctcatcacgttgcccaggctggctggtctggaactcctggactcaagcgatcctcctccttggcctcccgaagtgctgggattacagccatgagccaccgtgcccagccaatcaagctattttctagactgattgggtactgccaccaccaagagtgagggtttttctacagggtagattgacggagcatcagctcggtctgtgatttccttgggcctcataattcccccgtaagattgagattgcagataaggaatctgaggttgcaccagaaaaaagtaacgaggtccatccagctggtgtttgcggggataccggcactgcagccctgggtctggactccagggtccaacctctgatctgctccagaccttagtcatcacggcaaaggtagtcctagctcatatgccgcattttctcattttatgcttggtgtaactgacaatactgaaaataaccagtattgatatcctgatttcattagagaaatgactctcagagagcttaggtgacgggaagcctgtctaaggtcacacggctagcacagatcagtagtcatgcctcaaacccatgccttcatgggctccaacccaaaagacggaatgctgctggaggcgctgcctgcaaagcagatagtgcagggcctggccaagagggaatggaaagtgtttttttgttttttttgttttttttttttttttccttttttggagacagagtctcactctgttgcccaggctagagtgcagtggggcaatctcagctcactgcaacctctgcctcctaggttcatgcgattctcctgcctcagcatcccgagtagctggaattacaggcgcctgcccaatttttgtatttttagtagagatggggtttcaccatggtgcccaggctggtctcagactcctgacctcaagcgatccgcctgcctccgcctcccaaagtgctgggattacaggtgtgagccaccgtgcctaaaggcggtttttaaaatggattcgaagaggctccatttttcagcatttgacacgccttttcatcatcatcatctgaaaatcgggaccctatttggcctttcatgcccgacatgctatgaggagctacaatcacaagtgcgtcttcaactccacggcctctgccagccaccaccaagccacagtcacacagcccctcagtcccaggaagcaagccttttatcggaagggtccagaatcactgcataggataaagaagtccagacactgcccctctttttttttttttttttttttttgatacagggccttgctctgtagcccaagctggactgcagtggcgccatcttagctcacggcaacttccgcatcccaggctcaaatgatcctcctgcctcagcctcccaagtagctgggactacagctgcacaccaccatgtctggctaattttttggtattttttgtagagacaaggtcccgccatgttgcccaggctggtctcgaacccctggactcctagaacctgggcgccctcttgtgaccctgccaaccccttcctagtacagtgtccacaggtggctgtcctgtcccatctcccagctccacacccccttttggtggggatgcccttcctccctgagattttcagcaccatctcggcctggaaccttccaggaatccctggaccttctgagtcctaccatcacccaagctcactccctgctgcccttcccactcctcctaattctttaccatctcatgtgtgtctcagccacactctgaccacggtatacacagactgtgtgatgaacctactcagggtggagcgctgcttctcacatccctcctgagccccctgcggcaccaagtacaaagccactcacacacgcccactgatggatttaaacaagcgtgtcatctttagaagagcttggtttagaagtcttttttttgagacagagtcacgctctgtcacccaggctggagtgcagtggtacgatctcagctcactgcaacctccgcctccccagttcaaacggattctcctgcctcagcctcctaagtagctgggactacaggtgtgcgccaccacgccgggctaattttttgtgggtatttttagtagagatagtgtttctccactttagctaggctggtctggaactcctgtcctcgggtgatctgcccgccttggcctcccaaagtgctgggattacaggcatgagccaccgcgcccgtccagaagtcattttttaaaatcacataaaggatgagcggatacacaaaatatggtctatctgcacaatagaatattattcatcctgaaaagggaaggagattcagtcacagactacaacacagatgaaccgtgaggacgtgaggctcagagaaataagccaggcacaggaaggacataggttgtatgagcccccttatatggggtcccgaaagtcatcagattcctagagacagaacggggaagggtggctgccaggggctacggagggggccaggaagctgctgtttaacgggggacacagtttcagtttgggaagagctggatggtggtgatggccgcaagataacatggacgggcttaacagcactcaactctgcgcttcaaagtggttcagcgagctcattttatgtcacatgtatttcaccacgatttttaaaaaaatcacatcaaggaccattcatgcattaacagaagactgctggggccagtggagccacggcctgcctatctgatacccaggcaagtaacatccacacgggtccaagcattccctggccttgaattacgctgagtcctggtcactgttgcgctcctcagggcagccctggcctgaggcaggggtgtcatctctttacagatgccttgctggggagagaaccggagtttccgcgaaagcgcagaagtggacacttacggagaaattcctgtcctcatatcaattcccggctcccgggatttccggcacgcattatgcacaggctgagcgctcaataaatgtggaatgaacgatcgactatttttctcccctttctggtaggttggtaaccttataccttcaagacgagtcataaatattaggagaaaatgttttgaactacaaatcaaaggctttgagagcaggccaggcagagagaggtcagtttggtccaagaccaagtttgtgtgggcagccccgaagctcacagctgagaccactgtccatgaacctgggtccccgtgacagcctccagcggtgctcagagcccccgagggacagaaacaccctctctgcccctatctgcagagggggctcagcagaaggcctggtggccccatcgggcctggaggggcctcctgggggaggtggctttcaggcctgaggccgctaggacctgctccgggtttcagtcgggaacctgggccctctcctgtgcccccgccaccccctttctagtacagtccccgcggggggctgtcctctcccatctcccagctccacacccacttttggtgcggctgcccttcctccctgagccaggccccaccttcccaggagcctctgagtcaggctgggctgtggtctgcaaacttccgggcctttcaggtgtcagaaaagtttctcttcctccctctggggcaggtgcaccaaggggctgcagcctcctgacccccgattttttcctgtccagtaggaggaggtgggggctttgctgggcggtgatactcagagacgctcaaagagacacggaggagaggcacacgaggtggaaagtgagggagaaaaagggttggaagggaaaaaggggagaggagagtgagagagagaaggggggcagggggacagagatggagagggaaggatacccccagcatcgcgggaccagcgggagccactcccatcccccgacgccccccccgccaccgtgtcatctcactgatgccccccatctcctccccgtgccctcttctcttcccccaactccccgcctcgtgctccccctccgccagctcccccatccccgctgcgcctacctggggcgctcatgctccgccagccagctgcgcggggcgcctcctccacgcaggcctccggcttcctccaggcgaccaggccctccgtccccccgggcccggagccgtcctccgaggggcgccgcccgcccaggggctgcagggccgggagggggctgcgggcggcgcgggcaggagtccgaaggccagaggaggcaggagagaaaaaa

SEQ ID NO: 1563 - DNA, 9726 bp, Homo sapiens
tgcgggtcacccgtgctgtttatttacgcagctgtgttttctaacactaatacaatgcatgcatgtattgtgtgttacatggtgaaacagaacagatcctgaagttacacagatggcgtgtgcatgggggtggtgagcacccgcatggcctccgcaaaatgagtgccgcttaacaaacggccccaatgcccggcagtccggctgggcctttcagggcaccagattcctcgttccaggccaagtcagcgacggctcggggaagtctgcgccccagggcgtcggcacccccgggtggcaggaggccgggccggtgggtgtgccctggtcggggcctgcgctgctgcggctaggagccctcagtgtcggtgttgtcgctgcccgtggtgttctcccggtcctcctccccctgccgccatcctttctgcatcttcctgagggcgcgcttcctgtgaagacaggtgtctcaggcgcgacccggctgccgctccccagcccgttttggagaagcctgggggccgcccgcctacctgcggtagttctcaaaactctctttgaggcgccgccgctccttctcgggcggctccccgctgctcaggcctgcgtcctggagaagggggaaggctcgggctccggccggctcccctgagggaacccgtccttctcacccgccccccactggcccctgtaactgcagactggttgggaggcgaggagcccagacagcctcagctcagcgccaagctctccctgtgggacctgcctgtacccctggaggtgagccggtgtgggtagcctgcatttcagatgccaagacacacccaggaggccaagccacggctccagcctggggtccgggccattgtttctacaacaaagcccgaggtggtgcttgctctcaggactcctgtgttcacctcctcatccactgtaaaggccctcggaaaaccaggaccaggcacatccacgtccaaaaagccccccaagctgctgcagtgcccaagaaagggggatccacttcgcagcccagacaccgcaccccgagcactgtgggcagagaccttgtggtcactcctcagctgtcgtcggggccaccgcagggggtgcccagggcagggagccactctccctgtgatcggtcaccctgaggcccacggctgggaggaccccaccccggggaagccttacatgggggttccgcaaaacctgctcctggtgcagagctgcaaagggctgtttcgggctccccccgccggcaaggcagcctggaaaggagagtcgtgcctgtgggacctgcccatctgctgggccacgtatagcacggctgccccacccctccccggcattgcagtggggctgtcttccaaggcctggtgggatccccacatgggtccagtgtagactctgctttctgtagatgagactgaggccttatggcctcgcttgcctgttcattgctccaggaggccgccagatgccagcccaggcccaacgctcccgccagtgaccatccctcccccgagctggctgcctgccagggaggaacgcctcccagacctcgggggaacttaaaccctgggcctgagcagcaccgtcccccatcactccaaagcatctgtgggcatggcggccctggggagagagttggggacagctacagtggctgtctgggtcctcctgaagtgggggcaggggtactgcagcaattgggagagaaccttcaggcggctggaccccctcagaaaccgccaggacctgggcagaccagggatcaggacccttgggcagaaaccacgcacgtccagtctcagccccactgcggtgagggccaggccagggctgtcctggccattggcagccccttagagccagcccctcccctgctcaccctccaaccttcacacctgcccctgctcctgccacagccacccagggggatgggggcagtgcctgagccggactcctgggtcctgctcgcctctgtgcctacatgggggcttggcatccccatgttcaagtgttctgagctgcagccaaaggcgctggtcttcacttccccgtctgcggctcctccttccccttccgcctctgcttggaggccacggcctggtactcaggaagcttgtccaactccggtgcagcctcccaggacccctctgctgggccctccccaacccctacctgacagcaccttcagtgcaaacacctacctcatcaccactgcccactcctggacactcgggagctgctcccagctagccacccagtccttcccccagacaggcagagggggcctgccctgcccgctagaagcccctgccactgccttacccccactgcaccgggacacagcaggcccttggccacccctgcattcagccctttccctcaagccacgtggggccccatctcgccccatcttctagcttcatgcacctggtcgttcgctcgttaccacctccctctgtccaggaggaagcttggagcagccaggactgggcctgctcacctctgcaccccgtgggggctgcccagaggggccccacactctcaggacggtgggcctgctcacctctgcagcccatgggggctgcccagacccccacactctccaccccaggggacacttgtcccactagctggggccctgggttccagctgggctctgtagtttgttctctaggtgaccttgaccattttacttatccccagccccagtttccctgtctgtggagtgggggttgtgggggttgacacaggcattgcggcacgggctgcctgtgctgaagatgggcctcacttggggaagctgggaggcctctgggtgtactgctgtccccacctcacctttgtctgagagctgggtgtcctccaggtcctgggggagtgagagcttccaaagagagtcaagatgtcccattaggccacttcgccaaggactggacccggccacactgcccaccccagcccttggccctcagctgggtgcagccattgccgtcaccccctgcacagagcttctcagagactcaggtgcccagcagacggacattgggcggccaggaggtgggcactgtccgtgccttaccttaccccttgagccatcagaggccttagcatttggccacctgctcttcctccacccagcccagcccaccgagcagggccatgtgacgggcagtgtggggctatgcctggtggcagctcagccaggaccccaggtgaaggaaggccagcctcgtgctggctggggtctcactcacctcctgggacctcctgggtgagccatcttccaggtcggagctctgtggtcatagaaaatggggtgggtgggctgtgagggcagagggctccccaggcacagggtgggcagggcacagagcgggatcctccagggagccctgggcatgccctcagccacaccaggccccctccatgcccagaacaacctgctaggctgcctgatggccaggcccaggacccaccccggccctgcagccccacttcctgctgggaccctgaactgctcgtgtgccctcaccccactgccaggaggggtttggttaggttggggcccgtcacagagaagggttgggtcgggaaggccggggctgaggctccgtgctcccctggccctgcatcccacgcgccggctcccctccctgccgcaggccccaggcccaccaggacgagcgtctccagctgctgccgcctgagcctgccctccacggccagtagctgcgcctcacactggaacacctgcagctgcagctcatccgccttctcgcccagctcccgcacctgcttgcgcagcgcgtccttctcctgcaggccccgggcgtgctgtgcgtgcagctcctcccgcgtggctatggcctgacgggacagcacaaggccgaccctcagtgagggccccaagcttgccctgggccctcggcccggccgcccaactccaagcagaggctccggaggacgtcaagccgctgggcgcggaggctggtcacagcccctccatttgtgtgctctgcggacacgaagtcagcacgtgggggattgtaaatgtgacagttgtccctgctgcccttctgtctcctcccaagcctgcacccccggtggacacagcgtgtgctatgtacccccacacgtgcacatttgataaattttggacgcggcttgatatggagaccctgactgtccatagctaagcgtccttcgtgaccgcagcactctttaccacccctgtcctcactgcggacactgagacgcaggagcgaatgtgcaaacacgacggcttgaccacccctgcagccgaggctgggaggccctcacctaaccccttctgcccagactggagcaacggctggcagcttccctaatccctggccaacgcgctcccgggaagtcccgtgggagcccccgccctgggagccacaccaacccccatgggggcacagctggatctgcccttttcccctgccttggcgtgggccaggcgcgagtgaggctgaggtggggctgagacaggagctctgagcctgggctgctctcatgggggccggggcttcctttgtagccccaggggtctcgttttaaggctcctgatgtggacaaagtgccatccagcatttagccgaagcagcaatggtgtccattggaaacaacctccaggatgggacttgggacggggcatgggaagcagacacagccctgccccgcgacgctccatccggctcacagcacgtagcactggaggccttgcaggcctcactcccgtggcccaggctggagtgcaatagcgcaatggtgacttgctgcagcctcagcctcctaaatagctgggaccacaggcatgcgccaccacgaccagttaattttttttttttttgagacggagtctcgctctgtcacccaggctggagtacagtagcgtgatctcagctcactgcaacctctgcctcctgggttcaagcaattctcctgcctcagcctcctgagtagctgggattacaggcgcccggaaccacaccaggctaatttttgtgtttttagtagagacggggtttccccatactggccaggctggtctcgaactcctgacctcaagtgagccgcctgcctcgccctcctagagtgctgggattataggcgtgagccaccgcgccaggccaatttttgcatttttttgtagagcagggatctcaccgtgttgcccaggctgctctggaactcctgggctcaagtgatccgcccgcctcagcctcccaaagtgctgggatgacaggcgagagacaccacgtccagccaagctttttttaagattaaaaaaagctactggtaaaacaagacagaatgtttccatttttgtaaaacaaaaccaaatatataaatagatagataggtgatagatgatagacagatggatacatggatagatgacaggtaagtctgtaaggtggagcgggaaggttgaacacggttttccctgacagtaggctggggtggggaagtattgacttcatcatcgtttacttttttttagtgttaagtattgcttctgtcatttaaaaaacagaccaggtgtggcagctcagcttgcaatcccagcactttgggaggctgaggccggaggattgcttgaggccagtagtttgaggccaccctgggtgacatagcaagaccccatctcaaaaacaaataacaaagattaaaaatcctctgacaactgccctcaagggccgtggccctggtgcacccacccgcgagtggggtgctttgtcctgcccctgcgagtgcccacctggtcccgctcaatggcgacctcctccatctgcagcaggatggcctcgatgcggtccttgtacatcttggagtccttacgtagtgccaggcactgcagctcgaacatctccttctcctccatgcactgcagggggcggcagctcagcccccacaggcctgaggccccccattctggcccttggggtatactccgggcaggggctcagaagcatgtggtcaggccagttgggatgtcgggggaggccataggagtccccaggcccctaccagccctgcacttccagaccgcggcaggacagggccctccggcaggcctcagacactgctgtgcctcaggcaccatgagcccagaggttggcctttgccatggggggcaggcgggcaaggagagggcaccgtccactgtgcctccaggagtgggtgagtggaggcgctgcactggggtctccacaccccaccttccaggcacggagtgggcggagctcagcccgtccagcctggcttggaccccaggggccatgtctccccgcctgccctcctacccggaggcgtcgggcctcgccctggcggaggtccttgcgcagggagaagatggtgttggcctgctcctggtggtcccgcagcgcctgccgccagtcctcctccagtacctggatgtaggggctgctcctgtccagcttcccctcctgaagggggcaaaaggcaatggcctggctgggaaggcccccactgccctgcctgggctgcacctgccctgcctacggccccacctggacggaggcctccagctcctgcacccgggcctggagcagggccttctcctgctgcagctcccacagcagctcctggctgggccgctgctccatggcgtgcctgagcttcagcgtgtgcttgcgctccaccttgcagtcgtcctcggccttcatgaggctgtgcttgagctggtcaatctgcagaaggtccagtgagcctggctgtcccctccaggcggtgaccgcagacccgtggggccacccccgaccgccccggcctgcagaccccgccaggccaggcgagggtggcctggtttcccgggggcagcgggcgcacctccagctgcaggtcacggttccgcatgagcgcggcgcccttctcctcactctggtgcgccaggcgcatggccaggtcgtagttctcctccttgcagcgcttgagctcgcggctgccggcctcgcactcctccttgagcctctgcacacgctcctggtgcttgcgcagcaggctgtccttcacccgcagctccttgatgaagtcatctttggagctcagcagcgcggtcaggtcctgcaccttcttctgcagcttcatgacctcagtcatcagcagctgagtcaggcctgactccccggacgcgtctgtgggccaggccagtgtcagatggtgccgtgttccccggtggcccagctccatcacgccctgcgctgtggcaggagctcagggctcctagggatgggggccaggcagaggacccaacaccactgcccgctccccgccagcgcctcccctgtcggccccgcctcccccgtcactcaccgatgatcatggagaagacgcgggccggctccttgcctgtgaccttcttgtacagctgcgggtagtagagctccaggctctcgaggaaggccacgtagcccttgtggccggtccgctgcaggatgtccaggagcacacctgcgggccagagaggcctaactgggggcggggcacaggcgaggcagagggctggggtgggtgggcctgggggcagggacaggtggaggctggcatgcagatgaggtgtgccgtggtctgggtcttggatgaggtaccctgcgggtcttggtactaggctggggaccaagtgctgcccacccgccccttggctgtctcaggagcccccgctgcggtgggagccccgctgcccctcttggcagcaccaagccggcaggagaggctgggggacgggccacgtgccagggttgaggttgggcctcagtcagaggccaggggcaaagccaggcggggctctcctggggttgagggtcagggtggcagagcgtgcagccacctccgagctgactctgtggttgggtttggggcctggggcccgcggggcaacactgacccactttccgtttgcggatgaccaggttggggtcgctgagcacctgctcctcatcatcggggttcaggaccttgcactgccgcaggtaaggtgtgatgcgtgaggggtcgatgaccgaggtgagcgtcacccggaagccctccaggacgctccagcactcgtcatcgttctcgtagtccgacatggcctcagcaggcaggctggggagtgtggggcagtgctgagagcgatgccggctcctgcccccacccgggcccagctcccactccttctcagacgctgggccagggctctcgtcagggcatcgagggggatcagcccaggggcatccaggagaggtgcccagctccatgtcccatccccacgctggatcccccagggaggcagcagagacacagtgaccccgctccccaccagaccagccgagggcccctccgcagcctttcccagcccttgctcctgcccgttggcatccatgtcacccagatacgcagcgggggaggcacagatggggtctgagagaggaactccccctacagcatgaccccctctggcctctgcctcctggacactcccatcacgccctggagcctgcaaggttagccacctccatggctggaatgggcagaggagctgagggcaactgcctggcactatggccagcccaagctgggtgagagcaggttggccagtggccctcccaccagcacagcagctgggggagccggttcttgtgggacttcctcattcccctgaccgacgcctgctcacatccctggctgtgccctccctcctccacggccggctgctgatgatgcaagagtggccacccagccctgctgcagctgcggggtcgctgcactggccgggaagagctgcccacaggagcgtgtctctgtcaccccctgccggccccgcaaccctgggaggggctgtcagtgttgcccttggctggccaggagtgctgctgcggtgttttctccaggttgaggtgccgggcaccagtgaatccctggactcttctcctgccccagatgaggcccggcccccatcccagtggctgcaacagaactacccatgttgggaccagccactgctgtccctttctgccagcatggtgggggcctcagccgctgaaagccactccctctgagactgggactgcggcaaggctgggagcagccacgtggtcctcagacagcctccagccccgctgggaaacgctggtttccagcccagaggagctgggtcactgctcctggagacatagttgccccaggcttggtcttttgaggcatttctcaacttcccgctgcactttgtcaccccattcaggacagttttgacagacaagggactgaataaaaacactggccacacggtagacagtcctgggaacactgggcccctttcctgcttccccagcttgaaatgcagggtcccatctgccaccgtaattccactgaaatgaacacatctccgcccaggggccgtgaaagggacggggccgcatggcggaggctgcctggctgcctgtgggaagcctcaggctgctctgggggatcagtgccaggatcctgaactaggccaacgccaaccttcctggccacctttcagaaagcaccagacccacccacctgagggtcttccaggagccacctgcactgcagacacaccaggagcctgggccgcggagcctctgggagatgctgcccggggctgcagggagggaggagcacgccggacgcctgtgcacttcctgatgggttctgcttaactccacagtc

SEQ ID NO: 1564 - DNA, 9726 bp, Homo sapiens; identical to SEQ ID NO: 1563

SEQ ID NO: 1565 - DNA, 54269 bp, Homo sapiens
gtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1566 - DNA, 54269 bp, Homo sapiens; identical to SEQ ID NO: 1565

SEQ ID NO: 1567 - DNA, 54269 bp, Homo sapiens; identical to SEQ ID NO: 1565
